United States Patent 8,067,671 (METHODS FOR GENETIC CONTROL OF PLANT PEST INFESTATION AND COMPOSITIONS THEREOF) - sequence listing, part 28

SEQ ID NO: 42632 - DNA, 1283 bp, Heterodera glycines
  misc_feature (47)..(47): n is a, c, g, or t
  misc_feature (180)..(180): n is a, c, g, or t
taagaaatgaatgactttcctttttatgttctttgtctgtgtgttgntccataggtaataaatcgggtcaaaacgggcggtgaatggatgatcagacgatcaaagtgtatcattaattagctaatgagcttaatgacatgcgtaaccgttcaatgtttttgcttaatcctcacggattgntgagaggcgacgactgcaaatggcaaaaacggctgctgctgatgtgcgaggtgcgtttacttgtcgcgtttcacatttttgatcaaatgacgggcaaagcgataaagcatgatttattagcattaaaaagtaacaaaaaagaagccatcttcgctacctaagctcaaatatatttaatagaaataatacaaacataaaaaaggaataaaaaaagaaaataattaattttcaaaaaaataatgaattttaaaaatctatgctgttcaaaagtttgtgttaaaagattcatcggtcaaatcatcattaggatcattttcaagatgttctctcaaaggaaatatttgattaatttccccaaaatttttttattatttttcactattcaaatatgtatttttgtagataaataaataaaaaatataaaaataaaaaatcgcacgatgaaggataaatcaaaaaaaaaagaaattttgtcaaagttacattgggtggaaggaatggaaattattctcctaattaattaaaaaactcaatttctatcgtttatttgacaataaatgttttcacaaatctctttgttcttattcttatgtttagtaatcagaagaaaaattgtttgacaaatctattgaaattcaaaagataattgctttattatgtaaatttataaattttattgattaaaatatccagtaatgattatgtaaattcttaggttttactgaacattaattgtatttatgttacacagcgactgacgaattaaacattgcgttcgtgactaggaaaaaattgaaacaaattagcatcatgtgcattaatcccgaaataattttcaacaattatttatttgctaattgaaaaagcatttttaaaactgagtcagttaaatgcatgcatcctttcagtcttcgatcagttttttgacttcagcagcacttcacactttcgcattttgaagcagtacaagttggaccagtcgactttgcttctccagcaggacaacggacggtgaccacacacttttggtcattgcagctcaaacagacgcaacagcagtcgccactctccgtgttagctaatattttttaaattaaaatgaa

SEQ ID NO: 42633 - DNA, 1502 bp, Heterodera glycines
  misc_feature (13)..(13): n is a, c, g, or t
  misc_feature (22)..(22): n is a, c, g, or t
  misc_feature (31)..(31): n is a, c, g, or t
  misc_feature (51)..(52): n is a, c, g, or t
aaaaagttaagcntaaactttntggcctgtntaaaaaggaattaaaaattnntaaaaatttattcatctccctttttgatagaaaaagcatcagagtgcctaaaatagcttgtaaataaaatttggtgcgtttcagagcactttctgaaaaaaaaattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttagattttttattcatctccctttttgatagagaaagcatatgagtgcctaaaataacttgtaaataaaatttggtgcgtaaaagatttgatcgtcccataaataatttgtaattgatc

SEQ ID NO: 42634 - DNA, 1454 bp, Heterodera glycines
  misc_feature (51)..(51): n is a, c, g, or t
  misc_feature (57)..(57): n is a, c, g, or t
  misc_feature (61)..(61): n is a, c, g, or t
  misc_feature (187)..(187): n is a, c, g, or t
  misc_feature (246)..(246): n is a, c, g, or t
ggttgacctttttggtgtgactcaaggtctttcttttcctctaaggggggnggagangagnaagaaggaggggagaaagtcttatgaagagaaagaaaaaaagaaagagaaaaaggaggaagaaaaaggaaaaggaagaggaaaagaggaggacaaaggagaagaaaagagaagaggaaaagggaangaagaaaagaaaaagaggggagaggaggagggaagaaaaggagatgaaaagaaagaaangggaaaggaagggagggagaaagagaagagaaaaggaaggatagattgaggatttatttttgatataaaaaaaaatagtttagagttaatatttgataagggatatgtaaggagggttaaaatttcttaataagttgagtatatattaggatttgatagtatagattttatgatataggaaaatgaagaaaaatttatgttagatatgaatggtggagtataatattttaaagtttataatcgagatttgattgaagcaatgatgattggtgatgtcatagtatcagtgttacgcatcgtcacaattcgaggaaaaccttgatgaaatagttgaagaacaatttttagcaatacaatatcacaaaattttaattaaggaaatttctgaactcctgatcgaaattcgtacaaatagcgggagcctaatgccattccatatggaatatgtacattaactttacatttccgaaaactgtcctacttctgaagatgaataccttggaaattgataaaattttatcgacaagcccattcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtgtggtcgtcatgtgctcttctttttgtttaatagatgtctgggaactccctttgaaaagattgtaagatttttgcattttggaaaaacaacacctgacacacttgtgagttcttttgttacaagaataataaatataaatagttgaaaaaatatagttttttcacaaaaatgcatgtcgattttgatccccaccaagtggattggtctacattctcgcacgaatttattcaatatggaggttacaatatttttcgtggtgtaccatatcagcgcggtgctggtatcggttcagtatttagaagcttaatgagatttaaaggaccgatagggaaacaaattggatcgtcaattgcatttaaagggcttgaaagcgggaatcgagtgttaacaaatgtat

SEQ ID NO: 42635 - DNA, 1233 bp, Heterodera glycines
  misc_feature (1226)..(1226): n is a, c, g, or t
gacgccccaatgcaaaaaaggaaattggcgcctgtgcccgcatccgaaggaattgcagtggcggtaattgtagtggatgaaaaagcagttgaattagccagaaacggagcatctgcaaaagtaattgtttatttccgaataatttatttacaatttaaaatgcagattaaaaattgcaatagtttgctggggcggtgccaatgtttaattcctaacaataaacctaaaatttgtggccttttttgctctttttcacaaattattttttgcaatattttttaaaattttgtgtagggaatgaaccggcggttgggttggcggtgcgtgttacagaagaaaaaatctaacagttttaatgaaaatattaggaagattggccaaatttccagaactcttccctcccttttttaccaattgctgtgtttggtttcgtcgtcatcgttggtgctcccccaaacagaggggcgttggcgattgaacttgtctccgtcaatgaactggacgcagttctctttccatacggcgaaatgtcatcgactgattgtgcagccgatcgcttacgagatcgaccgttaacttgtggttgtgagcctgaaaaggagggaattggagcaggacgggagtccaatagtaaaaaagtcttacaataccccgagtttatttcgaaaaaagccggtaagcctgaaacaattatgttctattccgcgctctttcgacatggcatcccaggggaattgggtgggggcgtctctctcaccattactcccccattccaaacccacaaatggaggaaaaactatgcaaaagaaccaacttttgtagaaaacgaaggtggtttttttgttgttgttagttttggtatcaaataataacaatttgtttaattcggtcaattatgaaatgagttataccccttaaaaccggtctattgccaagttgtaacccactgcaaaacctcgttgataaaggaatgatcacacagtgtggtttgtcattcggagatttgtatttataatttagcaaaaaacgaacttgtcgtgagggtgttggcggtggtcgaaccgaagagagtgccaccggcggcggaggagccaaaagaagggaatttggcggtgccgaaagagaaggcggggacggaggaaggcacagcggcgggtgccgtcgttttctgctgagtgccaaagagaagcgggagagtggccgaggcggtggttgtggtggcgccngggggaa

SEQ ID NO: 42636 - DNA, 1234 bp, Heterodera glycines
ccgaaggatcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttttgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaaagttaaaaattcatagaaaatttaaattaataggtactacagggaaatcaacgcagagacgcctttccttgacctttttag

SEQ ID NO: 42637 - DNA, 925 bp, Heterodera glycines
ttcatcgaacctggttctttctattctctttcaaatcctcccccattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttattaattttgcaaaattaattcataaattttttttcagaaactgctctgaaacgtaccaaaatttatttacaagttaaataaggcacactgactcttatattatcaaaaagggatatgaataaatattttaaaaatatgtaattccttttta

SEQ ID NO: 42638 - DNA, 1232 bp, Heterodera glycines
  misc_feature (22)..(22): n is a, c, g, or t
gatgcagtcgcggcgttgacanctgagatggacccaaagtttccataatatctttccataaggctggaaaggcagaattgaatggccagtcgatatttacactgagcacccgttgaagcgggtgatgcgaagccatagcaaactgtattttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccggtgaagcgggtgatgcgaagccataccaaactgtatttttaaattctggccgcaattctaccaaaaacgtgtttagaccgcagtaactcggctcagagtgaagattaaggaacgcaaaagagatgatttaaaagcgattcgaaaattctatcgactgatataataacgatgcagtcgcggcgttgacaactgagatggaaccaaaagttccataatatctttccataaggctggaaaggcagaatttgaatggccagacgatatttacactgagcacccgatgaagcgggtgatgcgaagccatagcaaagtgtatttataaattctggccgcaattctaccaaaaacgtgtttagacc

SEQ ID NO: 42639 - DNA, 1179 bp, Heterodera glycines
cccaacccactaaaaacatatttaataaggcacattatttctccccgacggaaagtgtggcgatgatacgggccaacggacattgtcggggtgctccatcttagcaaaaaattcaaatttaaatgtttgaatttggcatttgtgccgtgccgaccaaatcccaaagtttgcgctggaatttgttactcggcttccgatatgccgactgaacgcggcagccttcgctctcgcaaaaatttgcccacacgtcgtctttcaattcgtagaacaccaactcgtcgatgaacagctccaccgggatggacgcctgacaaagacaaaagaaagattaaaggttaaagccaaacatttaaattaaaatttaatgaaaatttctaatgggagtaaaaaggtatttttaatttaaaaatattatatttttcattaactagcaattaaaaaaaatatattttggcacaaaaatatttgaatttacttatgaaatatattttataaaagtattcaaaaatattagacttaatttcataaaaaaatattttaatttttaaattaagaaattaatgacctattttattaaaaaaacaatcagtttatatctttccgtttattagttaaaagaaaataatttcgtcaagaaaactcacgggtctgatcacttgtccgcccgatctgtacacgtgcagaatcgcttcgaaactaagaaaatttaatttaatttttttaatttggcaaattgacaccgcaccattgactgcttcggtcgaggaaaatctcatgcaattggtcgttccacagctccttgcgcttctccggatttcccagcaacgagtcggggaaacggcgtaaagtgctctcaaaagtcttttgggaaattgggaaaaattccgtaatttgggatatggccatttttcccggccaaaaaatatggaaaaacaaaaatggcatttgtcgtgggcaaaaaaaaaatatatatatttgcccgagggcaaaggagggcgaagggatcagttccgtctgagccaagtttagagcatcataacttttttctttgttgaccaaatccaataaagttggtatcattcgaaagctcttaacaagctctatcggcttcccatagatcagataaaacgacatataaaaaagttataaattaaaatatgcaaaaatactgactttttg

SEQ ID NO: 42640 - DNA, 844 bp, Heterodera glycines
tgtgcgaacgaactcatgaaaagcataatgaggttttctcccccaagaattttagaattttaaaaataattatttttaattctttaattgtatttctaatttgttcaaatgttggaagaaatgtccgaaaattagtttggaataagcttgggagcaaaattctataattaaaaaaaacaaaattttgtcaaaaaaacaaccatttttttttggtaattaattcttattttatatagatgaaatttttgatttgtcaatggtaagaacaaaaaaatttggaaagattgaaatgatcacaatttatgcataaaatcatgtttaaatttttattaatgaaaataattataatttaaataattaaagcgctttcttctatgcttttatgttaatttatatattatagtttcaaataaaattttaatgtttttaattcagaaaattagtagaaatgattcagaatttctgtcaaaaatatataaaattcatgaaaaatttttttatttttagaaaaaacaattttctttaaaatctcggcttttttattgtttaaaataaatattttaattcaaatttttaaaatttttaactcagcatgaatccctgaacaacccattatggaaaaagttggaagacattctcaactttttcggcattcgtggagcacaacaggacgacacaaatcgtacaagcggacttgaggaggaaggctattgggacagagtgttgggcaaaagcgatgctttcaagaagcgaaatagtgctgacctgcaggagagggctgagaagcagataaattgccaaagcatcaaaaccctgaaaatccacaacaaaatgcccaatgcgc

SEQ ID NO: 42641 - DNA, 959 bp, Heterodera glycines
  misc_feature (609)..(609): n is a, c, g, or t
ggggttgaaaaattttgggggttggggggcccaaaccgttagttgatagaatttgtcaaagtgttattttttatcgcccctttaaagcgctatatagaaaagatacccgtttttggaaaatttttttcactttttttttggtaaatttttttttgtttaaaaagtgatgaaaccaagtacccgggggttttagaggtcgctgatcatgaatatgacaattatttgggcctattaagaaatttggcgctagttataaagtgacagatttttaattttatcaaaaacaaagggggacccttttgttttgcaaaaatttttgagataaaaaatcgtgaatatactttttattcaccataattgtaatagaatatcttgaaactttaaccatttgctaaaaaaagttaaaaagcatttttaaaaaaaaaatattgtcattaaataaaatgtttgaaagtattttcaaaaacggtaagattttatatattttagccttgtttgtctttgtgctttagaatgataccaaaaagataggatttcttagcacatgcacgaagttacagtataaaacactgggattgacaactgattggaccccaaaaactcaattgngactcataaaagtcgattggactcataaagtgcactagagccgaaattatgataaaaattgaacaaaacgaacaaaatgaaactatggtaattgataaaattggtgaagaaatgggaaatggtccaattgatcaaatgggaaaaaatcagaaataaatcaaaattaatcaaaatataaaaacgaagaaaatgatcagcaaaagagggaaactgttgaaaaatttgatgcaattaaagaaaaactgagagaaaaggaaacatatgcaaggaaagaaagaccaatgcaaaattgagacaaaaattggaagaagatgaggaacaaatagaaaattaatacaaaaatggaaaaa

SEQ ID NO: 42642 - DNA, 961 bp, Heterodera glycines
  misc_feature (5)..(6): n is a, c, g, or t
ctctnnagagtcggaattaaaaatcagatttattttttttaatttgttgcccggatacaccttaattgggtatttcgcctagaaaatagagacaggaaaaattgcactttttattattgatttttcttaataaatcattaaaatttcaaaaaaaaattttccggcggtgcctatcggctccgccggacaagttcttcgggttctccccccctcgaattttttttctggctattgattcttataaatgttgaaataactagtatataaatccaattataatgatcagactttcaaaaaaaattacaaaatgaacctttaaattcaaaaaaatgaatttacccaattataatttctttgtataattcaaatttaagaaaaaaattcattccaaaaatctgtttttgattttcattaattcactatttaaaagctttttaaaattttgacaaaaattgatttttgaaaaataaggattgcggatttccgtaattgaaaatccagttgcgcccagccctggtgagggcagacgttgggtgctgacggtcaccgccgtaaaaagtgtattttatttattctcttaattattatttttattcaagaattaattaatattttttttagttttataatttaattaatcaaatctttgcattttcaattattggtgatttttttaaattttagacttattatttgtttataatatgtatcctgtgggtaatgcttataagttcatttgtgtgaattaattgaaattaaattatctctcaacacagtattcattttatttttattgttacaatttgatattgaatatatatgcttttaatagttcaaaagtttttaaaatttaataaatggaaaatctagacatctaaaaatggaaaatcatattttcattgatttgactatattcaaaattcaaatttctagaaaattacgttttaagcatttaataatt

SEQ ID NO: 42643 - DNA, 962 bp, Heterodera glycines
  misc_feature (758)..(758): n is a, c, g, or t
  misc_feature (887)..(887): n is a, c, g, or t
  misc_feature (941)..(941): n is a, c, g, or t
ctaatagcttttcttttcgaaaagagaggcgaggaatataaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttanaggcctgacgagttatgtttcgacaaacatcctgtacaccataaatcgatttgcaaatttagtcgaactatataaatttttcaaaaaatgattcatcttttttatgggtagcgcatatgtctctagctntatagaaacggtccccgaatctgcgaggaactactttttagagaattctatagnatattattttgcatgaatcct

SEQ ID NO: 42644 - DNA, 780 bp, Heterodera glycines
aaaatttataaaaccctccaagaattttcccggcgacgtctatcggcaccgccggaccccgctaccccttccggttccccataatttttgaaaaaagcgcgccactaaaaaggtcttttgaatagcaaaaaaaaggtcgcaaaaaggtggctcaaaaaaaaggtctgcgccggtgaaaattgtgggccttcgtactcagctaatgatgcctgctgggcattaatttattttcatataactttttctaaagtgaaccaaattttttaaattttgcaagctaatagagaaaaagcttggctatcgaatggtactaaaaatgtaaaatttgattgtctttaagcaaagttatgccatgttttgtcgaaaaattcgctaaaattgacggattttatgaaacgacccagcacggaaaaagacagacatttacacaatgacaagacaaatggcacacactcagctaatgatgcctgctgggcattttaattttggaataattcgcgaatgttcgatgaaaatcaaccccttcccccctcacctatacgaaatgtcgtcgtcctcgccgccccacccccaataatcgttggagtaaccgttcacccgctcgaattgtttgcgcgtcatcgctgtcgcaccgccaaaaaggtgagcataaggcagcctaaggatggcaccacattaggatttcttccaaataaatgttttccctcgtgcgcgagacgaagtacgaaaagtgcaagtgatcaaattaaaaacaaaataatcattttaaaaattaaaaat

SEQ ID NO: 42645 - DNA, 1009 bp, Heterodera glycines
  misc_feature (26)..(26): n is a, c, g, or t
catttttaaattttttatagattttnaaatgtttgcattttttttggcttaccaaaacttcatcgaacctggttctttctattctctttcaaatcgccccaaattttttttacagccacgaggccgcgaagcggccgagtgagttcattgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattctttttaaacaggccgaaaaagtttaggctaaactttttcagcgggtttaataaatctaggaaaattagtaagcttttgtagtgttccgatacgtatctctgcaaaatttggtgagcccctgatcaattacaaattatttatggacgatcaaattttttgaaatttttttaagtgaaaaagtggtgggtgtctgcaaaaaattttcaccgggtttaataaatctaggaaaattagtaagcttttgtagtgttccgatacgtatccctgcaaaatttggtgagccgctgatcaattacaaattatttatggacgatcaaattttttgaaatttttttaagtgcaaaagtggtgggtgtctgcaaaaaattttcaccgggtttaataaatctaggaaaattagtaagcttttgtagtgttccgatacgtatctctgcaaaatttggtgagcccctgatcaattacaaattatttatggacgatcaaattttttgaaatttttttaagtgaaaaagtggtgggtgtctgcaaaaaattttcaccgggtttaataaatctaggaaaattagtaagcttttgtagtgttccgatacgtgtctctgcaaaatttggtgagcccctgatcaattacaaattatttaatgacgatccaattttttgaaatttttttaagtgaaaa

SEQ ID NO: 42646 - DNA, 944 bp, Heterodera glycines
aatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatgagaaaattgtcctaaaaagagatagccatttagcatcggaggtaccaaagataaaagtgattaaaaaagacatatgcaatgttctgagaattaattatggatttcct

SEQ ID NO: 42647 - DNA, 1064 bp, Heterodera glycines
  misc_feature (45)..(45): n is a, c, g, or t
  misc_feature (115)..(115): n is a, c, g, or t
  misc_feature (1012)..(1012): n is a, c, g, or t
  misc_feature (1020)..(1020): n is a, c, g, or t
ctgactagactccatatttgcagggatagcaatggcaggtctatntaaaggcctgacgagttatgtttcgacaaacatcctgtacaccataaatcgattagcaaatttagtcganctatataaatttttcaaaaaatgattcatcttttttatggttagcgcatatgtctccagctttatagaaacggtccccgaatctgcgaggaactacttttttgagaatttctatagattaattattattctgcatgaatccttcgcttaaattcccatttatcttataaagtcagattaaattaattaccccgatttgttttagaattggtccaaacactcttgctaatagcttttcttttcgaaaagagaggcgaggaaaaataaaggttgcatccaaatgtaatttttttttacattgaagcatttggatggcttgctgtttacagttggcttagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgttcgacaaacatcctgtacaccataaatcgatttgcaaatttagtcgaactatataaatttttcaaaaaatgattcatcttttttatggttagcgcatttgtctctagctttatagaaacggtccccgaatctgcgaggaactactttttagagaatttctatagattattattctgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaattttttttacattgaagcatttggatggcttgctgtttacagttggctaagtcttctttgcaagaagcagcacaacttttgtttgggccnacgacccncaaccattcgaatagcaatcgattgggctgactagactccatat

SEQ ID NO: 42648 - DNA, 1141 bp, Heterodera glycines
gtcctcacatttttcccatcaatgcgttgcttgcaacacatttacttgatagatctgagaagaattggtaattaggctaattagtagcagtaattagatgcctcttgcgttgcaggatcagcttcagttgtgcagcttgtgcgcttcgccgttggctgctttaataactatcattttttaaatttgaacttttattttaatatttttaattaacatacaggctattaaaaagtaatgaatagcgatggtaatattatattcacatgaaacagtgttaaatgcatgaaaaacatgttttagcagcatgatttgatgaagcttctaggacaaagttccatatgcataatttgttatttgcgtatatttcacaatttatgtgcatatttttgcgttttttcaaaaaaaaacctctattaaagcggcccttttgacctcgaaggaccgaaaaattttaatagactaaattttttgggtattttctcaataaaattaataaaaatagaaacttatgccaaaaataaattttcgttttttaatttcatttatttagaatattggcttctagaaaattaaaaaataatttcgtttttgaaaatttaattaataatttgcgttatgcttcaggggcctaattcgagtcataatctccgatatgacatatcttaattagtttcatctgcagaataaaaaattttgaacactcccgagtcgagactcgagaaaagtctcgggttttcacgaaaaaattttgtgtttgctttcttcctctcacaaggcctaatttcaaccaaattaatatttcatggtgtcattcaatagctgcttatgtgttctctattcaaaaaaattaattttcaaaattttttaaaatacatagaaaatttggttgaaattgggctaagatacgaatttatatgtctcttacatttttttttattttcctacaacttggcagtttttaagaaatgacatagccaccgtgcataaaaagaaattttctgatgagtagccaaccttttttttgtatgttttttccatttctttataataaaatatgatttctttataataaagtagagtagagcgggaccgggaccgggccgggaattcccggtcatccgaggtcccggtcccggttccg

SEQ ID NO: 42649 - DNA, 967 bp, Heterodera glycines
ctcacgggtgccacgcatgcacattcgccaagcatcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccattccaactgctcacgggtgccacgcatgcccattcgccaagcccttgggttccaactgctcacgggcgccatgcatgcccattcgccaagccctcgggttccaactgagcacgggtgccacgcatgcccattccaactgagcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtggcacgcatacccattccaactgttcacgggtgccacgcatgccattcgccaagccctcgggttccaactgttcacgggtgcacgcatgcccattccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgccacgcatgcccattcgccaagcctcgggttccaactgctcacgggtgccacgcatgcccattcgccaagccctcgggttccaactgttcacgggtgccacgcatgcccattcgccaag

SEQ ID NO: 42650 - DNA, 965 bp, Heterodera glycines
cctcctcttttcttcatggtttctcttagttagtgctccaccccagtcatttggtgttcccgaaaataaacaatcttgcctttaaaattgagtcccgaccatttcatttttagtgtcattttccgctcctcgcttcattttcatttcaaaaatggcgttaacttttttttgcctcaatttgccattgccttcccttcgtccgacaattcgtgtggaattgagaaaagcatttttacggaatttgcatttgttgagagaaaggagagcattttaatttttaggggggaaacgaaggcaatttttggaaatgaaatttaattcatggccagcagcagccaattatttcttctgctgctgtttatcctccaccttctctcaatccctcttttggtcttttcccctgcccattcatttccctggaagattttggaatattttgccaatttctctgtccttgtattttcttcattcacttcatcaaactcgtgcctttttgccctgtcggatttatcaaatttccgtcctttcctctctcttccctcttccctcttcctccttcctcatcacctcatcatcagtcctcttcccctccccttcccctttttatccgctcacttccccatcatcgcccccggccgcttcttcgcttccgtccagcagttgtcccttccccccccccccaaatcgtcaaaatgtcaaaaacgccaatccttttgctttctccccctcaattggcaccctttttcatttaataactttttttcatttgccatttcaattaattatgtatgattttcctattttctcatccaaattacctcccgcgttgtttcataaattggtaagtgcttttggcgtccaattgcgcgcaacattcacctccaatttcactaaatgccaacattcatcgttggttaatttatttacccattctgttccccccgtcgccgtcggcactttcttca

SEQ ID NO: 42651 - DNA, 1003 bp, Heterodera glycines
tttaatatgccaaaaaatgtaggcttaacttttttattctttttcgttctctcatattttttgctaattgagcagaagcctaccaaactttgcagggatactccccggtaaaggactaacttacactgaaatgagcagccgaggctagctaggctcaaaaaaatttttcgaaaatctgagtctttcagtttttatttatttgcaaaattaattcataaatattttttcagaaagggatctgaaacgcaccaaattttatttacatgttagaataggcactctgatgctttttctatcaataatggaggtgaataaaattttaattgctttttaactttgggaaaaagtgtaggcttaactttttactgaaagattgaacactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaa

SEQ ID NO: 42652 - DNA, 928 bp, Heterodera glycines
ccccgaaaaaaaaaaatcgattttttcaagtgtccgtctcgccctactcaaacaattatcggggagcaaaaatccaaggtaacaataaagtagaggtatatcgaagctattcccgaaggattcggactccttataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctg

SEQ ID NO: 42653 - DNA, 689 bp, Heterodera glycines
gggttgctccccgtccccgagctccccggtcccccactccgatccccgacttttttgggcctattccccgccccgaaccccgacatgtcgctccccgaggttcccggcccccgactttttgccctccgactccccgacactaattcggggaattggggactccgagcattgtaaaaatttaaaaagttaattcaacaacgaaggggggaaaggttgaaaatttatgaaattttgaacaattttcttaatattaattaattaaaaattccgaaaaacttttggtcggcacctatcggcaccacggtcccccaaaactccaatttttttttttgcaaaaaattgtcccaaaattgcaaaaattattattttttaggataaatctgttagggcaccgccgggaaaaaattgatatttgaatacaatacactgtcagattttgtccaaaaatgaccaatttttgcaattttttgagccagtttttttaagaaaattaaggattttaagggtccggcggtgccgataggggccgccgggaaaattttcgaaattttggctatatatttagcagattttgaataaaaattattaattttaccaaaaaaaaactcaattcataccagtgcatttttactcacgtttttttagtatcaaaatatgaacattttacaacattttttcaaacatttggg

SEQ ID NO: 42654 - DNA, 756 bp, Heterodera glycines
  misc_feature (739)..(739): n is a, c, g, or t
ccccccattttccctttctctgccgatcacagatatgagccgttggactttcacactgacatgtggtgagtgaggcctttaaaaataaataaaaattgtgaatttccggctcaaaatttctataggttaaccccctggatttttttttggagggggggggggacccatgaaactgtcagcaaacattaaaaatcccatcaaatatttggacaatttcccctcacattttcaggtccctcggcgtgatcgcttacattctgttagttttttcttaattaattttttttatgcattttttaaatgtttccatatttttttttagcctttcgggccaatcgccctttttgggcgaaactctcgcgcacacttattgcaatgttgagcgtggcaactggatgttctgtgaaggtgtgtgtgtgtgtatggcatgtgccattcatgtgtctgtatggggtgcactgtttttgccgtgccccgccggctgcatcatttcctcgcaacccgaaaatttttcaaaaaactcaaaatcgttaatttaataaattcttaaagatttttaaaattaaaaaaatcgaaaattttttgccttttaatggcacacaattcgagaattttctattaagcctcgagactgtagtgtctcttggcccgcatattgtaatattttttgttatggacaaagggggatttgatgaaccctacggtattgccccattaacggttgacggatgcggagggnggggggggggggggggg

SEQ ID NO: 42655 - DNA, 1465 bp, Heterodera glycines
  misc_feature (76)..(77): n is a, c, g, or t
  misc_feature (83)..(83): n is a, c, g, or t
  misc_feature (89)..(89): n is a, c, g, or t
  misc_feature (170)..(170): n is a, c, g, or t
tttttggttctttaactaatagtgtttaatggatttaggagccccaacttttctggtttcaaaaatggatgaaatnnatattnttccanaattcattattcttttgatttttttattagagtgtcgggttttttagggtctcgccgggacaaatctcgccgcaaaaattnaaaaaaaattcaaaaattgaatttttcaaggaaaaaatcttagaaaaatttattataagaaaatataagaaagaaaaattattgttaagtttttcttgaaaattgcgcggccaaatttggaagttccatggcataaaaaagcaattttttctaaattttgaaagtttttacttttaatagaaaacttttggttttgtgtagcagtctctaagagattttggtcaaaaactttttgtcaaaaacttattgtaaagatttctcattcgttttttggtgcaaaagtgccctttttagggtttttgcttttttgttgaaatttattagaattttcacaacagcttagcaaaggaatagttttttttaaatattgtgtgcccaaaaaacgcgctccagttttaaataggctatgaaaataaaaaaaaactttctgaattcggcgttttttctaagggacagaggctttttgctgcaaattttttaagatttataattttcatgactttttcagcacgtgcgcaatgacgtttggatggacattttcccttttttggccatgctcaactcggcctcaaattcgcactgatttcgcttcgtttcaatgcgttggtggacaaacattttcaatggcaaaagcggatgctgcgcaagttttaatttttttcaaattaaccggtcaaatgttttataagctctaaaaatttttgattgcattcggcaattaataaattcgaaaatgtaaacattttctttgttgaaaaaccttttattttaaaaaaactagcaatttaatttttatgaaaatcaattattgtgattttttgaaaatctcaacattgatgggctaaaaccattccatgcagttaattttttgtgaaattaaaaaattctcacaggcaattgccgtttggccggttaaatctttaaaatttatctatctctgatgaactgaatagaacaaggaaaaatttttagatgtaatatatgaaaaattatggcaaagtgtatactaagtgaatagttatactaacccaaatctgaggttggttaggaataagtttcgtacactttggcacgcataagctcctaaatagaatttaagaagtctttacgcttgactgaaacttaaatgtgtacttaaaattattttataaatattattgaagtcaattgtaaagatttctgtccttatccccatttgagactcacatttatttgtttcaaaatcttatcggtctgctttgcgaccatgatgagatttttgcacgtgccggtctgcttagcgaccatggcaacat

SEQ ID NO: 42656 - DNA, 1137 bp, Heterodera glycines
ccttaaagcaatgtcatttttacattacaaaatggattctcacaccagcctctttcctgaatgttcacttccatccgaagtctttggacctctgccaattgcactgcttcctccaattcttccacctgcatgcgcaagtcctccatctccttctccatggcacgcttcgacttctccagctcgaaagtgttcttgccaacgtcgtccttgttggtcaactacaaaacgcacaattttacttcaaatattagaaacatgaaagtgcccgaacatccaatccagcaaagaaaaaaaaaaatttcgggagagggatgtggcaccatccgtgtcatgccgttcacgccaaaaaattttctacttaaaatttaaaaaattcggttataatttgcatacgattgggaaatgcaagaaattgttcaacttaccgaaatctctttatttgatacacagtttcaacccgtttcattatatattttttggcacttttccgtttgggggccaaacattcaaatttgtgtgaatagctttttgttctcggacctcttttcatcatctcttgcacccaattccttttgattttatagcctgtccgaatagacttaatcgctgtttttgaatatgatgcttagatcatagaacgcatttttatataagaacgcaccccatctgatattcccatttttctgtttctcaactggtccacgtggactgcgctcattgactctttagctgcccccttaaggtacttggactttccacagtaaaatgcggcgcggattttggaactgccccccctcgcttgggggcctactagcatttgtagcgcaataaaaaaatttattgctttcaatttttcacctcttgtttaaaagagcccacaatcccgcgtccaattttaaaaacgaacatagtgcaccaaaagaagccgcctcacggcggggcttaaaagcattgtacatcataattaaaagcgaatataattttcgtatattttttcacaatttattttcaaagacaacaaaaaattgataaaatgttgaaacgaaatagagcacaaaaagggaggggatgcttagaccaaaagaggaatttttagaaaacaacgcaccccatctgaatattcccatttttctgttt

SEQ ID NO: 42657 - DNA, 933 bp, Heterodera glycines
tcaattggagcaatattttcggcatgtagtgctggaatttctgaattctcgaaaactggcatcttagtgagaactgaaaacggtacgggagaattacaaaataagtccccatttgcgcttaaaagggtgagaaatgtcaattggagcaatattttcggcatgtagtgctggaatttcaaaattctcgaaaactggcatcttagtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaactggcatctttgtgagaattgaaaacggtacgggagaattacaaaataagtccccatttgcgc

SEQ ID NO: 42658 - DNA, 1027 bp, Heterodera glycines
  misc_feature (18)..(19): n is a, c, g, or t
  misc_feature (26)..(27): n is a, c, g, or t
  misc_feature (52)..(52): n is a, c, g, or t
ataaaatagagaagtatnnatatagnnaatggaaagaaaggaaagctaatgnggatatggttaataaataaaagtatattaaataataaataaaatgaaagtttccttctgatcagtgatcccgaccaaaacgcgactttggaattcgaaattgaacggaacgcattggtcgaagttaacccgcaaaacggcattttgtcactaattaatgcgaattggcagcaccaaattgactcggagcagagcatttgcgtgtcaggtcaaagaatcaaacggattttgatgaagcaaagcttgaattgaatttttgagggattttgggacaattggcaaaaataattaaattggaattttacgttttaacgagcaaaacgatggaaattgaaaacaatttagaaattgtggaaaaatgccaatgctaaatttgtaaaatttaatttatttcagacggaccaaactcagtttgtgccaaggcattgtttcatttggtgaccgtttccaccgaaatactcaaaaagaggtgagacaaatgacacggatatttaaattgaacagcttaattgccagtgccgtcagtgttttcgtggaaggcatttcaatggacgaattgctaagcgtcgccactttcctccgatttgtccaggccctttcctcgttgtgggattgggcaatgcctgaaaatgttcaaaatgccgaaaataattttgtcaaaaactaaatttatttttcagtttcgcgtgttcggcatcgaagaactcgtaaggaattcgaatggcacggaattggccggcactgttctcaatttgttcgtcgctcgcaatttggaaatggacgaagaatcagtgacgacgacgatcaggtggagaaattcattgcacaattttgctatgccattctctttctttcgttttggcattttgtccctttttttgtttcatttgtccccttttccgatttccgattcccccattttattttatgcaatttgcccccccccctatcatttgccattcgtccgtccgtcgct

SEQ ID NO: 42659 - DNA, 920 bp, Heterodera glycines
atttttgtaaaattttattttaagttggtgccatttcttaatttctatcccacagaaaaggattatttgctggaattaagttttattattccttttaattgaaatgcgatgattaattggcgcttttttgttggattcctcaaaacattttgtgtaaaatcaccaacctggcgcgcaccacgcgcacacggcgctcgtactcctcgtcattgccgtccgctggcggtgcttccgttatgcgctcatagctgccgcgtttgtgtccccctccgtgtttgtgtgctcttccgcgttcgtagcttccgtctccgcccacggaagcgctgctttcgccatagccgtacccgtgcttgtgtcccgcttttccctcttccgctgagccgtgttcgtagctgccgtacttcttgttgttgtggcctgttttgctgcttgtttcgtaacttccgtctttgtcccgaccgccgtgtgcgccgctttcgtcactttcgtctccccctcccccgtgtcggttatttccgtacaaatgccgatgcttgtgccctcgtccgccgtgtccatgccctgcatacctatggccaccttttccatgtttgttgttgtggtaatggttgagatggtgccggggctggtacttgtcctgttccaacttttcatcgtgctcctcttcgccctcctcataagttacgcctttgccaccgtcttctgttggctgataggtatcgccgtcatcgccgggcgatggcgggcatttgccgggctctccggccggacccgcgggcccgggaggaccggcatcgcccggggggcccgccgggcacttgtcctcgtaatttgcgcgaacagctcgggtcagcagaaagccttccttcattttttaattttaattattttctttaaattaagctcacgcttttaccttc

SEQ ID NO: 42660 - DNA, 879 bp, Heterodera glycines
cgattattgccatgggcgctcttacccacagaccctcaccctagatacccaaacggtaaatttgttcgtgcattccctctaaggaatgaagcggaggggttttcgaattcatcagagagtaatgggattacttttgcccaatatggaagaactcattgcatttatgtgttcaatatgaccaacagcggggacgatcaggcggcattgtttgatctgataaagaatgggaccaccgcggtgagcatcaaatttaaccacccagtacccgatggaggaataatgctagtggtgatgggagaatgtgactctctggtgatgttagacaaaaaccgatcaataagcactgacaccactatttaaaccaccccgcattgtcatttcattaaaataaacatgtcatcaaaaaagctgcctctaattttacttttccttcgcatttcgattcccgtaactgcatatagagaagaggactcttcatattcagaatatttaagaagaaggacattatctaggtttactagcacaacaacaacaacaacaacaacaacaattactcccaataccacaccaaatgtgacaacgcctgtactaccaaagcaagaaaaactaattgatgaacatgtctctgctgttctcccaccacttattcgattgtgcaaggacacgccggaggaaagcagcatattccatcaagctatttgttgggcccttttcactctctatttaatgttgatcatcagtttggtgttgcatcaactctgttcaattttttggctaaagtatggacagcgtacgaatcacaaagattttgagcgaaaatcgtcggacagagcgagtatttcggggttgctacgccagtgaccaattgccgacgcccac

SEQ ID NO: 42661 - DNA, 961 bp, Heterodera glycines
taaccccctcgaatataagcccgccccatttggagtgcttccaaaatgaggaaatacggtccctctgattgtgaaggacatttaggttttgtgtaaaacatttccctgtttctgcatattttttaaattagctttctatttttttatttgacttttgtgtgacttttttcgatgcttcttccgtcgttttcggttgctttattcaaccaatctctctttcttggtaaatttaaatacatatgactcgactttcaaataacgttcccttttttggcatttgtgccgttctttcgcttcccattctttgccttctctgagatcattccgtccgtccgtttcgccaatgctttcctttccctttttgcttttccattctttcttttatttatttctctccttttctacaacaatgccttcttcgtaattgacaccaatctccacaaattctgcttcaatgtcccccctttcgtcgtgccattcgctccctttccaatttcttttttgtccgtctttttcattgcttccggcagtgcgatctttgctttgggaattgaaggggaatttcgtgccgctggcaatttctgctcgtggcaaaggccctggaggatggccaagtcgaacacttccttcaaattgtgctgagtaactgcctttttgaaatacaccaataaataaatgtccgttcgttttgagtctctccctcagaccgaacattccagccaactgctcagttcaaatctttcgctgagttgtgccattgcctttgtctcgacagtttctgatcggtgactgatcagtcgtcgatcactttgagtgccgatgagcaaaactaagcaaaaaataactactttattgtgaattttgaaatgaaacaaactgggtgctgagggagccaacgaacgaatttcaggaagccaccgttgtgtggccgaattgagggaggagggacgggtgacactga

SEQ ID NO: 42662 - DNA, 788 bp, Heterodera glycines
cccatttggtggatttaggaaacgcgcatggttagaaacccatttggtggatttaggaaacgcgctgccaccccattttggcggatttaggaaacgcgtggcggatttaggaaacgcgctggcggatttaggaaacgcgcatggttagaaacccatttggcggatttaggaaacgcgctgccaccccattttggcggatttaggaaacgcgtggcggatttaggaaacacgctggcggatttaggaaacgcgctggcggatttaggaaacgcgcatggttagaaacccatttggcggatttaggaaacgcgctgccaccccattttggcggatttaggaaacgcgctggcggatttaggaaacgcgctggcggatttaggaaacgcgcatgggtggcggtttttaggaaatgcaccagcaccgttttaatgccatttatttaatgccaaatcataagtttgattaaaattcacaatatgtttttttaatttctacatcagcatttttcagaatacgagcattagagcacattaataatgacaataaaatttggtgcgttttttctgaaaaaatatttatgaattaattttgcaaaaaaataaaatataaaataatagaaaactcgaattttgtcgaaattctcgtaaaatcaaatttgtggaggctcctccacaatttttaaaattttttaaacccaataagcgttgaaatattttttaagttagtcctgtaccggggagtatgcctgcaaaatttggtgcgattttattaattatagaaagggttaa

SEQ ID NO: 42663 - DNA, 1710 bp, Heterodera glycines
acttcatcgtcacgatatcgcgtgagcaaatttggcactctctgaattcttcgccaaattgcttgtccaaagtgaaacaagcatccggttcttatggaatttggaaagacgttgccagctgcagtgatcgctcccgattcgaaatcgctcataatacggtacgggaaccaattattgccaacagactgacgaattgtttcgaagaatcttgtgtatgtggcgagagttttgctgggcagtaaaccataaactgccggaactgcacaatgatcgatgacaactgccattgtgtagacttgagtaaatccccttgggcatgtctaagataaaaacaattttacttattttgtggtatattggtagcggcacattttatatgcctctcgccactatcctttttggcttagctacttttttgcgggatttctgcattaggctcccgtaccgcgaaattctcacacaattaatttttaccccagattgctttaaattttctttccttaaaatttattgttttaaattaaaaatttacatatcatttgagcgttaggctacatcaacgattttccgagtttttatttcccagattctattaccgtccgcatttataccgaataaagccgcttaatttgcaataaggacggcagataatttatagattagaaagagaaatgcaagagcactataggtacgccccagtgagcagagaaaagcctagtactatctcgtcgtttttctttttctttgtgatttctctcactttggcgttctatctcttcattttaattatgtaaaaaacaacatttacttcgccacacataacttttttttctactcatacaattttcaccaatttttgcatatcgatagagaaaaaaattctgcatcgattaataaggaaatttaatacaaaaataaggccaactgtagagtttatgggataataaatttgcatttctttttctctccttttggcgtactattttcatatctctaacacacgaaaaaaaatagaaattcgtaaattctaacaattttcattataagggtacaaaatcactttgaacatttagaatcaatagaaaaaagaataaatttagcatttttggtgaaaacagcagtttaggacttgagttataacgtgataaaaatttgaaagtatcacaacttttttctgagatgtcaaattgcttagcattcgcttagaaaaagattctccttttcaaaaacttttttagataccaaatttgttcagtttaattgggaatgaagcgagttatggcagatcaaaatacaaaaaggcattttccagtgtaaattttgaaatagcgcgcaaaaaattacgccaaatgcgctatttggcgttatgagcaattttgtctgccactggggcgtacccatagtgcaagagctgcacttgaatcatcaatcaattatgcaaaattctcaaaaaaccctcttgaatgcaacagtttcaaaaaaattataccgaaaattaattttttgaacgaacaaaattttgggatttaaattttttcaaaattttttgaatagtcgttctgctttgttcatgaatcatgataagctaaaattgtattcaaatttctgcaaaaatttattagcgaagaaacaactgatatgaataaactttttaagtgattcagcgttaaaattgctaatcgaacaataaataaaaatatttaaatatgg

SEQ ID NO: 42664 - DNA, 877 bp, Heterodera glycines
taattagcattattccaattaaattaaaataaatacttaaattatgcaacataattattaaaaatatttataaataaattaacaaaaatatctgtacaaaattggatgaaccatctcaataactaaatagcataattaatctagaagaatttaacttttataatgctttatttaaatttaattatatatttataaatatttacaatataaataaaaaaatttactttttcaatctcagtctgataattttgttgtcggcgatttggttcatctaaaaaacgcaaaacaaaggtatataaataagcatgcttaagaacataggcaaaacaattaataagtaaatatttgtttaaaaattaaattatttttaatcattaaatggttggatgcctatgaggaatgcggagaacagttcaatcaaccaaatgaatacattaggaaagaagttactgtccaactaatgaccgatcaggtaattgaaaaaaaaattgttagtttataaatcaattctatgggcttaatacagggatgtaatctggtatttaattttttattttattttttctgacgaaaatttttttcaaagtccagccttttttcaaatttatctcccggcagcgtttgttagcacctagagcaaaacgagcccaaaatttcaaaaattttctacgacggtttgagaaaatttttggctatgaaaaattccaattatgtctattggttacaaaatcatggaaatatacccatgttggaaaaattttcgaaaaatttcacattattgttccgaaattttgggttgaagtcccgtaaataatttcaaaagattttaattttcaagaggcctcgcaaaagtttcttgcctcaacttatgtctatg

SEQ ID NO: 42665 - DNA, 1094 bp, Heterodera glycines
ttgcgggggtctgagtcacgggggcgggggtgaggtcaaaaaacctgtcccgtcccctggggcggggctcgaaccctacctttttatcatttacaaactataaaaatttttttttctaaaaaaccatggcgctaagcgcttaaatcccacgggtcgcgcatcgcggattcaaattgccgcggtcgaggatcgtgcaaaaaaatctcgcggtcgcgctccacccctgccgccaaagcttctaacaattgggcgtcgccgggaaaatatgagaactttttcaaaaccctccccctgagtccgtccatggttggaccacccgttgcaccgaacaatcctctgtctgataagaatctgttctttttgaccgaactttcttcacggcaggtactgctccttctgtgcctttgtcacgcgttgtgcacccgccatggaacgccaccgtttgctgtccaaatgcaacgcggcggcaaaggcggcgcggacagtacgcaattttttagactttatttgataaaagttcgccattggaatccatcttttattttaaaagttttcgtttatattatcaaattttgaaaaattttttggaaaaatagtcaaaaaaatttaaggaaaaattgagtatttgtttcaaaatttaaaacaatctgagcctagccaaaaccaattcatcgagaatcattgtgtcaaaatgctttttactgttccattttcagccctttctcggttggacttctccctctgacacttccgtcgcctccctttcgtcgtcgttggccctcgtccagttgagctgtcttctgtgcacctcattccgttccgtcaatgtaaaggttcggacggttttattaacgacaaattttctttaaattttccaaaatctgtcctcaacaaagttcaaaaaagcttgtggccttgggttttctggaccgggattttgtgggatttttatcctcaaaatccccaacctacatgggatccattttaaaagtcaatcttttttgaaaggcgttggaggagcacatggccaaagttcaccatcaaatgccattcttaccgaacatcaagaacaacggaccaccactgatcatcag

SEQ ID NO: 42666 - DNA, 1011 bp, Heterodera glycines
acccgcagcagcagcagaatcagccggtgctgaccatgcgcgacgcggtcatcttcgccatcacttacagcaccgacttacgacccggcatcaaaatgccctactttctcacgctgacagctcgccgagttagagacgggcgccgatttggccgctcggaggagcggccaccgtacatttgcgggggcgcactcgcaacatcacaagcggtgggtgttgttggcacggggcaaaaggcacagggaaaacgaccaaattgaaaagtgatcgctcggcatttgatttctttggcatgtcattctgacttttcagagacttttgtttgcctgaacaagctccgtcccagggcttccgagcagcgggacaattgttcctcgtacagcttcggttggccccctccgccttcggacccattggcggaggagcgactgctcgcccaactgttcctctgcactcgcacgacggcgcgcgttcggcaggactcgctgtacggcgattacacgctggcggccagtcccgcgagcacgcaactgcgcaccactcactcgtcattttggacacaacaacagcagcaactcaaagtgagtgagaacgagcgagcaattgggatgatcaatcattcccattgatcatttattggccaatcaatcaatatttgattggctaattattatttgatttatcggtcaattagtggataattcaatgaccaattcataggcacaacagcagcatcatgcccagcagcgcgacaatccgctgcagcagcaacaattggcaatggaagtcgtcgaaaaggacgaaacgccaaaaagggagccgacactgtcagacagtaagcagcgaacagcagctgaacaataagcagcagcacgggaatgggacgacgaaagtattgacacggacagagtcaatggcagcgaagcagcaacagaacaatgatgacgatgatgatgatggaatgcgcaattgtaaaagaaggatgtgagtcatggggaaaggatgacgaaa

SEQ ID NO: 42667 - DNA, 1059 bp, Heterodera glycines
  misc_feature (80)..(80): n is a, c, g, or t
taactttaaaataacctttataattaatatatcaatgcattagtaatatatatgaagaaacaataatataattaaagatnttatttgctatatgtacatatgaatcaaaaaattatacaccagccacactgggaaaattacatgcatccgggcaagttactgtataaaaaaattagatttttaaaattaagctggaaatatattattatttaaaaattcaataaattgtaattataaaaaaatgcattctaacttaatttcgaaaaataaaatttcaacaaatcacatagaaaacaatttaaaaataaacttagcaaatgtgaaaattttttgctatttcttttgcaatttaattaatgttatgtgataaaaatagtaattcgctaatttttgaaaacaaaaatatattaaattagtaaattataaaggaatgacaaacaccccaaaaaccaattaataaccaaccacctgttgtgatttaaaaaactaaagtaagcaataattttatttaaaacttttttaatagttaattatttcgtaaaaaaactaaatcttgatcaattaattaatatattcataaatattttattttatgtatttaaattttattttagtgttgaaaataattgtatgaaaagtgttaaaaaggactaatggcaaactgaaaaagaagaaaacccgtcgtaacaaataaagcaaagcccattaaataaaagccaaatatagaaaagaaataaatttaataaattattaatatcaaatgactacatttcgaggctgatcatcaatactaccaacggttctcgccatgaaaataaattaaaaaataatttaaataagttatatcaatttaattgataaataataataaataatgaataaaagacacaaatatttattataacatagttaatagtttggggacgtgggtggtaccgttcgaaagctgagctcatttagaaactttttgaccgtcggcttttaaatcgccccaaagaaagtttttagataaactaagttttttgagttagttttttttttttggactttttcgatttt

SEQ ID NO: 42668 - DNA, 242 bp, Heterodera glycines
tttctaggctagaaaatccatttagatttttttatttaaaaattctaagttttagttaaaaattcttcgaaattttttttgtacgagttgccatgacaccaaaaatttatttatagtgcaataattttcgttaaaattgtctattttttaaatttcaaaatattcttagagaaatttttctgtgttttcaacttattggcaaagtcttttttgcttaaattgtttttttacggcgcaccttt

SEQ ID NO: 42669 - DNA, 1392 bp, Heterodera glycines
cgtaacggaaacgacgacgacgcagcgggggcggcggaatgcgcggcaacatcaaaggggagggcgaaattgctttgggccggggggaagccaattttcattggcactcaactccattcatccgccgaagtcgcgaaccgcagcacaaatcattcattctctcattcatctactgttttttttttggaggtgttgtgccgtgccgtggtcaactctttttttgggcaccaattaatatttttgcactctgtcaattatcttttagcattttcatcaaatccgtttgggcggttaattaattaatcatcctgttaaatttattttttaatcatttaatctcattgaacgcactattgtagaattgatctccaatcaatttttgcatacggtcacaattatcttttatcatctttcagtcaaatccctttgaatggtaattaatttcttaattaccctaattagtctgtcaatggatgccatttctgagattgattctctctctcttccgaatgtcgctttttcatcttccgccgatggtttatatatatgattttttccggcccgtcaatttttcgggttgccattttctatttttcttttttcattaattaccctcccagcacactaatgaatggcaccaccaccaccatctgctcctattactgttgctgctttgcaacagaacataatgccaatgcccaatgccacatttttaaatttaaaacaactaccataaacttgtcactcaaaaaatctcttttgtgctgtgccgtccgtcttccgctcctccaatttcgccccgggggaaaattctttccgttttccccattttagcactttctccccccttggccccctcctcctcttcatcatcattcattttcttcctcttcctctgtttgctcttcctccccatcctttgtctttttttcatcccttccttctgctgcgcgtgccttaatgttcgttccttcccctcttccccccccgccccgtccccctttaatatttttgtcatcgccgccggggccatccacttcacacctcctccacccccaccctccttccccacttcatcgtcggtgtccccgcctcgcgcggcgcgacggactgtccccgtccttatcgtcatccgccctcgcattttgccatagtttgttattaccccggcattttcaccccggtccccgtattttgccatagtttttttcggcgttttgaattttattttaccaacccggcatttatcccggtcaccgctttagtatgttttttgccacaatttattaattcgatatttttgtcacattccccggaacttgttttggtcgactcccatccccacattttgcaattcaattgtaaatttatttccctggaatccaatccctc

SEQ ID NO: 42670 - DNA, 928 bp, Heterodera glycines
ctctgtggaacggattagcatctggggttacgagataccatttgttctaaaaagagatagccatttttcgtgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggaaattgaaaaattttgaagagtctctgtggaacggattagcatcggaggttacgtgatagaaaattgtcctaaaaagagatagtcatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgtggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttacgcagctcttgcggtaatgcaaaaaattttgaagaggctctgcggaacggattagcatcggggttacgagatagaaaattgtcctaaaaagagatagccatttttctgagaattaattcacatttccgcaactcttgcgttaatgataaaaattttgaagaggatctgcggaacggattagcatccgggatactagatagaa

SEQ ID NO: 42671 - DNA, 966 bp, Heterodera glycines
ttcatgaagattttgtgaaaataaatttttttttgtattgttggggaatagccgaggatgggttattattcagtcccaaaaaatattttaataaataaaaaaaacctaaacattttaaaattgacacggaaatttgccatttttacgagatgagcaaatgtaagagttataaaagtcttttttatttcggcatttaattcctctaattcggggattattttcgtgtaatattttttctataaacttaattatctttcatctaaaattgtttgaaatcattaaatcaaaaatcttccaatttgtcataaattcataaaagtattttaatttttattaatagtaatttaaaattaatagagttcgacctggacctggatccaggcctggatttttcctggatccaggtccaggtcattttttgacaacatggatttttcctggaactggatttttgtccaggaaatccaggtccaggtcaatttggaaatccaggtccaggtccaggcttgaaaaacctggatttcctggataaaatttttttccatcttttatggcgaaatgttttaaaatgggtgtaaattcaaaaaatttaatttttttttaaaattttacacatgttaatgaaaattctttttgtttttaggcattaatgaattcttaatttggaatataggcttgttcgaaaaaaataaaattggcaaagttgggatttgcttagtgtgcaaggagcaaaacagacaaaagtctgaattttcaatcaacgacagctcaacgaaaagcctaattgtccatctcaattcgtcgctacacaaaggatcggaatatgacaaaaaattccagcaacttgagacagaatggaaaaacgcaaaacaaaagaaacataaggagcagccaaaaatcgccgacttgatgaacattacttcatcccggtaaaaaggcattaatttaattcagtatcagtaatta

SEQ ID NO: 42672 - DNA, 1114 bp, Heterodera glycines
  misc_feature (13)..(13): n is a, c, g, or t
  misc_feature (32)..(32): n is a, c, g, or t
  misc_feature (36)..(36): n is a, c, g, or t
  misc_feature (47)..(47): n is a, c, g, or t
  misc_feature (71)..(71): n is a, c, g, or t
  misc_feature (76)..(76): n is a, c, g, or t
gcatcagagtgcntaaactagcatgtaaatanaatntggtgcgttcnagagcattttctgaaaaaaatatntatgnaataattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccacccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaa

SEQ ID NO: 42673 - DNA, 1168 bp, Heterodera glycines
tttttctcaaaaaaatggctagaaatcgcaaaatttggtcattttttggtgcaaatctgttaacaaattacactcaaattttcaaaaatttcccggcggcgcctgccggcaccaccggacccacgccacctccgttctcaaaattcccaagagttttttggaaaaagcggttgtgaaaagtaaaaaaaaattttttgttgatctcgccgtgagaaaattttatgaaaaatgaaagcgtatccgcgctgcgttttctcttataagaagaatttattttttgtgaaaaacggtgaaaaggttcaatctcaacaaccattttaaaaatgccctcgagactctcgaccactctgcttaatttggcatcatttgcactcaccagcgcctctttcatgccgcgcaagtgtggcgacacgagaattgacgtggtgtaggagcgttcaccaaactttttgttattgccgctgatgcccgacgaaggtgtgccattgttgttgccgttattgttggcattgtttgccattgtggcgacgacccgtcgctgttgtggcgccgtgccgggcggcatcggcaatgagcctcgaggggcggcgctgaggtggcgcgaactatcaatgaaatgtccgattataaaaaatgttgaatgatgccaaaaaacactaaaatgcggttccatccctgatctgggccacataattgattttacatagaccagaagaaaggcgcccactttgccccgtgaccaaacgcttattaattatgccttaatgaggtccaaaatgagaacttaattaggtccgaagaattctaaatctaatttactccacgagaatccaaaaaagccacaaattgcaaaagattaccgtgccgaactgatccgagcgagcggcgattggggcgccacttggcactgtcgtcggcggagcgggcggttctaccgccgttgatcgtgccgatgccggtccggtcgcccgttgttggccgtttgttgtgcccattgctgtgctgattagacggttgttgttgttgttgctgcgcgggatgttgcaacgccactgaacgagttgctaggtggtgtgttgctgccgacgaaccccgttcctgctccagagcttgctaaaccaccagccaagccaaatagcttttaatacaattaatgttaattaaataa

SEQ ID NO: 42674 - DNA, 823 bp, Heterodera glycines
ggacaaaaaagaggggggagtggaagaggaaaataaaaggaagagaaaagaaaaaggaagattggaggagaggaggaggaaaaggcgctcaatgtctaaaagtaaataataagcaagtgtattttcttcttttcctattacaatggctagatggagtttaatacgaaatagccaagagagttgcccttcgaattgcccaatcaacgccaatgacaccaaatgaccccccacacacttttcaacaaaatcatctcttcatcccattaaccaatcggtaaacattaaactgctcatcagacttgagttaatgcaaagtcaatgggacagttgcgcaagaaaaaggggggggggggccgacgggagggagagagtgaaaagggaagggagagggtgtggggggacactggggaggggggggatgatgccaatattattttcgcgatttgggtcattattttatgacaattatttaaggataataatagcaataataaacataatggggagggtggggggtaactcttttatcggaaattaacggccaatgggagaggggcacagctgagaagtgtgaaaatggttgtgacaccgaaaatttggcagcagttgaccattaggtggaagaaaacacttggccaaaacagcgggcaaactttgtttttctttcttcgtaaagtaaaaatgtgtaaatgtgcgaaaaaagtcagaaatgtgtgaagggaggacggatgagttatgatgagacggatgaatggattttggaaggacgggggagtgatggatatgcgcgaagggacaacacattgtccgccccaggggcgaa

SEQ ID NO: 42675 - DNA, 299 bp, Heterodera glycines
atatatcgtatttgctctaattatcgccccggggggattattgttcatcctcctcagaaaggggggggggattattagatacggggtgataaatggagacggggggattatttttcgaccgattatttactgaaaaattttttttgaacatttcgccaaaaaatgttatcgcttcaaaaaaaagacgtcacaccggagcttggcatctatggctgtctgatcggcaacatggtcaccggtgaagtgtcctatgtctcccgatttgggcatacgataaaaaccaaaacggcggatgagga

SEQ ID NO: 42676 - DNA, 963 bp, Heterodera glycines
cttaaaaaataatataaaatttataaatgttttaattcattcattaactaagcaataggaaaaggaccaagggcgcttcttaaggagcgaaaaggcagggaaaaacacgaaacacggacgggccaaacaacggaccgaaccaccaacagatttgcgaaagcacgagaacggagaggaaagaccccgacaaagaaaaaaccaaaaaagacgcacaaaaaaagaagaacagaaacgaaggcagaaaagcgaaacaccgccgaaaccaacacgaaaaagaaaaaaaaaaaacaggacggagacggcaaaaaacaaacgacaacggccagaaggagaggcagataacaccccaacaggccaagaaacccgatgcaaaacgaggaccaagaaaccaccaaacacaacaaacatcgagacgcacaaaaacaacgcagaacggaccacaatcgatacgaaaaaaagaaaacgcgactccgaattacatgaaaatattgaaaaatagggttttttaattctatatgtcatttctcaatatctctgaaaaatcgcgccattttttgttttcatgattatattgtatttgaaaaggagggataaatttaaaaaattgaagaaataaaattccaatttatgtatttgtttttatatatttttcaaaattgtaaaattaatttatgacatatttttgcttataaaattgaaaccggcaaaacccaacaaattttacgaaatctttgtcgacggatggagggatcaaaagaaaatgatgaaaaaattgatttttcattcatttggttaaaaataaggcatggtacatattagggttaagccccgaccccgagctccccggtccccgacccccgacatttttgggcctattccccgccccgacccgcgacatgtcgccacccgaggtccccggcccccgactttttgcaccccgagggctcggggcttaaccctagt

SEQ ID NO: 42677 - DNA, 438 bp, Heterodera glycines
agttcatgttagaaagttggtggtatagcaaaagaacttagttgatagttaaaaaacggtggctgctggttgctccagcagaaaatttaccatcttcttttgctaccgtttttctcatgtttcgtgttcaaatgaccaggtcaaataagacatggttaaatgacctcgtcaaataaccaccttcttatgctacggcccctggtgtgggaaaccttccgccgggtgtcacaataaatttcactctaagtaccaaattccaagactcggaattttggtaaaattttgactagggttgctccccgacccctcgggaggcaaaatgtcaggggccggggacctcggggggcgacatgtcgggggtcggggcggggaataggcccaaaaatgtcggggatcggggtcggggaccggggagctcggggacggggagcaacccta

SEQ ID NO: 42678 - DNA, 1195 bp, Heterodera glycines
  misc_feature (1164)..(1164): n is a, c, g, or t
caattaattgcctacgaacacagtcgcctttgtctcttatggagcagaaaaggggaaatatcagatggggtgcgatcctttcacaaaaattactcttttcgtctaaccatccctccctttttgtgcactatttcgttttaaaaattgggaacatttttttgtttgtttttttgaaactaaaatgtaaagaatttaataaaattatttttgatttaagtaatgcttctgtttcgaatcttttgactctaagaaattaaactataaaatttagaacaattaattctctaaagtttttaacttggctttaccatgtttttaagtcccaccgtgaggcgggacagttccaaaatttgtaccacattttactgtggaaagtccaagtaccttaattggacaattaattgccaacgaacacagtcgcctttggcctcttatggaacagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaagaatttaataaaattatttttgattttaaataatgcttctgtttcgaatcttttgactctaagaaattaaactataaaatttagaacaattaattctctgaagtttttaacttggctttaccatgtttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaaatatcagatggggtgcgtcccatcctaaaaattcctcttttcgtctaaccatcactccctttttgtgcactatttcgtttcaacattgtatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggctttttcaaataaattgtgaaaaattcaaaacaaaaaacttttattgcgctacaaatgcttttaagccccngccgtgaggcgggacagttccaaaatttgca

SEQ ID NO: 42679 - DNA, 1107 bp, Heterodera glycines
cacattccaaaaatcctcgttttagtcaagaaaatagcgagttctatttagaaactaaaaaaagagattgtgtatgaactgccaggatactaatgtgagaatatatcgtatttttgtccatctactcgccggcttccaattggttcaaaattacttcggcgtccttaaaaaaaataattcactataacatcaaaagtgttcaggggtgggaaggtgtcaatttcttttgttatcagtctgtttatcgtaggcagttctcgacccattacctatgccataaattaaagtcaaaagtttaacccctcccaccgccttgaacatgatgaagaacttacctttattatctcatctgcaaaaccaacaactttcgctatgttaagtccaaatgagcggtcggctacgccagaaacaactcgaaatagaattgtgagttctccattttcgcaaatcgtatccatccggtaattttttacttttccggggtatttcgattgaagtcgagatatttcatgaaaatgagttgcgaacatagcaaaacaaccaattcgcgagatgatatccctgaaatgactaatttatctcattttttagtattaacacactctgaaatagcataggcaagcccaaatccatcataagtgctcgtccccctgcccaactcgtcgatcagaattaaagaatgttcagttgcgcattccaaaatagttgagcaatccatcatttccgccataaatgtcgagatacccttacattggaagtcgccagctccgaccctaaaaggaacaaaaaattattaactacaacggaatttattgctgttttttctccgaatgacctcgtataaatgccgtctaccagtgaaaaggtagcagaagtgcatggaacaaaagagccaatctgtcccatcaaaacggtaagtgccgccgctttcagataagtgctctttccccccatatttgcgcccgttaaaacgatgaattggctattttgtgctcgtttgcccatcaccaaatcattcggaataaattgcacgccttccaattgttcgaccattgggtgtcggcactcacgcagttcaagcacaccggaaccctaacacatacctat

SEQ ID NO: 42680 - DNA, 1490 bp, Heterodera glycines
  misc_feature (41)..(41): n is a, c, g, or t
  misc_feature (59)..(59): n is a, c, g, or t
  misc_feature (1083)..(1083): n is a, c, g, or t
gtacgtttggcattttcgtttgccgatttattaattgaccncaaaggtttattcaatcncgcggagtcagtcacttgcgcacatttacatcccttatgtatgatcggaaattggaccatttatttattcattttttaaacttagaatgacatgcaacttccgcccgatttgttggcactttctgtgagttttccatggctttttaaattttcggaaatgttttttttccttcagaatccgcaatgtatatggagtgaaccatccccaggatagcaatttttatcattattgtatatcttaaagaaaataaatttaaaaattatttttaatattttaaaattccccaaaattaatggcattaatttatctgtgcgtgttatttgccaattttggccaaatttgacgacaagccacagaacaaataatccatgagagattaaaagaaatgtgatgagtcatctcgaatatggtcaaaacaatgccaaagttttgaatgattatgccaatttcgaaatccaatcgaatgagtttcgctttccttcgttcatttacactttgacgcggcttcggcgcgcgaaaacgctggtgcgaggcgggcaaggacagtaagcaccgtcgtggccaggctgaccagcttggcccgcggctccgggctgtccagggcctccaggctgtccgggtcctcccggctgtccagcaggtccgggaggtccctggcctccgggctgtccaggctgtccgggtcctccgggttgtccgggtccaccaggctgtccgggaggtccgggcgggccgggcactgatgaactgaagcaaacagcataattttgttgtttctgtgtcggtaccttttcgttcctggggctccaggctgtccgggctggccaggtcctccgggctgtcccgggtttcctcccgggccaggaggtccgggagggccaggcggtccctgtcctccgccttgtcccggctgtcctggttgtccatcgcctccagggggtccgggcggtccttggcctccaggttgtccaggcggaccggcggggcacgaagggcacccggcggaagcttgagggcaaggangggggctgttgtccgggctggccagggccttccgggttgtcctggtccgccgggctgtccagcgggtcctggtgggccagggggccccggggttccgggcggacattgcggctgctgcagctggcacacacactgaggcggcaacccgccgttgccacgtttctggcgcagaaagatggaattgaacggattctcacggggacgggccggaggggtgacgctgatttgaacgtccatcagctctgtccatgccgagtcggtgttcacgcggaaagcctacgacggaaacttttccaatcgaattttggacgaattgtccacctgaacaccgtcgaacactcgcgagttgacctcgttgatctgttggtacagctgaggcacaacgatcagagtagccaaaatggccg

SEQ ID NO: 42681 - DNA, 900 bp, Heterodera glycines
gattggcaagggacaaatggacaaagacagtgagtgttcgattagagggaagggagaaatggaaaatgaaagagaggaagccttattgggaagggacaaatggacaaagacagtgagtgagtgggattgtaaagggacaaatggacaaagacagtgagtgagtgggattggaaagggacaaatggacagagacagtgagtgagtgggattggaaagggacaaatggacaaagacagtgagtgagtgggattggaaagggacaaatggacaaagacagtgaagtgagtgggattggcaagggacaaatggacaaagacagtgagtgagtgggattggcaagggacaaatggacaaagacagtgagtgagtgggattggaaagggacaaatggacaaagacagtgagtgagtgggattggaaagggacaaatggacaaagacagtgagtgagtgggattggaaagggacaaatggacaaagacagtgagtgagtgggattggcaagggacaaatggacaaagacagtgagtaagtgggattggcaagggacaaatggacaaagacagtgagtgagtgggattggcaagggacaaatggacaaagacagtgagtaagtgggattggcaagggacaaatggacaaagacagtgagtgagtgggattggcaagggacaaatggcataggacaaatggacaaagacagtgagtgagtgggattggcaagggacaaatggacaaagacagtgagtgagtgggattggaaagggacaaatggacaaagacagtgagtgagtgggattggcaagggacaaatggacaaagacagtgagtaaagtgggattggcaagggacaaatggacaaagacagtgggtgagtgggattggcattagacaaatggac

SEQ ID NO: 42682 - DNA, 950 bp, Heterodera glycines
  misc_feature (875)..(875): n is a, c, g, or t
agtggaccaaaatgggaagcaggggggagtttacgaaatggacgaagtaagtaaaaaatattcattgattggtgtagggcttgctcaagaccaaaaattcttgagactcgagaccgaggcctaaaaagacaaacccttctcgagtcgagactcaaggccgagagactcatgaacactaataatgctaatgaatagggatgacattttttggcacaaaagtcgcgaaataggcacctaaaaagcaggaaaaaatcgtaaaataggcaattacataggcagaaaaactctcgaacagtcacaaaaatagttaaagtctttttcgaataaaaataaaatgttaaattaaaaattttaattaagaaaacaaaattgtaggtaatcaatatttgtgaaaatttttaaattgttaggggcgaattttctgaaaaatttcgggtcattattagggtgtaaatcgtttttaatgcttttttgttaaggatttttctaaaatcctttttagtcatttgcctaaaaatgcaaaccaatgctaagtcgttattgacgccccttttggtggtttttattctgtataacggtcccatcaccgtattcagcctagagaaaccgtaaaaaattaatttaaaattgtaaaaagattacatataaacaatcttatgggaattttaatttaatattttattatttttttaatatttcagatagttttgtcaaaaatccgcaatattggattcatattgcggctaatgaacaaaatagaagcgaatttatggtgatatcgctcttacaaaaatacagaagagaagagcgacgggtcaaattgcaaatcggattctctgtttttcgtgtggtaaaatatgtcaggggtccgggtntttaggggaaaatatcaaaaaatagggaccgaaataagggcgaaaatattaaatggggatgaaattaaaaaatat

SEQ ID NO: 42683 - DNA, 966 bp, Heterodera glycines
  misc_feature (24)..(24): n is a, c, g, or t
  misc_feature (50)..(50): n is a, c, g, or t
  misc_feature (54)..(54): n is a, c, g, or t
  misc_feature (90)..(90): n is a, c, g, or t
cgattttattggttttgctgacgnagataatggttaccagagacaaaccngggncccctcgtattgtacgtgagagtgaaattctggacncgtagcaagacggactacaagcgaaagcctttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgaaggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgccccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggat

SEQ ID NO: 42684 - DNA, 896 bp, Heterodera glycines
agggcatccaattatatggaaatccatatttttttcctggacagagggaggcctaaaacgcaggaaacacatgtttttacttggtttaaagcttctaggatgggtttccatatccattttttccatatttcgcatttatgtccatatttccatatttgtccatattttggcacttatgttcatattttatgcccatattttggcatttttccaaaaaacctctaatagaacggccccaaccgataaattggccttttgacctcaaaaaccggaaaattttccaaaaaataatttttttagcaaaattttcacgaaaaatattgaataaatttaaatttgccgacaatcgaatgagtttttcagctcaaaatttggaaatgtatcttatatgcaattcaaccaataaatttgaagaaattttgagaaattatactctaaatttggaaaaatttatgtccatattttgagattttatgtccatattttgagatttttgctattttatgtccatattttgcgatttgttgtccatattttatggctatatttcgtgattttatatccatatttttggttgccctactcatgagtagggctgtcaaaaatatgtacaaaagtggtccaaatatgtacataaatatgtatgaaaaaacccaaatatgtaaataaaaattttttttaaatggttattttttggaaaaaaaaatcctcgtaaagtatgaaataaaaaatttgccgaaatttttaattttttttttgaatatttccaaaaattttggtaaaaaatcctcaaaatatttttaaaaaaataaaaaatttgtcgaaattttggcttttttttttgaggattttccaaaaattttcccgtaaaaaatccctcaaaatatgtaaaaaaa

SEQ ID NO: 42685 - DNA, 1244 bp, Heterodera glycines
  misc_feature (52)..(52): n is a, c, g, or t
ttttcttcatgctctgcacatgaccattaggtgttcaattttatgcggaatncagggcttgaagtgtttatttaggtcaacaattttattaatttcgagtttttttccttacatttgacatttaattttggattttgtgttttggttaagctaattttttgtgaaacaatgcatatttttagttctttaacataaaagaaaaaggttcttcaaattaatttatatgattgattatcattattttctattcgttcgtgaaatttattaattaaaaattttttgcatattttaaaatgtttcctaaatattccgcatttatacgattattttgtacccattttatgaaatattcgcatttaatttttgaaaaataatttttggataacttgttaattatttaaattacaaccaatcattcatttaagtttaatgtagtttacttatttcacaacaatcaaataagaatattaaataaattttaattatttaaaaataggaatagttgattaaaatattttttgtaaaaaacatagaacatgatttaatttattttttaaatataattttattttattctcattttcctacataataagcactctctcatcaaaaattgataatttatttattttaatttcatttcttaaccaaaataatgaactttatttctttcgtttgtcatcattggttgattatataaaaataagaaaatcggaatcagaaaaatatgggaaataagaatctgatgaaaaattttatttaaattttattttaatcaggaatgttaatagtaaacccgattaacaaagtattttcaatatatatttaattatatttaatgaaaaaatttaattttttgttatttattatattttcttaaaataatattttaattttaatcaattaattgatgtgaagatgcggaacatccacaaaaagtcgcatgattgatgtcgcttaagatttacaatattcatctcttcaaacctcataattaaactttttttaaaatttattaggtagcaaaaaagtttacatattaagcaatttatgcaaattgttattgaagataaaaaaaattaaaaatccatgaattattcaatattatttttcaatattcaattcattctaaataaaattttgttgaattaataagcattagaaatttattttttttcaatacgtgatgtcgccttttgaatattcaagccatattgaatatttttttaatttatgataaatta

SEQ ID NO: 42686 - DNA, 867 bp, Heterodera glycines
  misc_feature (32)..(32): n is a, c, g, or t
tatttctaaagattccgaaatttaaaaaaaantcggacattttcaaaaatatttcatgttcaaaattcattttaaattacattcataaaatcatttttctcacgagaatcttacaaacaaaaaaaaaattgaattttttttaatggtgaattaattagtgtttgtgaaaaaaacaatccaataaaacccagcttattgcaaacattgatttgaaatcaggaggaggaggatttgcataaatgttcatgaattaatcatataaacaaacaatttattagaagatatttaataattcaaaagtaaagtggtttttgcgtgaaaaataatggaccaacattatagtaaaggtttggcaaaatggtactgggagggaatcgaaccctcgacctctggtgcggcaatcggcttcccacccaaaccagtggtgctctttccgtcggagcccttcccttttatggatcttttgcccccgctttaagcgtttcaaccgtccgctggctcattccttacattatttatgaattaagaaaaattgtatttttcccaatgacgttcgtaattgccagaggagagatactgtcgagaagaaaaatctttcattggcttacaacgataagataaaaacaaatttaaataaatagtgaaagtccaataaatttaaaaaatggtatatattcccactgacctttataattgccggaggagaaattctactgtcgagaagaaaaattcaaacgacaaataaaaatagggattccgtataatcatcatataataatagttttacgatttaaaaaaataatctattaagagaattataacaatataaaattatttaaaaagaaaaattggagcaataaatttcta

SEQ ID NO: 42687 - DNA, 1178 bp, Heterodera glycines
aaaaaccggtaccggtaccaactttttcaaccggtccttggtaccggtaaaaaccggtaattttccaacgtaaaaatttcttggacaaaattttccaaatacaaaatttttattcagttttcgcgcgagtacctgttttttagcattagaattgttcagaagtatatgtatattgagggtgaccaagtttttttttcaaattcaggataaagaacactaaaattcagatatagacctcaaaattcagattattgcaaaacaaggggtcagcagccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaactcaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaattttttaccggcggtaccggtactagacaaaccggtaaacggtattttcatttttgaaaaaaccggtaccggtaccaaaaaaaccggtaattaccggccagtaccggtaccggtaccggtaccgctcaaccctactataaatccttaacaaaatgattgtccggaatttcctctccgacccccgagttttctctccccgagttcggcgaccaaccctaatgctcaaaaatggattttatttggtcaaaatggaaggcaattaatacaacgccgggatcactatttataatctgtcatattttaatcaggcatttctttcattgtgctatttgttgctatcggacaacatttacacgttgatcaattatgtggttggttagcatcaataata

SEQ ID NO: 42688 - DNA, 1117 bp, Heterodera glycines
ccacaatgctttttttcgggcatttatcagggtatccttttgatggcaaatgcaattaaatggagaattttttataaatcttgattagctaattattttgcaattttctatcacattacaatttgtaaataatgatcagctaattagttggcaattttttatcacattagattaatgggtgttgggtgatcggaatttaataaaaacccatgatgattttccatggagtttttgaaatttttttaaatgcaattatattgtaatgggatagaaaattgccaaataattaggtgatcataatttacaaacaaattctgcattttattgcatttccaccaaagcataacccgaaaaaaagcatgatgcccaacatgggcaaggtgtactttggtggaatcatgctaaaatgttgcagtcaagtttaaagtttttgataaataacgatcagctaattacttggcaatttgttatcacattagataaatgggcgagtaagaaacggattgttagatgttaaacaggcaaaagcaaaaaatttgggtcatattcgaacccgccgcttaatttttcttgtacatttagaataaaattgacttgatagaaagtcttaacaaaccatatttgttattaaaaagttatttgggcatataatgtcaatttctgaccaacgtaatgtatgcattaaattgaaatgatataagttattaaaagaaagcaaaacataagtttaagcttaaatttttgatatatctttaagtctgaccaagttattctatgttagttaaatttcagtcaactttggaacagctgtgtaaatttgaggtcgtattatatggagtatcaacaaattccataagcagtagttaagaagttccacgatgcttttgaaagtatttatgatttttcgaaataacagcgtttaaaataaaataaattaaatttgtaacaattaaccaatcagtgttcatcaaattcaataatatcatcatcggtttccttttgttccgtacccaccaaatggacatcgttgttttctttgtcttcttcaagcatatgaacgtcgcattggtcggctttatctcgaatcgtacccacctaaaaaaaaaataaaaaagat

SEQ ID NO: 42689 - DNA, 1341 bp, Heterodera glycines
gggaagcgaagtgcggccaatgaaagtgccgggggaaacgatggagggcagcaaatgagtggggaaatgggcgtgaggaaaagcaaaatgaaatgggaaacagagggagggcatcaatcagcttatctgttggacggtccaaatgaagtcggagacgaaacccccacgactcggcattttgtgaggaaataaacgcacttttggactgagtcaagagggatgcttaaacggacggcagaatgtaatcgtttggttgcaacggtcacccaaaaagtccatgatggtgcccgctctgtcccacttttctccgtccaattggcctttttcttttagccatgccaaagtcgccattccgtaccccgtggcaattcttttttccttttgtgggtcatttccgtccaaccatctgcattttgggtccacctgaccagtttccctcaaaagcgtactttggcagtttccgcaggaattgctcgtcgcagcgcgagtccatccacgtgatcagaggggagcagtggcaacggtccacgcccaaacttcactcacttttccgttttcattttaaaattaaaggacccaattgagtcggcttcccacagcatcactccgtgcatttgtcccgaaatgccaatgcctttcacttgtgccaatttgtccgtttccatctctcccatcaatttctgtacggtgtccaatattttctttgggctttgttcgtgtttgtccttctcctctctctcaattaatgcgttgtgttttctgtcccattccaaaaatgtcctgcaacttttaattactctcaaaataatcccttttaagaacactttttgtctccatcgattagggcaattttcactgacgttgtgccgaggtcaatgccaagaaaaagtggcatttgtcaaataaatttattaattgtgcactattaatgtaaacgaatttaattaaaatgtaaaaaaatatattaataatatttaaaaagaattatttttaatttgttttttaattaattaattagaaaacaaagaaatgacgatataatctttttcctttctgataatgaccacatcgatttcttttttttgtaaacatattcctcattcttttttaatttctttctttggagaatgaattaacacaatcatttttaacattcaataaaaaacatataaaaattcatattttttatataaaacattgtgccaaatttatattttaaaaatttaatataaatcgatttttccgttcttcctcatttctgtcggccttaattcctcattttgctatttgagttaaatcccaaaaactcaatggaagctgcttcaagtttgaatgatttaa

SEQ ID NO: 42690 - DNA, 747 bp, Heterodera glycines
tcctttcattatgcttattccattccccctccccccccactcttctacagtatgccgagttcaacgcaatggtcgctcagctggaggcactgcccgagagctggggcgaccggcgcacgctgctttggctgcgccaatacgaacagtttgatcgccgtaccgacaaattctggcgctcacttggcttcgccaagcaccgccaatacagtcccggctatgagaatttggcattttttctcgaccagttgggccatccgccggccatcaaaacggaagaggtcgcgcaaagcgttggtgatgccaaggtagaagcggcgtacaccgtatcgttcccgtcccctagaaatatttaaaaaaaaatttcaaatttagaaaaaatcttagagaattttacaagaaaaattataagaaaaaatgggtttgaaaagtttttaagcgattttttgtaaaagttttttgaaaagccttagtaattcatcataaaatttttaaaaaatcgttgtaagtccaaaattttttcttggaatttcttatagaattttctaagattttttttttgaaaatttctaaattagggaaaagaatttgaaaaatttttggatttctttgacttaaaattttttatttgaaaattatttaaaaaacccaaaaattcaaccaaacaaactcaaaatcaacggctaggccccaaaatcggtaaatctcgggtttatatgcagatacaaaagtcataccctcgctcgggat

SEQ ID NO: 42691 - DNA, 1079 bp, Heterodera glycines
tgaggcttttgaaaatcttcatctgggagccctgtctttcccaaaacttcgtggccatttgaccacgtcattaaccatgttcgttggttgactgctcatttaaccaccttattatagatcgggcccgggtaaattggaaattttggatcggtgaaattgaaagaaaatgccttgtcaaacattttccttttgctaattaattcgcaattagtcttgacaaaatttgtaattagttgcactttctcaaaaaaacatcaaattgctaacacagtagcctaatttattattttaagaaatgcataatttacacacaatgagaaacgaaaacgcattcagagaattcggaagtagaaaaagttgatgggttatcacatggcttgttctcgtaaaagaaagtgaactcgctaatcttctttaaaagtgaagaaacaattgattgtgagaatcgtgtggatttgtgtcaatgccaaacattcaaatggcgctgaacccgctgcaaacagagcctacactttgtaatcgttcatgtaatagaaagtcttccagaatttgctcctgttttgtctgtatttgaagtaaacgacgatcagagcgaaggcgaacagtccgagccacagaaattggagctgcgctcggtcggtgactccttcaaaagtccgttcgttgtgccgacccgcccctccgccgccttcgaaattgtcctcgatgttcttccactggcgcttaaacccttcctgttcctgtcgtaaccgtgactcaacttcctccaatttgtccacctaaagaatgaattggtctgtcagcagaaaaatggaacacctatcgatgctcccaaaccaacgccacttttaatacccaatgattttttgaatttctctccccgcgttgcgacccctcctgcccctgcctggtaaagtccactcgatagactcgtgtattatttttataatccgagggctcaatgcagtgcgattcatattcaaacaattcccgccgcccctctcactttttcggcattcagcttaaaaaaaagaaaaaaaaacggttcgcctccttttcaactttccgacctgcaggca

SEQ ID NO: 42692 - DNA, 1218 bp, Heterodera glycines
tgcatatatattccctgtatgagtgtttggatccatgcagaaatttattcaaattaatgaaaaattttgcattgttaatcaattggaaaaaatattttagttttttactattaattttggagaaatttatttagaaaaaaagtggcagaatttttgcttttttagataagaggagcaattaattgttcttaagaagacaaaattatttaggccaaaaaactcgttatttagctatttcttgaaataaaataaagattacaattttttaaaataattttatttcgccttcctaaaaactcacagccttattaaataaaaattgtcatatgaaaaaggaattagcatttaaaataaagcacaaatttatgaaaaatatgtggatcacaacaaatgattaaaacatattaaggaaaatttgtaatataaaataaaattttccatttttgattaatccccatgatttggggtgtgccaaggacgtagcaacaaaagtttttttttgtgaatggtgccgtcaggaaaattttaaattcgtttttttgaatttttcagaatcactatgcccaaaagtggcaaatttagtttaaatttggctgaagtaaatgcatcacattcatgaacatctgctgctcaacaaaacccaccgaaaacttttgctgtagcgatttaaaatgtttaattatcgaaaatggtaacaatagaaagtgcattagatatgctcatttcgtgcaaccgtagtcctattatggaatacacagcaccatgcgatgacgtcgtgaattacacataaacaattcccgttataaatacagaaaaaggtgggaggagggggtagaataataaaaattgataataaaaataataataatgaaacgatgataatggaacagaacaaaattggagagagagtaaatatgcaacaaaacaaagccatattaaataatataacaataataaaagggacagcggtaaaatttataaaatccataaaaacagcaacaggcagagagaaagagaggagagtcgtacgagaatgatcaagataagcaaaattgagaaaagtgtgtaaggacgaaaatgacggatacaaaaagggagtgcgggatgggttgagttttgttggttgtgtagtgaacggatggatgggcgcgacgacgttgggggaaacggctaactgagaacagccaattggattggcaggtgggcggaagtgaacag

SEQ ID NO: 42693 - DNA, 906 bp, Heterodera glycines
  misc_feature (67)..(67): n is a, c, g, or t
atgtgtgtcgaaagtgaaaggtgcgaaaatttgccttatcagacaatgaaaaaaggggggaattttnggggaggaatttttgaggggagcccttccccccccccccgaagcgacgaccgtttacagtgaaacattttaatcgaaaataattaatcaccgaaaatgtacccaattacccaactaaaccctccttccgtgttgataattttctcccttaattatgcatttgcacatttctcattctgtctgtctgcacgtcgttttgtttgtttaactaattaattaattaatgatcaccagcagaggccgatgaatgatttgtttttagttttttcatttttaaactaaatttgtcacttttagccatatggattctgaaaaattctaaaaaactaatttaaaattttcctgacggcaccattcacaaaaaaatatttttgttgctacatccttgattacaccccaaatcatggggattaatcaaaaatggaaaattttattttatattacaaattttccttaatatgttttaatcatttgttgtgatccacatatttttcataaatttgtgctttattttaaatgctaattcctttttcatatgacaatttttatttaataaggctgtgagtttttacgaaggcgaaataaaattattttaaaaaattgtaatttttattttatttcaagaaatagctaaataacgagttttttggtctaaataattttgtcttcttaagaacaattaattgctcctcttatctaaaaaagcaaaaatttctgccactttttttctaataaatttctccaaaaattaatagtaaaaaaactaaaaatattttttttcaatttgataaacaatggaaattttttccattatttggataaattttctgcattgaatca

SEQ ID NO: 42694 - DNA, 637 bp, Heterodera glycines
tttgaccgtggacgattgtttcggtgactttccgttcgttgcgtccgctcatgcgacaattcgctacgtttgtcgggggtcggcgatcacgttggacaaaggtgagcagccgaccgaatcctttcaatgctttttcatcagcaatttgcccccctggcggtgccattctttcttggcccttttcttccatcggtgtcctaagagatgactatctcgcgtctatcattgagttataagctacgttcgtctggcgcattcatatttcacattagttatttgctgaaataacaaaaaaaccaaaattttggaagttttttcttaataacttttttacaagctaaaatttttttttattttttgtaaggctaatatagcttgtgaagggctttcgaatgataccaagattgttagatttggccaacaatgaaaaaagttataatcaaaaaactcgcgttggcgccaaaacgtgggcgccaaaacgacccagtcccaaaaaacagaagacgccatgccaggtgatttcgacaatacagataatttttaaaaatggagtacatatgatttgtttgtccctttttcgggttagtcaatgcgttaattgacttctgtcaattgatttacaaattcttttttcctt

SEQ ID NO: 42695 - DNA, 928 bp, Heterodera glycines
cctgcgaaggtttcgggtcgaaagagacaatcactccatcttcttcagccacgcgatggagcaaaaagcgggccatcctttgaaaatgaaaagcaatttaaatacaattttataattttcggattaatttgaaaaactgaccaaagctgatctcccatttggattccttaaatgaaagcaaaatttgcttctttttttattttaaaaatgacaccgaccttcacatgggccgacctgaaattcccattggcccggcatcacttcggcatttgtacccgaaatcagaatacccgcgtaaagacaagcgcttgaaaaagttaaattaaaaatagtaaataaatagataaattaattaaataaaagtgctaaaaaagaatcaccgatagtgtgagtccacaatatcacgaccataagcctaaaaatgatttaacagaaaaaattgtcaactaatttatagtcaatctcactttgttagctccagcaccgcaataataaggcccttaatttgccatttttgaatatattaattcaattttaaaattttatagagtaattagagccaaaaaatgattaggccgggaaatgaccttggggcccggggaagccgaacggcgcctttggccatccgaacggatgctggtcaacgtccagcagtgtgtactcctgctccatgccaaaccacgcgtgctgaatggggaaaagcacaactgtataggatttaagccaaaatgattgattgtcattaaaatgaattaaagcaccattaaaaaagataaagccttttaaatatttcaaccgctcatcctttgttccagccgaaacttttggaaccctaatccgaaaatgatctaatattttccaagattcccgctactgcaaatgccatttaattttcatgtatttaaattggagctgtgctataattttg

SEQ ID NO: 42696 - DNA, 1524 bp, Heterodera glycines
  misc_feature (1448)..(1448): n is a, c, g, or t
ggtgtttttttcaaacttggtcaatacggcgtggtcggtactgctgcttccctgggtcatccctcgaagtgcgccaacgccaactcggccccaccatgtcgtcgcgtgtgtcagcgaaattcgaaggcctctcctggatgtgccgttttgctgccgcctgagctttgcggtcgacacctaaagttcaaaaaatatcatgccatcactaaaagaatccaagttcctacggaaggagcagacttccgcagccagtccccgacgtgtttctgttggttgaaaccaatagccaacattggcacgatggtttcgtttattttcaaaaacgaaagcatcccattgctgccgccatctggagtgacaatgctttgccaagtgtccctgtttgaggcaggcaaagcagtattttgacccttccttgatgttccagggcagcgccctccttgctgccgcctgatttactaaagataaaatcggaataatgattaagtatgtgtgcctcggatcaacacggctcctgttttttttcacggtgacgcttatctacgccaccggaatctcccaccaaaatttcgataattctttaccctacaaccctttaataaaataaatgacaaacgaactccaatcttccaaaatccaacagttcgctgggaggtggccgctcgctttacaggcgatgcacctcttgttgaaatgtccgtttccaggccggtcagcaggacagatcccgacggtgtggccaggttggcggcacttacagcaggaatttgacgggtggatttttttgcacttcttgcagatcgattccatttgaatataaaacaaaacagaaataaacctgttaaaataagttaatataagcgtttttttaaactgcctcaagtgagtgaaaaatagggtaacggtaatgttaacgatattttatggcgtttcagggtcggagaagccgatttggacgcgaatcccggacccgggttcgaacaaaaaatcgaaaatcaaaattttcaatttagcttttttgtgcaaactttgtttaaaaatatggaaacaaaatgaaagtcatcagtgcttcaataaaaatcatttaagccatttttagagtatttcaaaaattttgaattttcgaccttttgttcgaattcgcgtcagtgattcagaattggtgaaatggaggtacttgtaggttttgtcacccccccctgaattttttttttctaataattttttctcggctagtttttgatgctgattacgaatatgacaattatttttaaccatgacgtctttccagtgtgaaaaattttaaaaggtaacagtgaagattgtaccccccccccttttcgaaaaaaaattccaaaatttttttttcttgaagtaaattcattttaagagttttcacggtcggagaatccgattcttatattcatttcgaccgaattcgaaccttntaaccgaatcgaaacaaaagtcgaaacttgtaattcttttctagttcgcatttttgggtcaaaaccggcttaaata

SEQ ID NO: 42697 - DNA, 1238 bp, Heterodera glycines
  misc_feature (1158)..(1158): n is a, c, g, or t
  misc_feature (1224)..(1224): n is a, c, g, or t
aattgccatatttgtcctttccagtggcaaaaacacgattatttgtgcaccgacgggcagtgggaagacaattgtggccactgacattatccgaacgcatttgtggcgtgccaagcaggagggacgggtggcacgggtgaggccaaattggggggggagggcacttggccaaaaaacagtgactggatttgttggcattttgtataaaaatttcacaccgttttttcatctgtttgttgttgtacagtgcgtgatgttggtccctaccgtaccgctggtggaccaacagagttgcgagtttgtacagtacttggccggccactattgggtggacggcttctcgggctgcgagaattggcacgacggacgtgcccaacgcgtgttggcatgcggtgggaattgttacacattttatttcgcctttttaaatgtctgtccctttcccacttagatttgtgcgttatgacacctcaaattttgatgtaagttcattgaacatctgactaattgctgtaattgttagaatattggcatattttttgttcaaacagtcagcaattgaagatgctttttagcttcttaatggatcccggggccgttcacccaattgcgtattattttatgtccaaattacaaagtttggtgtcctcaatttcgggctgttcctgtttttagggcttctgcaactcggtgcccactttttcctaatgtttaaacatttttgcttttgttttggaattaacacattgttttacccttttaattttgatttgttttctcgcttttgggcgggactcgagtttcttcgtctccgcgtttttacaatatccctcccattccgcttcagcaacatgatgaactcggtgctggagtcggaacgtctttacttggccgacttcactctgattgtgttcgacgagtgccaccactgtgacaagggacacccgtacaaaagtgccgtcaaaacaacaacccccaattttctttaaatttattttgctattagtgatcatggatcagctggccgagttggacgccaaaaattggacaggcaaacggccacaaattgtcggtctaaccgcttcgcttggcgtcggcgacaccagctgggacatggcggcatgccgacgggtccagcagaaaaatcggattaattanattttggcaaattgctttttagcacatgctaacgctgtgtgccaatttgagagcggaaacgatcangtccgtgcgccatc

SEQ ID NO: 42698 - DNA, 863 bp, Heterodera glycines
  misc_feature (803)..(803): n is a, c, g, or t
  misc_feature (824)..(824): n is a, c, g, or t
aaaggtatatgagttgccaaacttttctacctttggtctcccaaaattgcgattgctggcacgtggtgggatgggaatgcgaagaacctgtgaaaaaacgcaataaattgctaattcttgctataaattgaggaaaaagtgatcagcagcatattataaaatatgataaaccgatcagaaaatagagaaaaaagtgagatggttaatgatcaaaaatttttataggcaattaaagaggaaaaatgaattaactaattgctattttttttttataaattactcaaaatgattacgacaccaaacaaaatgattaagcaaggtaactaattactaaaattagctaaaactttttaaataatcagctgatcagagtgaacaatcagttttttgtctcttaccgagtttttacgcgaaaaatactgcacatttgggctgatctgatcatcgtcctcctcctcttcgtcattctcttcctgatcagaacggacggcaccgccaagcggcactccccgtcgtcggttggcatcgtttgtgtgctgttcccctgccaaatacacacgagtcactgtggcagctgatgctcggcctaattagtttttggaataggtaattagcaaataattaatagtgatttgacattcaagaaaattaaatacctatgacaaaagtgtaaattcaaaaaaaaaaaaaaaattaaaagaaaattgatccatattttagcataaatgagcaaaaaagttatcagcaatttttatgtgtttttgtctaatctttttagcatttatctagcacttttttagctnttattagcaacaattattttngttttcggtttttaagaagctaaaaatcccatttctaat

SEQ ID NO: 42699 - DNA, 1072 bp, Heterodera glycines
atcacaaagtgttactgttttccagagtcggcaaatgctttcgatcattgaaagttttgttatcattgaagggttggtaaatataacgcccaaaaaacctttaatttatttatattactgtattattacagttattccttccttcgaatggacggcacaactccaattggcagtcgacaaacccttgtcgaacagttcaacaaagttattgctgcttttcttacaatcctcactttaattctaaggatcccgatctttttgtgtttttattgacgacaaaagtcggtggacttggcataaatttgaccggagcgaatcgcgttttgatttttgaccccgattggaacccgtccacagatgctcaagtcgatttgctcaattttacaaattaattttccttatttttttggtcttaggcccgtgagaggtcctggcgaattggacagcatagggcggtcacaatttacagactgtgcgttacaaaattattgcccaattaaacaattaattaaggttgacaagcggaacgatagaagagaaaatttaccaacggtgttgtttttcatcggttttcgttaattaatataaatttattcgtttaattattacctttaaggcaaatattcaaacactttttggccaatcgcattttggacaacccaaaacagcaacggttcttcaaaaccaacgaattgcacgaattgttcaccctgggctcgtcaaaaagcgaccggaagtatggcacaggtaaaacaatctgtaaaaatctcatcaatttcactcccaaattttagaaacggcggttatttttgccgccaacggaagcgaagtgagcagaaaaaagttgaagaataacatggataaaagaagggatgaaaaggaggcggagaacaaagcgaaagtggcggaacggacggacgacggcggaaaaatgccctcggctgattttaatgacagtgcactttcggacgaggcccgggaaaggcttaaaatggtcgccaaacgattagcggcgtaaaataaataacaaaaaatgcttaaattaacaataattttaaaaattttggaaaaa

SEQ ID NO: 42700 - DNA, 1542 bp, Heterodera glycines
  misc_feature (46)..(46): n is a, c, g, or t
  misc_feature (61)..(61): n is a, c, g, or t
  misc_feature (109)..(109): n is a, c, g, or t
  misc_feature (1530)..(1531): n is a, c, g, or t
aaaaaaatttaaaaaaatttgatcgtccataaataatttgtaatgnatcaggggctcacanaattttgcagagatacgtatcgaaccctacaaaagcttacttatttcntagatttttaaccccggtgaaattttttgcagacacccaccacttttgcacttaaaaaaatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaattgggccttgttaagctgtaagacacccaccacttttgcacttaaaaaaatttcaaaaaatttgatcgtccataaataatttgtaattgatcagcggctcaccaaattttgcagagatacgtatcggagcactacaaatgcttactaattttcctagattttttaaacccggtgaaaattttttgcagacacccaccacttttgcacttaaaaaaatttcaaaaaatttgatcgtccataaataatttgtaattgatcagcggctcaccaaatttagtagcgatacatatgtagtatcctccattatttatttcaataaattttagaaaaacaaaagggtcttccacccctttggtttcttaataaaattcaaaatctttcactttttttgttgatttttcgtcattagttccatcggttaaaaaaaacaaattctgtatcaaaacaaacaacaaaaaaaaatttgaccaaaaaaaagtgaaaaaattttcaaaaaaggccactttttaaccagcgccaaattttttaaattcttaaaaaataaattaaaatgttactccgccaacgaaagaaggccaacagcattttcagggttacttctcaatttaagatgaataagtgcgcgaacggcctcctgctgacaattgaatctggtgggcggaagatcgccatttcgcatccattccgaattgtcaacactaagtaagaatgaaatacaaatacataagttagttagcattttgcactttacaatgttaaagcaaaccaaccaaatcattggctttccggtaagattgcaatttatttgcggcaattatatccaatgctannattgacctgca

SEQ ID NO: 42701 - DNA, 1436 bp, Heterodera glycines
gaatcgacttaaaatagtgataatatttgaatgaaataaaagaaattattttcttaaaaataatgtgtattttaccaatattatcgatagggcttcaattatatgaatataaaatcgcaaaatatgataatgaaaatagaaaattcatgaaacattgagataaagtcgcaaaaattgatttctgatttggaaacattttcttcaattttattaaatttagtaaaaaattatttcaaatggttcaatacggtattaaaataatttcagaaaaaatacaaatattcatgaattttttgcgaaaaaactgcctaaaacccaaaagttttggaatatttttgacataaatttaccattttttaggaaaaattctattatttctttttagcttattcgcccattttgtatgcattacggtagtatccccctgtactgtacataccaaccgtacttacactgtcaaattcgggtccgccttcgatgctgaaaatgccattggacaccgacttggcatatgttgcccactcgctgtgcccgttcagtgtttcgtgccgtataattcggtgcgtaaatccatgcagaagacaaattttgacattgaatttgaaatcttcgtttatttgccatttttccgttaattcttcccattccttttcaaattttgttctgatttcttccaattttccgtcaaaaagcttgaaaaataaaaatgtaaaaaacgaaagtttaggtaaattaaaaaaatatttttaattaatatttcaattattatttatttgcttaaaaagttagttacttccatttcttttatgtgtctaaatgcattttcgacgacgtccataaaatgccaaattacaatttggaagtcaagcactcctttttttggagagcccaaaaaactgtccaccgaataaattgagaatatttctttgagtgtactgcgcatttcatccaaaagtccaaattcttaatcaaacagggctggaaatcgtctcgaaaaataatccaaagttctacatagttacgggataaaattacacaaaaattgcaaaaatccgtaacccgtaatccgtaattactgggaaaatttccgtaatccgtaattacgcccagtcttgtaattaaatttattttttggggattgttctaatggcaaaatttggtctttggtctttcaatttcacctttatccggcaatttgttcttatccagttcccttaattgctcaatgggcgcttcttctcttgggcattcgagaatttttttctgtgaataaaataaattttcgaaaatttgattaattcattttttaaatattcaccgctaattattgtacctcattttgtgtgacagcagcaatgattaataatgcaatgaaaataaacaatggaaacagaagaagtccaacggattgcatgccaatatttcggattttatta

SEQ ID NO: 42702 - DNA, 901 bp, Heterodera glycines
gaggaggaggagggtgaagtccgactcggagacgaaggacgagcagaagaggcttatgaaatggagggggaacacctccgacaccacaacagctggctgagcagaacgcaaaaacaggttggcagagaagggacagactttcccaagaagaaacaccccacggacagatgctgaagaaactgcgcaaccggggccacgaggaccacgaaatacacgaacaaatccacgaattttacgaagtgtccccggaagaagtgaaagcaactgccagaggaattctccagagaggctgcgaatccatcttcaaagtgtgtgagggaagagagaaagacgaaaagaatgacaagagagactaattaattaataggttaagcaattaattattgacattgattaagcgtatctttggagaatacaaagcggaggaaataatccaggtaattagagatttaatttaatgagtgtcgatgacgtcaattgtttcatttgattgtttgaagatgcgcgacgaaggagcatccaatgttgaaattgaggagaaaatcacagaggcactgaaccaaattcgaagtccgcagaagcgacaggaggccggccgatttgcgatgtcatgtcgccgaatattcgcaatgattgtgagtggctaatcaccgccgaattttcatttagctaaggaacgtcgtcgacgatcggcggataacgccgaacattcgctggatcaactgttcaaatcgcatttgatttggctgaatgagcagcaacgggaggagctgaagcaaatgaaagggtccggaaagggacggacggaaatgcagcagagagtgatggaatggtccggccagttggaggggcaagagaataagaaagcgcgagaacacctgcgggacgggtgggtaaacgg

SEQ ID NO: 42703 - DNA, 1269 bp, Heterodera glycines
  misc_feature (82)..(82): n is a, c, g, or t
  misc_feature (125)..(125): n is a, c, g, or t
  misc_feature (195)..(195): n is a, c, g, or t
  misc_feature (1223)..(1223): n is a, c, g, or t
  misc_feature (1231)..(1231): n is a, c, g, or t
tttttttatagaatactacgcccattattcatttcaagattcgggttggacatatctctgtgaattttcaagtaaacaattnaatgaatacaccattcgaaagctgcttttgagctctttcaganaattacttaacctcgcccacacactcaatgtggaccaagatatacgcttgtaattcataatggctcattntacgcctacactcggcaaattccgtgttagctagtgtgagttgagaaattaactcttgcaaatccataatcgatttattaagtcgcttcatctgtttgctggactaggattttgtgtaaaaaaaatttgtttttgctagatatttaccctatgatgtgtttatggataattcaaatccctgggcactgtaaaattcctaagaaaaatttttttttatagaatactacgccattattcatttcaagattcggttggacatatctctgtgaatttgcctacactcggcaaattccgtgttagctagtgtgagttgagaaattaactcttgcaaatccataatcgatttattaagtcgcttcatctgtttgctggactaggattttgtgtaaaaaaaatttgtttttgctagatatttaccctatgatgtgtttatggataattcaaatccctgggcactgtaaaattcctaagaaaaatttttttttatagaatactacgccattattcatttcaagattcggttggacatatctctgtgaattttcaagtaaacaattaattgaatacaccattcgaaagctgcttttgagctctttcagaaaattacttaacctcgcccacacactcaatgtggaccaagatatacgcttgtaattcataatggctcattttacgcctacactcggcaaattccgtgttagctagtgtgagttgagaaattaactcttgcaaatccataatcgatttattaagtcgcttcatctgtctgctggactaggattttgtgtaaaaaaaaatttgttttttctagatatttaccctatgatgtgtttatggataattcaaatccctgggcactgtaaaattcctaagaaaaattttttttatagaatactacgccattattcatttcaagattcagttggacatatctctgtgaattttcaagtaaacaattaattgaatacaccattcgaaagctgcatttgagctctttcagaaaattacttaatctcgcccacacactncatgtggnaccagatatacgcttgtaattcataatggctcatttta

SEQ ID NO: 42704 - DNA, 982 bp, Heterodera glycines
ttcactatttactactaaaaatggaaatttaatttttttttcccttaaatgtgagaagcatgaattacataaattttacttccttaatattattctcgtcgtctcttcttttcaaattattttgggtaataaatattatatttttgaatatttcggcacatatttcaattaataatttcaattaattttcctaattattagttcctccatttgggctgaacctgttgctgctgcactttgctcaattgcacaataaacccacccaaaatgatgacaactttgctgctgctgaactgccacgttactctctccccaatttttgctgttgcgcgttcgaacaaatttatctaactaataaacaattaatcactcacaaattgcctaattagcgatgagttagtgaacgcatgagtgaacaacaacagcttgtgcactaaatttaaagtaaaatttcattgaaatgttttttgccctccccctcggtttttttgggcgaccaatgggcggccttttgctgaatttgtgcccccccctacccaaaaaatggaggccaaaacgcagaatgcactcctataaaagggggggtcaaacatgccaaaatcacgttcatttcccaattggcccccaatcgccggacacaaaaacccacccgaaaatgttccatttggccgccatcgttgcgctagcggcgctcgcactgcccctggcatcttcagacaagttcagaccatgcctcgagggctacgcacaatacggcaaatactgctacaaggtgtgtgcatttgactgtacttgctttacccactcgcggtttccgaatcatacgtcccctcgggtgacggttttcgaaactttccatgaattatgtcctctttgacgagttgcagttccgaaattctggcgaagggttttataatggcatttcattttgccattttcaggcattcacaaacccgacaaagcctgccatggtcagacgcta

SEQ ID NO: 42705 - DNA, 1016 bp, Heterodera glycines
atgaatacacaaatacaccctaaatatgtgcgaaaactcctaacatataaggaatggatcggaatgccggtttccgacatttttgggctttgaatttcgatttccaaattttttcagccgtcggaatgccgattttcgatcgccgaatttttttgagggcaccggcacacatctctgcctgccacataataaagatgagaaattgtgcattttgctgagggaagagagattataaagaaaaagagacagaataaatagttagaagaagaagaagaaaacaagagaaatagttgttagggaaggagagaaatagtgcatttctgtctgccggtctgtcgacgcggggaagggcagacagtggacagacgcgtcaagagggaatggtgaaaacggagagagtaaatggcaaaggaaaagaaacaagagagaaagaatggaaaggaggagacaatgaaaaatttgcggtgtgactaaaagcgcctccggtgaaaattttgatataaaaaagtgaatttgtcagcagacttgtccagaaattggcaaattttagcgattctgaaactatatttaagaaaataaacgtttttgggccggcagcgctgataggcactgccgggcaaattttttgaaatcttggctacgtttttaatttttgtacaaaaaatccagatcatgatccaacatggaatccaggtccatcgatcatgaactgatcctggtagttttgatcaggatcaaacgattttttttctcacgataaattttttaatttatgaatttcatatttattcttaagctgaaaaatcggcttaaagtgaaatagttatttttatttgattacattttataattgattaaatagtgaaaaaatgggaaaataggaaataataaatgtaccgtatttgctctaattaaggcccctgggggattatttttcaacctcctcagaaagggggacataattggagacagggcctttaaaggagacggggccttaattagagcaaatacggtaa

SEQ ID NO: 42706 - DNA, 552 bp, Heterodera glycines
aagaggaggggggggggggaagagagaccccctgaaattttgaagaattccccccccccctttcccaattttccaatttcactttttaaatgttttaccgcgcacggacaaacaaatcgtcgccaaatgtgtgtttgtcgtgtgaatgagtgaattgcgcgtgggaggaaatgaatgaaatgaattttgacctgccgattttcggggggggggggcggaggaagacgaaatttggaagaaatttgaggagcaacaaaaaagaaaaatgagagagagagaggcggaggaagggcaataaaagcgacggaaaacggaagggaaaagccttgggggaaaatcctctcgaattttctgccaatttttgggcaaattccaccgaataaaattgttgcaacaaattgcgcaaaatgttgaaggcactttcaatacgggtgaaaagaaagagagcaccgcttttggtgggaaaaggggcaggggttggtctctccgcggggttgcgcttccggtggggtttgtgggttttgggcggttttttcattgtttttgggtggg

SEQ ID NO: 42707 - DNA, 1013 bp, Heterodera glycines
  misc_feature (28)..(28): n is a, c, g, or t
  misc_feature (874)..(875): n is a, c, g, or t
  misc_feature (944)..(944): n is a, c, g, or t
cgatcagcaaattgatttggtatttctntggcttaaaaacaaatcaaaattaaagactctaattgattaaaattaaatttataagacaatactgtcgaagcctcacacacccccctcccccgcccaaccgacatctgtgaatcccggaccggaatacggtaatactatagatggtacccccccccttttcgaaaaacagtgtgcatttcgaccaatttcgaatctcagacccaaattcgaacaaaagttcgaaattaaaatttttggactttgcaattttggttcaaaatggtttaaataattttttattgaagtattaatgagttcttgtttgtttccgctatttgtgccgattttgaaccaaaaatgcgaaattcataaaaaaatgaatttcgaatttttgttcgaattcgggtctggggttgggattctaaaaccaagcttttcgaaatgcatatcaatgtccgaatgtatatagaggatgaccatctgttgataatcaaagatttttgctttttttttaaattttacagtcaggtgcaaaacggtttttttggaattggtatccgggatgcgatactataatgcagggcttccatttgttcttatttataagaaatgttctgattttgggctattattcttattttgttcttatttcttaaaattattcataaatttagaaatttatggcataaatgttcttattttccctataaattaaaaaaaaaaatttccccggcggcgcctatcggcaccgccggacgctaaaatactttattttctttaaaaattggctcaaaaatcaccaaaattggggcaatttttagacaaaatctgttaacaaatcgcattaaaaattacaaaatttttnncccggcggcgcctattggcgccaccggacgcccatgtccaacccccaaaatttttttgaaaaatgtcgncaaaaagccttttgaaatgtaaaatgggtcgccattgtctcaaatcgcaaaaatgataaattttgatga

SEQ ID NO: 42708 - DNA, 1569 bp, Heterodera glycines
  misc_feature (73)..(73): n is a, c, g, or t
  misc_feature (93)..(93): n is a, c, g, or t
ttttaatatttaaaaattacaaaatttatgaattattaattcaagaatataattaaaaatatgaataatcatnttccaaaaattcctaaaatntaaggaacctattgaaatgaaaaaaaaaatttgtaataccgaaaaaaattgcttagccatttcggaccaaaattttttgaatctcttcaagattgtctataaaacacatcattctcgaaataaatgtttgatcagtttaattttagcatacataataatatttggaataatcttcaatggctttcgatttaaaaatttatcttcatctatttatttcatttacttttgttggactgatcactgaggtaagtcagtgaatttttttttttttgatttaaaaaatattttttagccttaattttattcatcaattttcaggcttccatcaaagttgttccgatcagttatttgatcaaatttaatggaattgatcatccacaaccacaatatttgtcatacacaaataaacaaaatgtaaatttatatacatataaaatttactttatattttaaataatcattttaaattcaggtgcctaaaaatgaaaacaacaattataaaatggacaattccgtggtaaaactctcgccgaagttgaaggatgatacatgggacaaaaaggtaaaaaaattaaaatttttaattgaattcattaatttggatataattttaggaaaacaatggaatggtggtgcaacaacaaaaaataacgaaaaattttgctccaacaaccaaattaaatgatcaacaaaaagtgctaactcaaaaagatgatcagaggccgccgactttgtggacaatgtccagtttaaaacaaaaatttttaaaaataaaccgattattttaactgcatttcaacaacagcaaaaaagtgaacaaaatccgccagtcaatccaaattatattcaacaaaatcagtaccagtccactaaactgtttgatcaaaatcaatcccaaacaacttctccaacactgatccaaccaattcagtatcaaccggcggttcaaaaacagctccaactaactcagtaccgacctaattatccacatcaatttctgccaaatcagtatcagccggattcaatctctccaaatcaatttcatccaccagcagatttgcttcaacaaaaacaggatcagcagctggctacacataatcaataccaagcggacaagtctcagccggcggcgtcgccaaaccagtttcagcaagctcagtaccagtcgtctgtgccaagccaaattttcaaggagatgcgaacaaataccccaatctgcggatcaaagcaagaaaatcattccgcaatcggttggctctccagcaggcggaggaagaaacagcaaattcacgccatggaatgtgcacagctactactacacaagctatgatgagtgtgacccgtggtgccgtgcgcattgtgccaccaaacggacgcccgaattctgcttcaaagctgggccatgcttggccaattgttaccgaattatcaccaattttttgagggcccgtcgaatgtgaaatgaataatctcata

SEQ ID NO: 42709 - DNA, 938 bp, Heterodera glycines
ttttctttcataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaagggtctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttaaaaaaattttaagagatttttgattattaatttgaagtcttga

SEQ ID NO: 42710 - DNA, 1219 bp, Heterodera glycines
tttggtgttttgtgtgcaaaagcggtcaaatggcagaaataattgacggaagaaaaagcgaaaagaacggcgtgaaggaatgccgaaagaaaaaccacggaagaaatatgccgaacacagcttaaaagaaaaaaaaaatatttttgaattaaaagtttaagcagcgaatttaaaaaaatttaaaattaacaaaattattttgaaattaaattttttatcggtttcaaataaaaaaaaagtttaatttaaataatttttttaattaagtacagttgaaaaaataaaacaattactttaaatgattcgttcagatttatttattttcttcctatttttttgggcagtttttagcattagaaacttctaattttctttcaaaatttttgtcataaactaatggaaaacacatattggttattaattgcaattagcataaccaaaaaaaaaaaaaaccgatttcgttttccttaaattttgtttatttttgtttctttctgtttctgtgatgtgatcgatcctttttgtttacattttccattccgtttcattgtgcttttgacggataacagatgctaatattgctcagcgccgatcgccccgttttgtcatcccttcctttccttaatgatgctaataaatgaaactgatgatcgttgtggcaaaagccgcttcttccgatgggttaagcccgggcaaaagcatgaaacattcattcattccatggtcagaagaagcagctgtttctttctcactacgtatttcattccatttgatttttccgaacttatttgttaactcattcataatcatatttttgatgaatttcatttttattcgaaagcattcttttcatttttcatttaaaattataaatttattttaatattattttcaaattttggagtaaaaattttattagttttatattgaatattaaaccagtaataagaaataaataactttaaacttataatttccttacgcactgtaacacattgagtcaaaatgtacggtaatatgggtcccctgtcgcttcccatcacttttttatcgcttttgctgttggcggtattttgccattctgaggatcgtaccgttggtggtgaagagcctgaggaaaagctgccctacaaacagtatttcagtgaacaaaaatatgtgagtgagcagaaaacattttcaaaaaaaaatcatagctttaattgaattgctaattgct

SEQ ID NO: 42711 - DNA, 1175 bp, Heterodera glycines
gaaaaagcagcgccacaaaaaaagcgacttaaaaacaaaaaaattaaaaaacaagttttggtcattttttgaataaaatctgtaacaaatccgaagacaattttcaaaattttttcggcggcgcctaccggcaccgcccgaccccaactgtccccgaagttttaaaaaacgcaccgcaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgaccgggctttctgtacccggcaataccctgacccggtatttgcccaaatacccaggcccgtacccctaatttaatatacgattttgaagttttttaaattaaaaaataaggctacagaaaaaaattgaaaaaccctcgcctctcgtcctctcgcctctcgccaactctcgtgtttttggggactctcgcctctcgccaaactctcgctctcgtctttttggggactctcgcctctcgccaaactctcgctctcgtctttttggggactctcgcttctcgccaaactctcgctctcgtcttttctgagacaagtcacacccctggtgcatatgctggtcattgaaaacaagtcaatcgattgcctaatttgcccgattgcccactgagaatttttcaaatgacttattttgctgctaataaacattcgattatattcaccgaccaggcgcgcacagaaaaatcccgcggtcgcggaaaaaaatgcctcgaatcgtggtcgcgtcccagccctgccgaccattgacaatgaacatttaaagatcctagtgaactattatcgtaaattcacgagggtatgaacaacggtgctgtaaacgcagtccggaaaaaatttttgatattttatatgcgaatcattacccagatttttacaaaaatgacaaatctctacagtctgagtttgccaaggacgaattttgtttttactaaaaatcggacacgggtccgtaaccccgtgttagtgccaaaaccataacacatgcccggcgtatgtgaaaatctcattaaaaaatttttaatttttttacaaaaaattcccaaaacaaatttttttctttgtgcaattttt

SEQ ID NO: 42712 - DNA, 967 bp, Heterodera glycines
  misc_feature (814)..(814): n is a, c, g, or t
  misc_feature (833)..(833): n is a, c, g, or t
  misc_feature (881)..(881): n is a, c, g, or t
tgtaacgtataaaatttctcaaaataagagatagtcccttttcttggatataagataaatttaaaaattctctgtgaacttaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcacctcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagatanatttaaaaattctctgtgnaattaaatggcgattgcgcaccgccctccctctcacgctcgagcgctnttgtaacgtataaaatttctcaaaataagagatagtcatttttcttgggatataagataaatttaaaaattctctgtgaaaataaa

SEQ ID NO: 42713 - DNA, 963 bp, Heterodera glycines
aaaattagccaaaaatcgcaaaatttggtcattataaatttgacaactttaatgatgtatcataactttttctgaaagcctttattcgatagccctatctattagtctgcaaaatttcaaaggatttggttatgtttcaaaaaagtcatgagcagaaaacctcaaaaaattgcattttgaccatatttttgaatcttgggttctcgaatgatacaaagaatatttgaactttgatgctttaagaaaaagttatgtattcattaaaattgtcaaattattttacagtcgtgtcttttttggcaaaattttgccttttattggtcaacattttaaaaattttgcccctttttcttgaaattttaattttttttttttttggaagggagaggagttcacctccctggctacgggccagaaaccaaagtattaatgctctaattgagtggttttttaatttaatgaaggttctaagtgcatataaatcagggcttccatcgaaaatttttctaaagcagaacatcaagtccaaaaaataagattttaaggtcaaaaataagaacatttcgcaaaattgcttcaaatcagttatttttacaatttattcgatcaaactattaaatacaatatttttcacctcctattattgatttaacaattttggggaggaaataagcaaagcgtatatttcagtgcattcgggatcaaaaaaaaatcagattttaacaatttttttgcggcgaatttttccaaaaaacttttggtgaatgggcaagaggagagggggtccggcggtgccggtaggcgccgccggaaaaaattttgtaatttagttttgatttattaacagattttcacaaaaaatgctaatttttgcaattaaagccaagtgacgacttttttttcgtttttaaaaacgctttttgcggcgcgtttcttccaaaaattttgggagacagggggggt

SEQ ID NO: 42714 - DNA, 981 bp, Heterodera glycines
  misc_feature (19)..(19): n is a, c, g, or t
tcatcgtcgtcgccatgcncggaaccaccgggtggtccaatctcggcaaagacccagtccagtaccgctgctggttgctgctgctgttgtcgtagttgtacctggagggggcggagaatttgaaacattgaaataacaaaattattaacttttttaataagaagatttcatggaaaaaatgtttcaacgaatttttcaaaattttattatgaattactattttttgaaaaaagtttccaaaattccttgaaattttcttattaaaaatttattaagattttttaaaaaaatttctaagaaaaaacggcattttccgaatagatattgggtccaaaaaacaaccacggcaaactggaaaaatctttaaatttttcaaaattcattcttttcattcgtaccatgccggcgccgctgttggccatggctgttgttgactattgtaggcaaactgttcatgcccagcggagccgtccacaggctgaagctgctgttgcggctgctgctgatactgttgaggaaacatttcgttgggccccgcgtcgccgtcgtttcgcatgcgactccgttgttgttgctgttgctgctgtttttgttgttgtaccaccgttctgcgcatgttcaactcctgctgcaactgtcgctcgcgcaaatgtcgttcccattccgccgcgtcggtgtgcaggaaacgcgccaggcgactgcgatgacgttgctgctgtctctgctggcgtcgcagtgccgctgacgcggcggcattgtcgctggcaccggcgccgcgcccgccgaagcggtcacggtccgtctccccctgcggatggggccagtagtaagtggtgtcatcacgctgctgttgcggcacatggcgaccgcattccgccgtacccggcatcgtggatgacagcaaagcgcctcgatcatagtgccattgttgatggggactcgtcgccatgcggacacaatcggatgacggatatgcctctg

SEQ ID NO: 42715 - DNA, 957 bp, Heterodera glycines
tgggcagagtgcggcgacacacggcgctcaaatgggtacatgaacagcacgcgctcggccgactcgtccttggacaccaaaatgacgccgagtggtgtcatggcggcggcggcagaggaggaagacggtgccatggcggaagacggagaagtggggccaaaatggcggtggtggtggaaagctaaaggaaagaagtatgggccgttcgcaatatttattcaaatatgagcagttttagccgctattttaagtcaattaaatgtttcggaaataaaagccaacccataaatttattagcgtaattgtctcgcaattaacataaattatgcatgatagttacccaaatgccgctgcgtttgttgctgatccaatggcaccaaaacggtgccgtcggcggaaagtgttggggtgacggacaacgattggtggacaaccatttcattcaagacattttgtgtaacgtaaatttcaatcattcgatttaaatgaagtagaagatataaatggcaatagatgaccattttacgagacaaataaataaataaaaacccaaactcattaattttaattgtaaatttatgcatttgtattggcattttttgttgaagaaaaatgtaaattaaagttgagtatcaatctcggttcaccacaacggtcactctttcagcacttgccatccaattccagcggaattccatgtctgcaatggcattttttgatttcgttacaaaagtttaaggaccaacccccgcaaaaacttgtacagctcggccccgtcgtagtcgtctcccaattcggcactcatacgaataaaattgccgatcaactgctcatcgctgtacacttgcaatgtcggaagggcgttgagagtctatttgggaaaatataattgtagaatattttttggtacttttttccgttttgaggccaatattttgaattttttttaatcaacgg

SEQ ID NO: 42716 - DNA, 1260 bp, Heterodera glycines
acattctgatctcatcaatgtttctctgcgctcatcgacggattgcccatgcaaatcaatcccagaaacaaggaagtgtggacgatggtcatcaacggaaatttcgactgcgcgttgaagggggggacgagcagaacaaataataaaccaccaattccggtcaccaaagtattctcgagagcaagttcagaagcacaaattgaaaatcaccaggaacatcggtaaggtgaaaagagcaaattaaataaatgagaaaagggagggaaagggactcgctaaataagcaaatcaatgccaaacaattgcttacggttacgccaattcatcataattcgactgtgttcactagtatggcatttaaccgaacaacgaccgatcttccttcgcgcaatgacaataatatggacagaacgcgattagagcgttatttctgtgtggattatgaaatggccggcatagtcgatcggctgtctgcgcgcttctggccccgaaatggatgccaaaaacactttttggatttggactttttgcacgggcactcaaacccctcgggagctgactttgtgcacttcgttaatgcttgagcatggcacatggataaaattcaatgcagagtctgtcaaaacaaaaccgaccgccaaattgctttatgggagtttaggtgttaccaaaggggagaaatagacgaattcaaagagttggcgcattggttggatacccatgttaacgagggcccaaaagctccaaaagtggtcagttggagaagctgtgggagtcggactgacacctctttaattaatcccactccctcgtcaaattgggtacccaaagatgaaatagtctggcggggtcgagacccaattccatgctaacgaagtccaggggagtcggagacgacaatttacgaaccaaaaatgacctcccctcatttatgtctcattgtcaactaagtcggaactgcaaattcttcaagaatgtttagtgtttggaatgctctattcaaataccggctgactacgacccggattcagaagtgcacaatgaaatttggacgtgccgtttcaagccgaagaacaaccatatcccgttcatcaaaaaattgattccgacagatgaattgaagtcctatttgaaacaacaccgtggaaaattcggacttttcgctcggctggaatacagaagggaattcggcggaaacggtcgaactgtgggatattgaaaaattgcgaaattattgacgggaatgaacaagaaacccga

SEQ ID NO: 42717 - DNA, 1503 bp, Heterodera glycines
  misc_feature (8)..(9): n is a, c, g, or t
  misc_feature (1378)..(1378): n is a, c, g, or t
  misc_feature (1432)..(1432): n is a, c, g, or t
aacagatnntaacaacaaaataatttgaaaaacaaaattataagttttttgaaggaaaacaaaattcaaagattagtttcaaaaattttcagggaagaaaccaattaattagtaaaataattacctcgtttcgtttcgtaaatattttgattaataaaattaactgacctcaacctcaacgaactgtcgatgaaagaccagcaaatgcaccgctctcatcacacattcgtactcaatacaaacgacgaaagaaaatcgtccgtaattttccaaggcggcgcgaaaacgttccgaaagttcgctgcgggaaatgaggacgttttgcgacttggagaggccattggaagttgagggggactgattgtgagcagaaatcggtggggttggtacggactgagaagccaaattatgagcactcgaactgcgcgaagcggaagacatggccgagggcagcggaagaccatcacttttgacagcgattttggcactttgggcggaatgagaagagtcgaaattcaaaaaattacgccacgccttccgtttcgaagaattctttcctggaaaacaaattcacgaaacagagaaagtgaaggagtacctgtgaaaaatgacgtgctattggacagattcttggtgtcggtttcgtcttctgacggtccctgcagcgactgattgtgggagggaatgccatcggtgggcgaccgcgaggcgttttcctcgccgatggccacgtccaccgtcgtattgtccatcgttattttagccacttcgtctgagcagtatcgttggtgaccaagggaagccctaacaattccgaaatcaatgccaaaaacgcaaccgttacttcgattggtgtgcaaatgcgtccataactgttcgcactttgtaattttggtgcccatttttcggctcattttcctctcgccgattggacgccattcgctgtttgtatttgaccataaaagccgcgcagcaccatccctcataagcagctaaacattgtgacaatggagagaaaagtcattgaaacggaacccgcaagccaaagcaaatcggcggtggatttgagcaggtcgatggccgattggtaggattggacagcggcctcaaacagtccggtgagaaaagcgtagtctccggtctttttgcgaagtcttccgatgcattttttccttaaattccctctcgataatttatttttgggttctcttctaccaataaaaagaaggaaacgtggaccaaactttttgtgaagggggtcgatttgcgaaaacaaaaaatgaaaattcaaaggagttgacggaatagaatttcgcaactcaatccctatgaaaaatgtaaaaattaccgcccccttgtccaaatatgaccctcttanagaatctcagttttggtcaagcgaaggagaagggacgtgcataccctcccttgnaaaaacgttcccccccccaaccctgccgtgaaatttaaaaaactttatgaacatagaaaatttttataaaa

SEQ ID NO: 42718 - DNA, 878 bp, Heterodera glycines
catcattaatagtaattaatactaattaattacatccactctatcgctgctgttttgctgaaaaacaacagggcctaaaatttcacaatatttttaataaaaaattcaaaaatttcaataaatacccaaattttggcaactctttcagcacacaaacccaaaacacccccacatatcatcatatcacacaccacatcacatcacatcattatcactcattaatcatccgcagaagaccaacaccaacaccaaaccagcagcaaataaaattgtgtaattccaacgccgccggaggcgacgggggggggggggggtcggctggcagcaaaaaaaagtgattgaaaattgggggataaacaaaaacaaaaaaataatgacgaatgggaggaaaacgatgggctctgctgggccagcgccaggaacagcagcagcaagcagcaaatggtggtgcactttgacttgaacagcagagtgaaaaagtgaacacaaacacaacagcagaaagaaaataagcaaaaaatcaaacatcaaattttaaagggggaaataattaggtaataaaaatgtaaatatttattaattccaataattaaacacacacaacatacatatgtatggatcagggaaggggagcgataccctcaaaaagttcggaaatcggaatctccgagggctgaaattttttggcaatcgaattcaggcggctcaaaaaatttcgacccttgaaaattgaaattccgagcccaaaaaggtcggcaatcggaaatcggcatgctgtcgtcccatccctgatatgcatattaattttgacaaaataaattttactaaaaaatgtaattcttttttccggaatttcattttatttcattttatttttt

SEQ ID NO: 42719 - DNA, 688 bp, Heterodera glycines
ttttgagtgacgtcatagcaccatttcttggggccaaattctcccaaaagtcagtgctcacaaatcccaatgtgcagcgaccgatcaattcgttctgttccccccgcccctcatttgctcgcatttacatatttatttatttgtctccgtccgtccatttactaactattagcaaattttgtcgacacgttttatgcccgggaattcccgagatcaatttgtctttttaaaattctgtcaatttatcaacatttgcttatccaagatgatacagaccataatagcctttcttaaaattcaatctaaaacatcaagccaaaatgctaatcacctgcttaatttgaaaagtgcgatccgccccattccagcacaaaatttgttgggctataactttttatagacttatcgtaggaccctgaaatgattaccattctgtcgattgatatggtatgagtagagctaatatttatattttttcctgagctcctcgtagcctgaaacacacgagaaaaatatgttttttttcggttgttgttaaactaatttccgagttattggcaactattttctagttttttagttttagcacctaaaaaactaaaaaaaccaactgttttcaacttatttggcgttttgctcaaaattttttaacaaaaatgcaataaaacgaaaaatacacccctaagaa

SEQ ID NO: 42720 - DNA, 954 bp, Heterodera glycines
  misc_feature (947)..(947): n is a, c, g, or t
agaagaagaagcgggacaaagcgtcgagaaagaggcgtcttctgacaatgagtgacggacaaaagaacgacaacaaaaacagtgaccagtaaagaaatgaatgaattgggaatgatcgatcattatatatttgacacaccgtccgaaaaaacgagatgtgtaccaataaatagagagtgccagagaaaaacattatcttttttctttaattttttgtctccttttggcgtactatctaatttaggaaaaacaacatttacttcgctatgtttagcttcttttctatatgttagatccacaggaaattttgcatatcgttagagaaaaaaattctgcatcgattaatgctgaatttatttttgttaatgctctatttcaaaagttataagaaaaacaaaattttaaggcctcataacttttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttggacaaaaataaatgaaaatattcatgttgcacaacggactcgaaccaccaccctttgtctctttactatcttacaaaaaccactgagccacacatgcaaatcttttctggcacaggagctcatttcccggacgctgtgttgatgaaataattttattaagaggaattgcaaaatgtgtgtacatgtaaataaatcggatgtataaaaaatggcaaaatcggttttagagattaataaggtaatactaccgatggtagggggttgcagtgaaattaaaacatccaagaaaacttattcacttctttttagacttagctcgtcaagagctttcggatgataccaaatttttcaggattcaatcgttttaaaaaaattagaagtgtncatctct

SEQ ID NO: 42721 - DNA, 1610 bp, Heterodera glycines
ttagtaggctagagtctcgctcgttatcgaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcggcgaaggcgaccgagcaagtggtaatgacacagcgctggccaggcatccgagcttcccggacttgggaagaaccatctcgccgctggacacagctccgagggcagtgcacaggcactcacacgagcactccggatttcccggttaggacacttcctca

SEQ ID NO: 42722 - DNA, 958 bp, Heterodera glycines
  misc_feature (906)..(906): n is a, c, g, or t
caataaattggttgtaaaaaacttttgggtattgaattattttttgaagtgagtcaaacaccctattagtgctttgctgtgccgagaaccggcaggcaatggatggctttaaatctgcaagaaattagatttgcaataagtggttgtaaaaaacttttatgtaaggaattattttttgaagtgagtcaaacaccctattagtgctttgctgtgccgagaaccggcaggcaatggatggcttcaatctgcaagaaattagataggcaataaattgttgtaaaaaacttttgggtatggaattattttttgaagtgagtcaaacaccctattagtgctttgctgtgccgagaaccggcaggcaatggatggctttaaatctgcaagaaattagattggcaataagtggttgtaaaaaacttttgtgtaaggaattattttttgaagtgagtcaaacaccctattagtactttgctgtgccggaaccggcaggcaatggatggctttcaatctgcaagaaattagattggcaataaatggttgtaaaaaacttttgggtaaggaattattttttgaagtgagtcaaacaccctattagtgctttgctgtgccgagaaccggcaggcaatggatggctttaaatctgcaagaaattagattagcaataagtggttgtaaaaaacttttgtgtatggaattattttttgaagtgagtcaaacaccctattagtgctttgctgtgccgagaaccggcaggcaatggatggctttcaatctgcaagaaattagataggcaataaattattgtaaaaaacttttggtattgaattattttttgaagtgagtcaacaccctattagtgttttgctgtgccgagaaccggcaggcaatggatggctttaaatctgncagaaatagattggcaataaagtggtgtaaaaaacttttgtgtaaggaatta

SEQ ID NO: 42723 - DNA, 747 bp, Heterodera glycines
  misc_feature (741)..(741): n is a, c, g, or t
tctctgccctatgagagagccgtaaatcattcactcgttttggtcaatttggtatcgatttgttttgtacatgctattccattccgatgctaagaaaatttcgaccatttctgttcccggaccctccaaaaaattgagacttcaaatttcattggtgactttcaatttgtttccatgtatttacataagccgtttgaaccaaaaatgtgttatttgaaaaatcaaagtttctattttttttgttcaaattcggacctgggattgaattggcggatgaaattggtactgtattcgtgatcagcgatccctaaaacccttaaaaaaaatttccacatctttttaaatttctaaaaatttaagggtggtttaccatcggcgtcattcttgcctttgtttttctaaaaatataatttaacaaggcttaatccaattttacatattgcacatttttttttctcttctgttgtattacatattaacaattcttctacacataacccttgaaatggtggagtcaattcgggtgatcgctttgattgatatgggtaaggaagggaaagcatttttttggcttttttccaatttatgcattcaatcactgtttacgcgtcctcaatttccttttggccataatattcctgcttggtcaatcaatgtctaaaaaacaaacacaaaatttggtgtttttccggtatattcattagaagataattttttttgtcaattgcatttaacaaaganatttaa

SEQ ID NO: 42724 - DNA, 589 bp, Heterodera glycines
  misc_feature (282)..(282): n is a, c, g, or t
gggggggggggaaggcccaccacgaggccgcgaagcggccgagtgagtaccttcggtgcaggaaaattattaaggaagagagttcattatttatttgtcttttgcataattaattcataagtatttttacagaaactgctctgaaacgcaccaaattttatttacatgttagtttaggcactctgatgcttttctatcaaaaagggagatgaataaaatttttaaaaatttttaattcctttttaaacaggccaaaaagtttaggcttaactttttagtganaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcattagtagtgttctgatacgtattcctgcataatttggtgagcccctgatcaattacaaattatttatggacgatcaaatttt

SEQ ID NO: 42725 - DNA, 870 bp, Heterodera glycines
ggggatctctagagtagtatccctgcaaagtttggtacgcttctgctcaattagtaaaaattttcctgcaccgaaggtactcacctcggcctttttcgcggcctcgtggtgggccttcgccccccccctcccacgcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattc

SEQ ID NO: 42726 - DNA, 987 bp, Heterodera glycines
  misc_feature (979)..(979): n is a, c, g, or t
atgaaatgaattgaattcttttattgtaaatgtatattttttgatcaaaccaacgcactgaatgatatacaagactaaacttgttgccttttaaatctttaacatttattttacaaaatgttcacaaattttgttaattttaattttattttttccatttttatgtactgaactattttatttgggagaaggtaacaattctcaattttatgataacccaaatttaaaaaataaaataaaaagcatttaaaaatctaaaaaaaattgaaataaaaaaataacattgtggcttttaatatatattttataatttaaaattaatttttttttttggattaagttgttttttaaattggattttattcctaagtttgtatccgtcctcaacactttaaacttgagctaaaaattaaaaaaaagatggcaattaaacagctaataaaaaatattgacaaaaattactaaaataaattcaagtggattatttttgcttttgttaaaattattttaaatttttaatattcattattgaaaatttctacagaatttttatttttattcgtgcaaatgaatccttttttaatctgaattacaccttaatatgggcagatgcttacctcttttgcgcgactatctataaattttataatcttattaattattgaaatgggcaaaatatttatttcttttttaaaataaatattataatttaactgttctaacagctaattttaaattgtgagaatttcccttagcattcgaattaatcataaaaaaatttttaaacgttttattcgtttcgtatcaaattatgatttatcatcacacacaaaaattgacattcttaagcatgaaaattataatgtttaaattgtcatgaatagcaattattcaatccaattttaatttgctttattttattaatttctttatttattaataatattttatttaatcttttgtggagaagcaaaattgnggatcagc

SEQ ID NO: 42727 - DNA, 634 bp, Heterodera glycines
taaaaaaattcgaaaaagtgcagtaacttgcacacccgtcaaaagaattccaaggaaagtgcagacaaaaaaggaagcgaaaatcaatgaaagcgtcacaatgagtgagtgaccagcacatcgacaacaatcgttcgttctctgcgaagtttcgcccttcagacattcgcacttttttggagccgggagaacaaatcggagcccgaaatctcttccaaggcctttaaaaagggaagcaattggacaaagcacacaaaagtgagccaccacagttgctctgttctttatgttctgtcccacctgtttggctgttttgccctccttcagctgacgtgccaaatggaagattccctgcgcgtattcctcttctctgaacggtcgttggcatccatcgttttttctcttcggtttggtttcccaacttacgtcagttcccccttctttttcataaggccgagctctccgatcagttcggttcggtctcgagcttcgtcctcaattttggtccgattctcaaaaaagaatagcatttctctttgctccctaagttcggccctccttttttgaatttcgttcagtcgtgccaaatgttccgcgcgttgcgcctgtgaagggttgcatttttgtgtaggaa

SEQ ID NO: 42728 - DNA, 1460 bp, Heterodera glycines
ttaagatgttaagaaatactttaaatctgtaatacggattttgtcaaatttgttgtatatatgcatatcaaaatgatggtatatgaacgcgtatcgcggcacacccgcataattttttaaactttgttccgcgtcataaaaaaatgggaaaggtgaacgaacggtcagtcactaatcccattccaaagaatatttcaaataaacatcaaaaaataaatgaatgaatgatgtattaagagagggtaaaggaagggctgaggagggggcggagccgcgtcacctcggcgcctgccaatcttccgccacatttgaatttatttgtctaattgaatcaatagttaatgataggcatgttcaaattggttgtaatacatacgtacgggtacatggtccgcttcgaggcacccttctcccctcctccccacacccgcctcctaagagccaattgacgccgcttacgcggaagtgataagtagggatgcgatttttaggttttaactaaattttttgctcaattgatttgaagaaaggagctcaaaaaacgcatttctgcattaaaaattttcgattctgatgtcactatcggtcactagaaatcactattttggctacttcgtcactaaaatagttaaaaatcactattttggcgttttgtcactatttcaacattttttggaaaattacttaacaaaaatacaacaagaacaaatatataacagtaaacattttttaattttgacttaagatatgccaaaaactaaatcaaaatcggccaactttcgggaatggatccgacggatcggtgggaatgacttttattcaacaactggcaaaataatttattgccaattatgtgaacaacaggtaactgcggcaacatccacccaacaacaacaactaccaataaaaaattcacagatcccttgcacgcaattcgcgcatctcaaacaacaacagcgaaacggcaaaacacaaggcaaaattggaacggaacaaaggaggacaacagcagcactttttgacaacaccaaacaatgttccaaaccaattcaacctcgatttatgtgaagcttttgtctcagctaacattcctttccaaaaattggagaatgaaaaattgaaaaattttttggaaaaatattgtaaacgtgaaatgccccatcgaaccactcttcaaaaaaattacttgcggttaacttgtgaccaggtcactccaaaaacaaaccaataacaaaaattaattttagacaatggagaaaattaagaacaatattggcgactctttcgtttggattttgtggacgaaacaacagacaaaatgggaagagcggtggccaatttgctgattggaaaattggatggacaaaaatggcacaacccatatttgatttccgtcaaatgcttggagaaagtggacagcgcgggaattgctcggttcgtcaacgaaggacttggtaaaa

SEQ ID NO: 42729 - DNA, 892 bp, Heterodera glycines
atcatcaatcactcccataatttttatgagatccctttttttgcgttgtgcactaatatctgtcattagaaatgtctagaaaaaaataattaaaaaatgaggacaaaagcaaagccgaaaagtccccaaattgagtgttttaaaaaaaagtgaaactgtccatgtcagaactttttttaggaaatgagtttttgaaagtggcatggggttgcattggttgcgccaccttcactgacatcaatgctcaaattggacaaaccgccaaagccactgtggactgtaaagcgatttttggcgaaaaggatctggatttttcgaatgaatatttcaattattcaatgttggcaatggccatggcaacaacgacgaagcagacaaagcgcaaaccgaaaaagcttatcacggagaagccgagcaccacggtggcaccaaaaaccaatggggcatggtcagcagaaatgacaatgaaggcccaggagacgacgattgaaggggaaccaatcactggagatcagggttaggcatactgtatttactgtgtgttcgttaaaaagccatttgtgcatgggtatataacagtcagtatattatggtaaaagttgttcctggaaaattggacaccgaaacaataagaaattaaaaatatccttagaatttttgtgtaatgtctttataaaattaattattaaatacattgacatttaaatattcaaaaattaaattatcatgaaacccgagttaccaaagaccaaaaagtgataaaaatgaaaccaattctattatttggttcatacatataaatggctgagcatcagtaaattaattttattttctttgccaatttatttattatattttataattactttgtatcatatttataaaaattatt

SEQ ID NO: 42730 - DNA, 1200 bp, Heterodera glycines
  misc_feature (24)..(24): n is a, c, g, or t
agggacgtttgaataagcaaggtnataatttgaaagtttattagtcttactagcctgaaaaatttcaaaaattttggttggggcgcaaaaaaacttttggcgtctcgcctttctgtactcaatttattttatttattttgacatatcgcaagctaatagagaacattttcgaatggtaacaagattatttgatcaaattctgatcacagccacccataaatgaatgtggacaattgaaacttattttgagtttacacgcatttatttacagacattattttacacgatgatggacaaatggacgtacataataattacattccttttttgatcaatgatcctatatttatcaattgttgttgtcgttgcatttggcccatcgttccttacaattagtaatttttccccacgtcgttcaactgatgcgcttgagcaatttcttggtccacatttggctgtcgtgaaacacttccatgtagcactggcacatgccacggaattcgtcctcaatttcgttgaagttggtcttccgcaatttggtcgtctcttccggcttgcacaaatttgtgtagcgtccccattcgttgaaagtgtcgccaaagccctcgaactgttcttaaatgggaatcaaaacatttcattttttgcatcttcctccattaccgatcaattcgtatgttttgtgcacttcgtggccacactggcgacatttgtacttcacctgcagcgcagtgtgtgtcaattctgtaaagattttaaaatgtaattaaaagcataaagttatgttgcaaaaaattggcaaaaaaaaagttcggaaaagccatgagaaaaaatctgtcataattgctttgaaataagtgctaacaataagcaagccaaaggccccttccctcgccaccgttttttttgggagagaccaaacgtaaaaatgccattttttaattcggttcctctaaaaagtcatgaagcatcaaaacacaatattatatatatcattgctttcgtgtaaattgtaacagctcacccgcgaaacacagagccacaagaacaaacgctatgacgatgcccaaagggatggcaatgataagcacaatgaacaaattcatgggttgactcggatcttctttggcatttttggcatcctcaaaatatgtataaaatgagaaagcgatgctccaatgagcattgagataccaacct

SEQ ID NO: 42731 - DNA, 655 bp, Heterodera glycines
cagtgcaattcaaagttcgctattgcatggtcaacgatttgacaaagtgttccaagggactgaaatttgccggtaaatctttggcccggggcgacttacacattgacttttgcccctctttatttacttattctctgccaattctctttctctctctccccatttgttcggaagcaattaattaattggtccgttaatttctgctgcctttgtttctcctaatacccattcgtttatcggtgggtaatggccattctctcttcctccttcggttggattaagtcgaattaaacttctaaagatcataagcatagatatgcgaattttatgttacttcagcagccgggttttaatgccatttcccacccattcgttccccccgggggaaactctccaaaagaaagagcgacgaatgaatgaatgaaagatgcgctcccttcccctccccccccccctccccttcagctgccatctgcttttccttctcctccttttcctagtcaatttcagcccttttgtgcctcatcatccatcccaaccataataatgctccctttccttcacttggactgatttcgtgcaaaagggcgctttgcatttgaagaggggccacaaatgggggggggggggggactgactcggaggggtacgttcc

SEQ ID NO: 42732 - DNA, 1369 bp, Heterodera glycines
  misc_feature (48)..(48): n is a, c, g, or t
  misc_feature (51)..(51): n is a, c, g, or t
  misc_feature (59)..(59): n is a, c, g, or t
  misc_feature (64)..(64): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (131)..(131): n is a, c, g, or t
  misc_feature (134)..(134): n is a, c, g, or t
  misc_feature (138)..(138): n is a, c, g, or t
  misc_feature (175)..(175): n is a, c, g, or t
  misc_feature (190)..(190): n is a, c, g, or t
  misc_feature (192)..(193): n is a, c, g, or t
  misc_feature (261)..(261): n is a, c, g, or t
  misc_feature (274)..(274): n is a, c, g, or t
  misc_feature (282)..(282): n is a, c, g, or t
  misc_feature (285)..(286): n is a, c, g, or t
  misc_feature (289)..(292): n is a, c, g, or t
  misc_feature (299)..(300): n is a, c, g, or t
cgacatgtttgccgccatgcaaatgccatcaacggcccctaagggggnggnaaaagggngccgncaacaacaaaaacacctcgacgaaagcattagaggaagaggaggagggccctganganaangangangangaancggagcagcagcagcagcgaggggaacagaaaaggangacgaagccgcccgnanntgggcaggggccacgaaggcgacgaaaggggggccaaacaaaggaagcaaaggaggggccgggggggncatggcaaaacgnactgaganatnnaannnnaaaaaannaagaaacaggctaggtcggaggcttaggcttgcttgggaataggcttggttaggactaggcaaatttacccttctcccccctcgagaccatctctgctcatccactaccaaaacatatgacgagaaccatcccatgccgaaatcttgtattcattcctgaacataattttcaatggtgatctaaccggacttaacaaaatgttggactctcgacatccaattaatcctttggttgctcataattaaaaaaaagtgccattggtcaaatgagtgattagggtgtactactccttttcacctcttccttaagcgaccatcaacaacatgccaaagcagaagaaggctgctgctgatcggttcggtgatctcatgttcattgcttcttcttttctcattcatctcgctgttcttctttttcacgcaacactcatttcggcacacatccgcacaacagaatggcaccggcacaaccaaaacaattaaacatgatgttgatctcagcaacgaattcgacgacactgaagtgatcagaaggcttcgcggggcatattcaggtgatcaatcgcccctctttatgcatttggttgatcaatgattaaaaaaatcatttcctcggttttattttcctcaaatttattttatttaatcaaatatttctatttaaattaatgaattttttctcctaatttagcataattgatcaatgatcattttagttggttgttatttttctccatggccaacaattaaaaataattttgtcaatatttgttccagacatttttttaactcaattgatcaccaacacactatagtgaatgaatgactgatcactttttggctctctcaattttcgttccagaaattccccccccccccaaaaaaaaaactctccaaggatgtgtcaaagattgatgaattgagaatgttgcgattttccacctccgcctcgccgccccctcccctccttttgtttgttttccgcattttctccacttttccctctctctcactgttttttttgggacacaaaattggccaagtgcccattcatcattgcgaacacttt

SEQ ID NO: 42733 - DNA, 903 bp, Heterodera glycines
  misc_feature (742)..(742): n is a, c, g, or t
ttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggatttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttnaatgtttggatttttttttggcttaacaaacttcatcgaacctggttctttctattctctttcaaatcgccccaaattttttttacagcttaactaagccctattaagtttattccagaaaatctcgcatgaattctcatttttaaatttttaaaaatttt

SEQ ID NO: 42734 - DNA, 1295 bp, Heterodera glycines
  misc_feature (9)..(9): n is a, c, g, or t
  misc_feature (29)..(29): n is a, c, g, or t
ggttttcgnaaaattttttgagcctcganaatgccatccccctgcccatggacacaaaaaatgtctatgggagcgcgtaaaacaccgactagaaagaaccccctaatttatgatcttttgatcatagaataatttgctctcggcatggtgaccacaaaagcctgatgtggtttcatggtttcattcaactctcaggttgttgacattctccatccgaatcgcgcttctgtgcccaaatccgaggtgcgtgagaggctggccaagttgtacaagacgacccaagatgttgtggttgcgtacggtttccggtgtcaatttggaggaggtcgcagcacagggtttgcaaatgtgtacgactcactcgactacgccaagcgctttgaggccaaatatcgcttgttgagggtccgttatttttccaaagccttagggcaacaaactcgccgttttccttttctgcgctagtattgttttccactttagcaaggcgttggtcagaaagtcgagaagggaggacgaaagcaacgcaaggagcgaaagaaccgccagaagaaagttcgtggtgttaagaaagtgaaggttcaagcgggcaaaaagtgagcaaacggagaaatgacaaagaaacgagggatggagacgatgtttggtgttgttgaagttgcggccgagaggcttctattgttattcttcactcgttgaaaaaatgaagaacaattcactggttttcataacgtaaatagacgacagcccaactaacactaaggattagggttcgtattaagttttaaaacggtacgtaccaaatgataatatcacgccaattacgctttaggaattactttaattacaatttggactattattttccagtatgatttggcctaatacgtatttgattgcccttaactttggctagacttcggcctttctcaataattcgcattccgtcgttttttatggcctttgccttaggaacatcccccacctccctctttgttcataagtacactcacaaaccattggctttttttattttattgttttaagaaagaaaatggagtaatcgtaatcacaccaaaataaaaacaaagaaatttgtctaaaaaacagtgttttacaagtgacgttattgtttaaaattctgaatgctctctatccttttagagcggtcaagcgaaaaattgggggaaggagaagcacttaaatgaccggcatcacttttggtagaataccagaatgtgtttggataaaaacaaacgcaattccattcataggacttcctgaggaaatgaaaa

SEQ ID NO: 42735 - DNA, 1518 bp, Heterodera glycines
atttgtgccattgtgtggcaaataaaaaatgtctgttgatcagcataataatcatctgaatgacatgggtcctccgcctgatccggtgatggaagtgccgccgccaaaagagatcaaagtgttagagagcgcggtcgacattcagcaccggcgaacagaagcaagtggttcagaacagtacaaccattaatttgagtgctaattggccttaattaacgcacaatgcctggggatttaattcgggtttcaatggcttaaaattggaatggaatgtttgtgggcataattaaccccattcattctaaaattaataatttcaggtgcttgaccattactcacagttcaaagattttgcgaaaaccaaacgggaccggctggaggaggcccgtcaatttcagtacttcaaaagggacgcggatgagttggaaatttggattttggagaagctgcagacggcagcggttagttgaaaaaaacggaaacattttaacttaaacgagatcggaattttcaaacccgggaacgaggactgatgttggatagttgacaagaaacgccgttttattgtaccatggccgcgccggaaacggggattttcaggattcaataaaatggccatcataatgtaacaaaatcgacattccaaattattccgttttggaatccccttaattaatatatatatttattagttaaatcaaacctaaagcatcattttcgaattgcttacccctttctctctcccccaacggccgaacgtttttgaaacggggaataataaagggttttattggttttttgaaaattctattggattttcaaattatataaaagaaacatttttcaggaggagtcctttcgcgatccgaccaatttacaagcgaagatccagaagcatgatgcttttgttgcagaagttcaggtcggaaactggtgaagagaatttaattaattttggattgaattttcaagaaaataaatatttaaaaggcattcctttaatgattcatactatttaaaagtcagcccaaaattgtttttttcatcttggagaatttttttattgttcgaaatttttgactataaattttcatataaatttttcgtaatttatttttaattaataaaataatatttaacattttgtgggccaataaaaatttttgaatttaaattctttaagcttttctcttttttgtttatataagaatttaacaattttttcttcgaaatttggtaaaagttcttttaaaaattgctttcttggcattttgtctaccgcctctttcaggcccactcgaacgcgatcaccaagctggacaagacgggcaatgacatgatccagcatgatcactacgaaaaggaaaccattcgcaaacgtttggaccgtcttcatgagctgtgggaccgactgttcgccatgctggagaacaagggcatcaaactgcagcagacgctgaaactgctccaatttgtgcgcaaatgtgacgagatgctctactggatcaaggataaggt

SEQ ID NO: 42736 - DNA, 922 bp, Heterodera glycines
tctcgtgcttccgagtccgaggctgctcgagaccgaagtttgaccccgagagtcataagaggaaaaataagggagggactcgaagcaaaacgagactaatcaccagagaagtgattgaacacaatatccccccacccgctcactgagaatttatgtaagtctgtccttgccatatttgcgtcccatcaagtcattaaattaaaatgcttttgcatattatttgtatatgtgaaagctccacgttggaacatactcataggaggggggggggggggggggggatttaatcaatcttcctcaattatatttggctattgcacatttttgtttcatttgttccaagcatcttcccacctttcctattagttgcttttaaattcattatttcaataattttatttttaataaaatatttttgggtcatacaaaaacgttttgggactcataaaatcttaatggggcgcacaaaatgtcactgaacgtataaatagcatggaaaatgtaattaatgccttccaacttgatagggccgaactgaccggctctgctgcaacagcccacggcatcggccgacatgcaacaacagccacagcagcacatttcctcctcgcccgaactgctgaccaccatcatcggctcgtcctccttggccacggtttggtctggcaacatttgctgttgttgccgttgctgatggtgagaagaacaatgatggcattggcactgcggctgctgctcgccaggatggcaacggtggtgcccgatttggtgttcatggccagaggatgtgtcgtcttgccgcatcctcggtagcagcaattccgcggatcgcgagcagcagccaccgccgccacagcccgtgccaccgcccgcggcgtaataggcctgggaaggcaaaacgggtcaaatggacaactgtgag

SEQ ID NO: 42737 - DNA, 1525 bp, Heterodera glycines
  misc_feature (899)..(900): n is a, c, g, or t
  misc_feature (903)..(903): n is a, c, g, or t
  misc_feature (908)..(909): n is a, c, g, or t
  misc_feature (912)..(913): n is a, c, g, or t
  misc_feature (918)..(918): n is a, c, g, or t
  misc_feature (920)..(920): n is a, c, g, or t
  misc_feature (924)..(924): n is a, c, g, or t
  misc_feature (926)..(926): n is a, c, g, or t
  misc_feature (931)..(931): n is a, c, g, or t
  misc_feature (943)..(944): n is a, c, g, or t
  misc_feature (948)..(948): n is a, c, g, or t
  misc_feature (951)..(951): n is a, c, g, or t
  misc_feature (960)..(960): n is a, c, g, or t
  misc_feature (969)..(969): n is a, c, g, or t
  misc_feature (984)..(987): n is a, c, g, or t
  misc_feature (989)..(989): n is a, c, g, or t
  misc_feature (994)..(995): n is a, c, g, or t
  misc_feature (1003)..(1005): n is a, c, g, or t
  misc_feature (1008)..(1008): n is a, c, g, or t
  misc_feature (1013)..(1018): n is a, c, g, or t
  misc_feature (1021)..(1024): n is a, c, g, or t
  misc_feature (1028)..(1029): n is a, c, g, or t
  misc_feature (1032)..(1034): n is a, c, g, or t
  misc_feature (1036)..(1037): n is a, c, g, or t
  misc_feature (1043)..(1045): n is a, c, g, or t
  misc_feature (1048)..(1050): n is a, c, g, or t
  misc_feature (1052)..(1054): n is a, c, g, or t
  misc_feature (1059)..(1059): n is a, c, g, or t
  misc_feature (1061)..(1063): n is a, c, g, or t
  misc_feature (1067)..(1068): n is a, c, g, or t
  misc_feature (1072)..(1072): n is a, c, g, or t
  misc_feature (1075)..(1075): n is a, c, g, or t
  misc_feature (1082)..(1082): n is a, c, g, or t
  misc_feature (1087)..(1089): n is a, c, g, or t
  misc_feature (1096)..(1096): n is a, c, g, or t
  misc_feature (1108)..(1108): n is a, c, g, or t
  misc_feature (1111)..(1112): n is a, c, g, or t
  misc_feature (1122)..(1122): n is a, c, g, or t
  misc_feature (1128)..(1129): n is a, c, g, or t
  misc_feature (1134)..(1135): n is a, c, g, or t
  misc_feature (1156)..(1156): n is a, c, g, or t
  misc_feature (1158)..(1159): n is a, c, g, or t
  misc_feature (1167)..(1167): n is a, c, g, or t
  misc_feature (1169)..(1172): n is a, c, g, or t
  misc_feature (1189)..(1190): n is a, c, g, or t
  misc_feature (1193)..(1193): n is a, c, g, or t
  misc_feature (1199)..(1201): n is a, c, g, or t
  misc_feature (1212)..(1212): n is a, c, g, or t
  misc_feature (1215)..(1216): n is a, c, g, or t
  misc_feature (1224)..(1228): n is a, c, g, or t
  misc_feature (1230)..(1233): n is a, c, g, or t
  misc_feature (1239)..(1242): n is a, c, g, or t
  misc_feature (1251)..(1251): n is a, c, g, or t
  misc_feature (1254)..(1254): n is a, c, g, or t
  misc_feature (1258)..(1258): n is a, c, g, or t
  misc_feature (1263)..(1264): n is a, c, g, or t
  misc_feature (1267)..(1268): n is a, c, g, or t
  misc_feature (1277)..(1278): n is a, c, g, or t
  misc_feature (1280)..(1281): n is a, c, g, or t
  misc_feature (1292)..(1292): n is a, c, g, or t
  misc_feature (1299)..(1300): n is a, c, g, or t
  misc_feature (1302)..(1304): n is a, c, g, or t
  misc_feature (1306)..(1306): n is a, c, g, or t
  misc_feature (1314)..(1315): n is a, c, g, or t
  misc_feature (1317)..(1317): n is a, c, g, or t
  misc_feature (1320)..(1320): n is a, c, g, or t
  misc_feature (1322)..(1323): n is a, c, g, or t
  misc_feature (1325)..(1325): n is a, c, g, or t
  misc_feature (1334)..(1334): n is a, c, g, or t
  misc_feature (1349)..(1350): n is a, c, g, or t
  misc_feature (1366)..(1366): n is a, c, g, or t
  misc_feature (1368)..(1368): n is a, c, g, or t
  misc_feature (1374)..(1374): n is a, c, g, or t
  misc_feature (1377)..(1378): n is a, c, g, or t
  misc_feature (1382)..(1383): n is a, c, g, or t
  misc_feature (1385)..(1385): n is a, c, g, or t
  misc_feature (1390)..(1391): n is a, c, g, or t
  misc_feature (1395)..(1395): n is a, c, g, or t
  misc_feature (1397)..(1400): n is a, c, g, or t
  misc_feature (1403)..(1405): n is a, c, g, or t
  misc_feature (1407)..(1408): n is a, c, g, or t
  misc_feature (1410)..(1410): n is a, c, g, or t
  misc_feature (1412)..(1413): n is a, c, g, or t
  misc_feature (1436)..(1436): n is a, c, g, or t
  misc_feature (1440)..(1440): n is a, c, g, or t
  misc_feature (1442)..(1443): n is a, c, g, or t
  misc_feature (1447)..(1447): n is a, c, g, or t
  misc_feature (1449)..(1449): n is a, c, g, or t
  misc_feature (1458)..(1458): n is a, c, g, or t
  misc_feature (1460)..(1461): n is a, c, g, or t
  misc_feature (1472)..(1472): n is a, c, g, or t
  misc_feature (1481)..(1482): n is a, c, g, or t
  misc_feature (1488)..(1488): n is a, c, g, or t
  misc_feature (1504)..(1504): n is a, c, g, or t
  misc_feature (1509)..(1509): n is a, c, g, or t
  misc_feature (1512)..(1512): n is a, c, g, or t
  misc_feature (1521)..(1521): n is a, c, g, or t
tttttaccgggcagaagggcgcgtttcttcaccaaacagcgaataacgcacaatgcgtcgtgcagagagcgctcggcttcgtccaacaccaatttgctggagccgcgaaccaaaatggacacagcgcacccactctgtttaaggccggtcacctgaaaatagttacaaaaatagccaaaaaggagagtaaaactccaccgactttgaggactttcccatcagccgtctcaatttcctccaccaaatcggccgttccgagcgattccgggacaaaatggtcaacggatgccaccgggcgacacccgaggattttggcatagaattcgatgtcatcccgctcgatgtctttgatcaccataattttcatttttgcgaaaaaatgcagcgccatttcgttgatggcatcgctaaagaggataatgttaaaaatgaaaacatgtcggaaaacgagtcagcgttcatcaccgcttaccgtaaaatggacttttggattagcagcacattgcacccggcctttttgatttgcttgcacagttccaaaatgtaatttcgttcttccttcagcgcacggtccatttgagcatagtcagagatgaccacttgattttccatctgaaataccaattaagtattgggaaaaggtagccaaaatttttttttttttgaatttcgcttaattgcaagcccaaatctatgaacccccccccccccccccccaccgccccattgtctatgcatgaaatggacgtacgttgggctttggtggtgagatttggaattggatgaggccaatcttcgccttctccacccgcgcggggcctccgtggcccatcgatttctgatcgatcagcgcccccttcatgagctgcgactcctcccccgtttcgcccaactttttnncgnctttnntcnncttcngnttgncncttgngtcctccggtgnnctcntcngtttcttcnctgcctgcnccgcccttggtgccnnnngntgggnnttttgcgnnncgncctgnnnnnnggnnnntcgnnggnnncnntgggcnnncgnnngnnngtgcngnnngtgnnctgnggnccttcgngttcnnnctcgtcntggcgggcttcnccnnctcgtcgtcntcgttnntgtcnntgggtgtggccctttcctcgngnnctttttcngnnnntgtggccgcccgttggnntgngtcggnnntggtggtcggntgnnttcctttnnnnncnnnngtgctnnnntttggcgtnttngcgngcttnntcnncctttggcnngnngtttttctgcngcgtccnncnnngncccggccnncnccncnncngtggtggtnccctcgcccgcctcnntgtcctgcgccttggncngctcgnccnnctgnncngtgcnnttgntnnnngcnnncnncncnnttcttgccctttttgcggtgggntgcncnnccgncntttggttgngnnttgtcgccccntcgttggtnnttgtcncttctccgttgcccgnttggntcnttttgtccnttcc

SEQ ID NO: 42738 - DNA, 680 bp, Heterodera glycines
ttttttaggatttttcctgccaatgtttgcgttacatttgtcaaaatgtgagccgattattcaaatcaaatgaatttttgcgaattgatcagaatttactttgtgaaatatttgaacgtgatcagttgatgatcaacgatgaatatcaactttggcaagctgtaattaatttaaattggaattatcttacaaattaattaatccgtttgttttccatcattaggcactccgttgggccaatgaaaagtgccgtcaaaaagcaatcgaatgttccgctgcaaatcgtcgtgctgcgcttggcccggcactgttcaaaattcgccttcctctcatttcaatggaggattttactgaaaacatctgtagcaattattaaaactaattgaaattaatttatgtatttttgcagtttcttctagaattctgacaaacgatgaaattgtttccatttatcaattccattcccacccgaatctccgtgatgtgcctgggcttaaaccgttgaaatttccatggcatggaagaatttctgattggaacatatccaagggcaacagagggaccctggcgatggaaattgagaaaatttctgaattttcacgagagaaagtggcaagtgagcggaacagtgaaatcgaagtgctcataaagggacttccgtggaaaatatcggcacaaat

SEQ ID NO: 42739 - DNA, 686 bp, Heterodera glycines
ttgcccaaaaattgtttatctcttgtttctccggtggatttgaccgcaaagtggctacctgcttttgccgtctccagcatgctctacctcacactcacacaatatttgaaatgctagctaaaagaattcttgcccaaaaaatggctatctcttttttctcctggggatttgaccgcgaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctactaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgcccaaaaaatggctatctcttttttctcctggggaagtgacccgcaaacttggtaccaacaattgccttctctagtctgggtctaccaaaaactcacacgatatttgaaatgaaaatgaaaaaaattcttgcccaaaaatggctatctcttttttttcttgggg

SEQ ID NO: 42740 - DNA, 1008 bp, Heterodera glycines
gattgagaaagaaaaaagttatggtcgaaaaattcgttcgacgacgtttcggctgacgacgttttttcctactccgaagggaggaagaggataaggaatggctgattgggatgagaagtgccgttaaaatatggcactgatggtgatgattaggacagttgggaaaatgaggacaatgagtggcattaatgataatgatgttttctgggcaaagagcaaaacaaatgggggggggaatcaaacaaataatgatgccgagaatggaagggaaatggaggagagaatactgattaaaagatgatagaggccgatgggatctgctgtttatccgttaataaatggtcatgagaattagaattcattcaaaaccgattaattcgattgccaaatgaaagtgttcacccacatttgcgcatttcgcgtccctgccaatgtgcggcatgccaaaagtgtccgtgccggtcctgcaccggtcaatgttgtaccaaaaggtcagtcgaagttttggcaacggaaaagcgcacagcgcggaccgcgtgccggccgcatcggaaaatgccgcatacagaataccatcatcatcccgttgatcgaacagcgccgctccgcccccgagtatggcaccggcactggcgacgccgaaaagggcgttgtcgtcgggcgcgcggcactgcaactccaactcggagtaggaggtgtacctgaagagaacagcacaattcgagcgttttttcactctctaactccataaaaatatgttttggtgggcattccgctttattttggctaatttaattttttactccccgcggggcatttcccttgaataatttcccaattttccccctgcccagcccctcgggaacaccccaacccactcgtggtttatcaattgaattgacttctccaaatattcgatgggattatcccccgcttaatccccctccgctcgcctgtcatcttccagacaaactctgaccaggcgcgtggtcagaggggagcccgact

SEQ ID NO: 42741 - DNA, 711 bp, Heterodera glycines
accccccccccccctcccaccttttttatgtatgaaacgaactgctccccaaatagcgcccctcaggcataggacggcattttcatgggaacaaatcccgcatgatgcatcgtttttttgcaggctcttctacacccgaccatgttggatgaacgacttcgtcaccgtgtggaacgaatgttggaacagatggcggaccagtgattatactcactgaatttggataccatttttaaacaatttaaaattgaacacatttaatttttgcatttaaagaaaattcttcaaattatgaaaaaatacaccctttgactaagttttgctgttattgttgaggaaaatctagctttatttaattttgcaaaaatatttatttatttcataaataaaagtgatttgaatagcacaattttattggatttccaaattaaattgaacaataaatgaatgaatatgtatttgaacaatgcttatacaatattaagaaaaagagatttgatttgaattcaaaacataattgagaagtgaagtgacggcaaaacgaaaaaacaaaagtggcacataaaatgaatgaagttggatggtatttttaacaaatggggaaagttttgacaaacatggaattggaacacaatacagaggacgtatggaaaagcataatagggggaagtcccccccccccccctcccgatcacgagaaaacaaatgatg

SEQ ID NO: 42742 - DNA, 587 bp, Heterodera glycines
tacaaggtcgacttccaaggacgggtatgccgatttgcaaggacataatgggaaaaattcattaattccaaggacattaacatttttattatatgcaatgaaatggttaatatttattcaaatggcttgtatttttcgctggaatgaattttaacgaatagttttttggtgccgataggcgccgccggggaaaatttttgaaaattatagtataattcgttaacagatttgcaccaaaaaaaggcggattttgcaattttgagatatggcgatgagcatttttaacttttcacaacacttcttgcggacgttttttccgaaagactttttgggaatatgggggaggggaaatttgttaatggatttatccaatattgatcatttttaactagagtgccacgggaccgggacctggtagcggacaactgagtacaactgagtaccgaggtcccggttttgaccgggaccgggactagtcccggttttttcccggttttcccagccaaaaattcccggtttttcaacccgaaaaggtcccggtcccgggtttgcccaaaattcccggtcccgtggcactctatttttaa

SEQ ID NO: 42743 - DNA, 621 bp, Heterodera glycines
cggagacctcgggagggcgacatgtcgggggtcgggtcggggtataggtccaaaaaacgtctcgtgtcgggtcgggggctcggggtaggggagcaaccctaaagcaaatcattccaaataaaataatacaaaaattaaattccataatataatacaaatgacaatatattagtcaattttaatttttgattgaaaaatagctataaatatgtttatttctttttttcttattattcagaaaaagatggagaatccaggaaaaaatatgtattttaattaatgttcccctctctcttttcattaatcattttgtcattcatttgttgcattttgtttgatattttgaaatacaaaaatattgataaaacatggactggatttcgttttatcgcattgccattcttgtctgatgatgatgccactgcttggtaacatgtgatttcgtcagaagtgatttcgtcagcagtgatttcgtcagtacgggatttcgtcagtgataataatcattttttacgaaaaaacatttaaaattaaaattcgttcgatatttaaatgcaaaatgaaattatttgctcggttgtcaaccgatatatgggccgctcatttgcatatcataaaata

SEQ ID NO: 42744 - DNA, 930 bp, Heterodera glycines
gtggttgagtcccagtgatgaaatgctgttgggtgagtcccagtgatggaatgctggtggttgagtcccagtgattgaaatgctgttgggttgagtcccagtgattgaaatgctggtgggttgagtcccagtgattgaaatgctgttgggttgagtcccagtgattggaatgctggtgggttgagtcccagtgattgaaatgctgttgggttgagtcccagtgattgaaatgctggtgggttgagtcccagtgattgaaatgctgttgggttgagtcccagtgattgaaatgctggtgggttgagtcccagtgattgaaatgctggtgggttgagtcccagtgattgaaatgctggtgggttgagtcccagtgattggaatgctggtgggttgagtcccagtgattgaaatgctgttgggttgagtcccagtgattgaaatgctggtgggttgagtcccagtgattggaatgctggtgggttgagtcccagtgattgaaatgctggtggtttgagtcccagtgattgaaatgctggtgggttgagtcccagtgattgaaatgctggtgggttgagtcccagtgattgaaatgctgttgggttgagtcccagtgattgaaatgctggtgggttgagtcccagtgattgaaatgctggtgggttgagtcccagtgattgaaatgctggtggtttgagtcccagtgattggaatgctgttgggttgagtcccagtgattgaaatgctggtgggttgagtcccagtgattggaatgctggtgggttgagtcccagtgattgaaatgctgttgggttgagtcccagtgattggaatgctggtgggttgagtcccagtgattgaaatgctggtgggttgagtcccgagtgtttaaaaatgctgttgggttgagtccccagtgattggaatgctggt

SEQ ID NO: 42745 - DNA, 1142 bp, Heterodera glycines
  misc_feature (41)..(41): n is a, c, g, or t
  misc_feature (80)..(80): n is a, c, g, or t
  misc_feature (140)..(140): n is a, c, g, or t
taattgattcggatgttttatcgcgggttaattagagcacngaaaactggtttgaaatcgtgaagtttatcatttctacntcacttctcaaaatgttgataaattgcaaatatattttccaaaagtctgttgacactttntgaaaataaattctatactcatgtattttccacttattagattttgcaggcttattgctgcatgttctttgacacttcttcaaaataacctatgccctttattcgttcaaaacacaatctttgttatttcgctttggattgacaagcccgatgataaatagctcgagcgcaaaacgcgtgcatgtttggaaagtatcgttcataccaataattgaggatttatttttaaatgaaattttatgataaaccttattatctcagaagctatttaattgattcgaattttttatcgcggttaattagagcaacgaaaattggtttgaatcgtgaagtttctaactcacttatcaaaattgttgataaattgcaaatatatatttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagtgtttatttttaaatgaaattttatgataaaccttattatctcagaagctatttaattgattcggatgtttttatcgcggttaattagagcaccgaaaattggtttgaatcgtgaagtttatcatttctaactcacttctcaaaattgttgataaattgcaaatatatttttccaaaagtctgttgacactttttgaaaataaattctatactcatgtattttccacttattagattttgcaggcttattgctgcatgttctttgacacttcttcaaaaaaacctatgcccctttatttcgtcaaaacagcatcttttgtgtttcgctttggatttgacagcccgatgataaatagctcgagcgcaaaacgcgtgcatgtttgg

SEQ ID NO: 42746 - DNA, 1070 bp, Heterodera glycines
atggtagtaccacacactttgtgttccatgaacggttccatagtcgcttgttatgatagtcatagttggggggcatgccctccaatgtgatggctttgggccggaaggttaaaacctcgtgtagggggtgacctatgcgcgtttttggctctccaaaaatggcccaaatcatcgctcaggagaggggtcatgcccgatttttttgggtggccattttctttcattttcgatcaaatcttattgttttcagttttcataaaataaaataatcaaaatcaattttagaaaaaatgagtcagttttctgatgattcccaaccccccgtgcttgatggtccttattcccctgttggtgatggtgggggcgaattgatggatgatgcacctccgctggaagacgttatgaaacgcctaccaatctccgttagtctttgcgaaaatgtcttaaaattttctattttaattttgcgaggtcttttcaggtcgagccatcggacaacaatgagcgcaaagtccaaaaggagccgtcgattacccatgaattggacgctgagttattcaacggcaacggatttgcatgtctctccgcagcacaggctgaagctggacggttcaaaggtgtggttataaacacaagatttttaataaaatttaaaatttattattgaattttttgatttatgttgtgtaaaattatttcttaaattaactattgtacattttgaacaaaatattttaaatgagccgtttagcgtttcgatttattggccagtttttgatgagcatttcgttcggcgcagttttcccagaggatatattgcgcaacctcattaccatgtgccttgcctatgcggttgaaggagctgagtcaatgaagatcacggccgaccacttcattttcctcctgacgtcaaaacatcttgactacgaagtggccgtccattttaaaaagcttgacaacacggcaactgagaggattctgactcgcttcgaaatggtcgaccaaagcaacaaagcaaaagaaaggccgtcaaaagtcgaggaaccttttgtcatagacatcacggcaat

SEQ ID NO: 42747 - DNA, 1128 bp, Heterodera glycines
  misc_feature (41)..(41): n is a, c, g, or t
  misc_feature (124)..(124): n is a, c, g, or t
  misc_feature (1080)..(1080): n is a, c, g, or t
aatgggccgcaaatgtcggaaaatggcccttaagaaatggnccgcaaatgtcgtggctccgttaaaagttattaaaaaacgatggcttttttaatcgaaaaaaaaatttcaaaaatgaaatatntaatttgttttggttttctatttaattttattcccaaccaggaatttcttacaataataaaaataggcggattcataccgtcaaattttaaaatgtaaaagtaaattgtttttacccttttcaaccgtcgcgttgcctccgtccgcgggcgccgcctcaaatgccgtggaacggacagtgatgaatttgacgggcgcactgcttttcacctattaaaattgtttctcaaaataattcaaaagcagcagccaatcgaaaaaatagtccgtccaaacacacccatttttggagacaaattttgtaagcggcaattttatgaaaattcaaaaaattcatgttttgcggtaaaaaaaaaaattttttttttcttggttaaattgaaaaaaatttgcgtttattcaaaatttgtcaatcaaaatgtgacaccttggcaattgcgttgcctgcgtaggtgggccgcaaaaatgtgtcatcgccaagcacggcactgatctgaaaaagttttatccgtaaatggttgcacattaaaaaaatttctcattgttggggtataggggagggaaattcaaaaaaaaaaaaatgttgtagaaatgcgaaaacagggtggaaaacaaaaaattttgcaccggaggagggccattaaacaacccagaatacaagggttcggtaccaaatagggattccgcccgacccgaacccaacgtacaacgtttttcagagccaaactttgttaggccgacccgaaacatggagttttcgacccgtgaaaatcccccctttttttggagtaacgaagatttcgaaccaagatgctgggcctggtgacaatgacacccgaattccgggctcttttccgacccccaaattttaaatgatttttttttttgcgcgcgcacattctacgcgattcgaacctcggacacgggtgacacgtcgcatagcgcggccgctcgcgngaccaccgagcgggcgaacgcgctggcacccgccagcacatgcgttgc

SEQ ID NO: 42748 - DNA, 770 bp, Heterodera glycines
atttaatggaatttttaccaagccaatgatattttaaaggactctttttaaaaaataacaggaaaaagcaagaaaatagcaaaaggcctagagaaattccacttgtaagttgtactgagtttgtggcaattcccatttaatggaatttttaccaagccaatgatattttaaaggactctttttaaaaaataacaggaaaaagcaagaaaatagcaaaaggcctagagaaattccacttgtaagttgtactgagtttgtggcaattcccatttaatggaatttttaccaagccaatgatattttaaaggactctttttaaaaaataacaggaaaaagcaagaaaatagcaaaaggcctagagaaattcctcttgtaagttgtactgagtttgtggcaattcccatttaatggaatttttaccaagccaatgatattttaaaggactctttttaaaaaataacaggaaaaagcaagaaaatagcaaaaggcctagagaaattcctcttgtaagttgtactgagtttgtggcaattcccatttaatggaatttttaccaagccaatgatattttaaaggactctttttaaaaaataacaggaaaaagcaagaaaatagcaaaaggcctagagaaattccacttgtaagttgtactgagtttgtggcaattcccatttaatggaatttttaccaagccaatgatattttaaaggactctttttaaaaaataacaggaaaagcaagaaaatagcaaaaggcctaaagaaattcct

SEQ ID NO: 42749 - DNA, 711 bp, Heterodera glycines
tgacagtctttcaatttgaattgcgaaacatttaataaggacatacatttttacaacttttataatttttttaaaggcggtgggacgatggacgtgtccattctgtggctgaacaatgccgtcttcgttactcaggcgatggcgggaaacaatcgcctcgggggacaggactttaacgagcgcatccaacggatgcttttgcaggcacttttgatcttttcaaattaaaaaaacaaaatgattgtttctttttagaaaattcgtgaaaaaacccgcaatgaactgacaaatcgagaggatgtgcaacaattgcggttggctgttgaggaggccaaattgcggctgaccgtaatgccggagactttgatcagtctcgattttcgctccattggccacttcgaatattttgtcggtcaaatggccaatttatttaaaatgatcgactgaccaatcccaattcattgcagttaacgcggcaagagtttgagcaccaaaacgtggatttgtttgccagcatcgttcagccaattcaggcggcgttggacgattgcgacattggtgcgcaggaagtcgatgaaattgtgctggtcggcggttccactcgaattccccgcatccgccaaatcgttggcactttcttcgggtttttactttctaacaataagtactttcaattccaatgttacacattttacaggaaatcgccaaatt

SEQ ID NO: 42750 - DNA, 1241 bp, Heterodera glycines
ttttggggtctctggatcacgaatctgacacaattttaatcaaatcctgtccctaaccctgaattcgaacaaaaagccgaaggttgaaaaattaaaattttcggaattttgttcgagtttgggttagggataagaattggagtgagattcgtagtcaggaccacacatgtccctggcaatttgtttaataaattcaaaaatatacattttgtaatcgtcgtttggtaaaatccaccattttagctattttttcgataaaacatggcataactttgctttaaagcaattaaattttacattcttggtaccattcgatagcccagctttttctctattagcttgcaaaatttcaataaattcaattaacttttcaaagttcttttttgccataatttaagttaaatttgataattttattttaaattttagctaaaatggcggattttacaaaacgcccaaggtgacggattttacgaagatggcctagagcaccctttgtaactagctcttaaaaaccttaaaaatctaaaatacatatttctttttttaacaattttttttatttttgctatccattcgttgtgccaatgtttccaatctgctgtccttcccatttgatagtcagccaaaatgagtgccaacatccacggacaaatgagggaggtcgaccaaaataaaatgcacctaaatacatatgagcaataataataataagatggcattttgggttgggaataagctgtgctaaaaatgccctttttattcggaagttttggaaattcacgggcacacaattggcacaattttttaatttcgatgcccccccccttcgtgaaaaagtaaacaaactttgcgttatttttctgttatgcctattttagacggcattgaattcattcaaactttcataatgaaattttttagggtatgtctttcaatttttaatctaaataatttaatttaatttaaaagaattatttttttaattttttgtgtaaattcaaaatgaaaattggtcatctattttttattttattttagctaaataaagtaactgaaaaattaaaaatttaattaatctatttgcaccaagtattcacctccccttaaacattaaaaagtttacaaaaaatttttttgaaaataaaaaaaattttccctctacatttttccaattttctacgtgaaatcggtggagcagaaaaaaaaacctgggaagaatattttgggaattttttttt

SEQ ID NO: 42751 - DNA, 863 bp, Heterodera glycines
  misc_feature (8)..(8): n is a, c, g, or t
ttaaaatntttttttcaaaaaattcactaattttttgaatcatattctgttaataaattgcattgaaagtttcaattttttccggtggcgtttatcggcacggcggacctttgaaatccataattttctttaaaaatttgctacagttttctgatcaaagtctgttaaaaaatcgcatgcaaatttttagtatcactttttaatctttggtttagatttttaaatttaacccttttaaaatatttgaaaattttctattgtacttggattttttcaaaatttccgagaaatttttgggcttcggaatgccatccctgttaggtacggaagaatgatgaattgaaattttatgcatgaattgatatgcgaataaattgacactcatccaattaattattttggttttttatgggtttttaattttctaaaactgaattactaattaagaacgagaatctcatacatatttttaaattatttttttaattatgcgtcgatttttatgagtgcacattcaaaaatttttttgactttttcataagaattttatataaatttataggcagaaattttttttttatactaggcattcgtatgcaaaaatcaacctaaaagaacagctcaaaaagagcaaataaatagccaaaacaaaaggggataaagctcaaaaagaacagcagctcaaagagcaaacaaataaatagccaaaacaaagggataaagcattcccaacaaataattaatcgtttcatttccttcctcaaatgatcacttcttcttcttctttcgcttatcattgctgggcccggcgggactcgaggacacttcttttgcatcgccacctaaattaagagcaatttgaa

SEQ ID NO: 42752 - DNA, 1079 bp, Heterodera glycines
  misc_feature (1023)..(1023): n is a, c, g, or t
  misc_feature (1026)..(1039): n is a, c, g, or t
tttccccttttatggtccattccgtcagtgctgaaccgtctgtgtcgagtggtggtactgctggagggtttccgcttaatgtggagccgtccgtctttggcgcggcaatgcccgcaacaaattccccacagtcatcaaatctggcggaaaaagcaacggactctctgctcaacgggctgcagaacactccggctgtgacttacgaggatttaactgtcgcgactgacggattcagtcccaacaaaatcgtcggcaggggcggctacggcgtggtctatcgcggagtgtggaaacacacgccggtgaagacacattctttcgcactgttggacacgtttttttcaggtggccatcaaacgaattcaggggaagtgcggaagtgacgaaagggtatgtaaagcagaaatgcagcagttagggttttagagaaaaatagcgaatcttccaaaataaaaaaagctgtggaaaacccaattaaactgttacattggaaatcccatttattgcagcagcaaagggagcgaattcgtcagagtttacaagaattgaagactttggcaaagtttcgacatgacaacgttctctcactgtacggttattcgctggacgggcccgagccttgccttgtgtaccaattcatgtccaatggtacgcttgaggaccgtttgctatgccgggtaacttacaacggaaaccatttgtaatttttgcgtttaaaaaatcgaattgactgctgctcattgtcagcatttcaatctttcctttttcgaatgggacggagccactcggttgggccaaaaagctgtccatttgcgggggcgtttgtcgcggcctgcactttctgcacaccatcaaccaaatgccaatcattcacggcgacgttaaatccgctaacattctgctggacaagcattttgagccaaaacttggcgattttgggctcagcagatacggacaggtgatctaaaaggacagttggtccacgaaaatggccaaatcccacagagtctgcgtatcaacggnggnnnnnnnnnnnnnncgcgacaagcggccgatgatcgcttctcatgtgaagggaa

SEQ ID NO: 42753 - DNA, 1127 bp, Heterodera glycines
ccccatttttcgcaccgtgaatgttatttttattgaactttgaaccggtttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcattgcttaacttgccagatcggacgggtgcgcatgactt

SEQ ID NO: 42754 - DNA, 59 bp, Heterodera glycines
gaaaacaatgccgctaaatgtgtgggttgaaaagcaaaaatcctgtcagaaaattacaa

SEQ ID NO: 42755 - DNA, 1291 bp, Heterodera glycines
acaaaatttatgccaaaaacagcgatcagcaaagtgatcagagagttcagttggaatagtgccaaaaacaaggaatccaaggcgaacagcacattacaagtgttgtaaagctttctgaaatatattagaatattttagggatgctcaaaatctcgtagtctcgtttagaggatttatcagggttttggtcttggtctcgactctcgggggctaaccattgccaacattttgagtatttttaaacttcggaactttgccattgctcaattactcgccaatgttatcttttcaatacaattgaagcgattaatggcagatttccgcgtcattcctgctggctttttcgctaccagttctactactgtactcgcttacttcgactttacggtagtggcaaccaaaatggcattgaacagaatgccaaccgatgagagtgcacactttccacccataatcagccacatggtcaatgtgtgttggttttgatggaacagttcaatataagttaattgctggttttgtggcgattcggttgcatttaacggcattatctttggcgattcggtttcatttaacggcatcatcatcattaaaaataatatttaattttttaaagagagaaataaagaggggtgaaaatgtcgtcgaatttaaaaaatggatcgttcaccacggcaatggcctttatccgggaatgtcccctccaagggttgttttggttattaattaattattagtagagtgttcattttgcagcatatgattgctaacttggggcgtgctaataagcatgaaaaactcatttctaacttggtttgaggcttctaaggtccaactttttctgctgattttttgattaaattggtatgctgagcatgtaacttttgtgctggatttagcattttagtgcttattttgtgctataatgacaaatttgactaaaacaccgtctgccgcaatttagaaaaatttataaattttgaaaatttaattagtgatgtgcttttgcatatttaaaaaaggttaatttttcatttgttaatgaatgtcattatgttgaaatagtattccgtttttctttctttttttaatgagattttgaatgtgatgaattgcaatgttacatagtacatttctcagttcacttaaattatcaaatttgttgcctgccaattaaaaaagtctgccactcatcatctttttaatgggacgctaaggtatcccttacctaaaagaaaaattcaaggcacaaataaagggccaaattggtttcatgtatacaaaatattaa

SEQ ID NO: 42756 - DNA, 917 bp, Heterodera glycines
ctttcctcgccccctgctgccgtaaaacagtcgactctttccggctggtaaagttgaaatcggaccaatttccaaacgaccttaattaaattggcttacaattagcccattaattggtcaatttgctttggttgacctgcattttgctgtaccgccttcggttgctgctcattttggcctccactttggtcagccaaatgcaatacagcgactgcaacacgagcataagtgccaatgccatccaagtggacagtccgtagggggagaaggtgttccacatgcgactggagaagtccatgacgcgggcgtgcaccaaaaagaacagtttggtctgctcaaaactccgtttcattcccttttattcagtcaattccctacgctggtcactgggtaactgaatgagaagtatttcgcccgtttgtccgtgtattggaagaattggcacaccgtgtcgacacttccgttgtaaatcatgccgaaaacgccgtcccatgtgccatttgtctgcgattagtgcgagttatgccatgtccactaatcagcccccccccccgtcggcatttacaaattttccccaattgacgtgaccggccacatttttataatcgaccggctcaattttcaagcgcataaattcggccaaaaagccaatgacctgaaaatgtcaaaacacataagtaaattcagcatttgattatgaatggacctccgcgcaccacccggggaaagggcatgccaaagtcggacgcaaagtcggaaacttccggcaattgtcaaaagcctcgggcggagttcgggtgaaaagcacacggagttttctgctttgctgatttgaatagtcaatcatgacaaaataagaggacaaacagcttaaatgataagtgctatttgttagaaaaagcacgaaaaattggcac

SEQ ID NO: 42757 - DNA, 908 bp, Heterodera glycines
ttgttcaccaaaataatttaatttaaattaaaatttaaattaaaaatttttatttattattaataatacaaaacaaattaattaaaaaatgtaaaagtaagcaaaaaatgcacagaaaaataatgtacaccggccggattcgaacctgccacccccccccccccagaagatgactcagaatccccaatcacacagggattctgagggcttaacgatgtcaaaagtaaaatctgatcacgtattcgtgatcagcaacctcaaatagccctaatgacatgtttttggaagatttttgtcgaaaaaattttttcactcaaaaatcctggtcacccccctttggtcccgaatcccaaaatcacttttatttttatatctttttttaaaaatgtgataaaaatgtaaaataaaatttatattatagaggaaaaaattgcggatttttgtagtattttatatttccagaatatctttttagaaccgagttctaaatttttttctgaaaattcgaatttttccagaaattctggaataacttttttccttttttagatagaaattcgaaataaagtccataaaattctcctgatttttctctatttttaagcctttattcctgtaaaattgatcaacccttcgatttgttatgaatttttaaatattaggccaaaatcccgagggccaaaaaattgccaaaaaataaaaaatttttaaaaaattccaaaaattctgaaacttaaaatagacatcatattcgtactcagcaccttattttaccccagaaaaatatttttcacccccattttcgtccgaaaaaaaatttccgaaaatttctagggggcctagctcgaaaatttttgaaaatttacatcatgtagtacaccgttcgatagagcttaaaagctctacaa

SEQ ID NO: 42758 - DNA, 922 bp, Heterodera glycines
atttgttctccaaatcgtttcttccaaattcttatgctatttctatcaattttcaatatttttgcaatttccgtgtcactcatttttggattttcactttttatttcccaataaattttcattttttcaattttttgttcatctgttattcttttacagcgaattccgagttgtttcttccaattttcaattgttctatagctaactctgatttccttacgaatttcttcataattttgttgccattctttggatgaatattgccttttttgcttatattcatttatcatttcaataaaattctgtacaatttctaatttttcttcatcagtttttgatttgtaacatttttgttggttaagtcctaattctctaatccatttgtaaatatatttgcgatttgtccctaatttcttcactatttttgaatttattttattccattcttttgttgaatattttcttcctttttgctttattttttcttttattttataatattttgcaattatttctctttttttgagttcatttcgtttttcttcttctttttcttgccatttttctccaaatatttcgccaaatgacttttgttgcaattttttcttttctgatccaattttgacaattaaaaataatataattaataatagtagcggaaataatttcattttgtcgtctcgaaatgattttattttatttttcttcaattaaatgacaattcattttttgaggcatttaaatgatttttttctgattaaaaaactgaataaatcattattttacttaataaaataaggaaatcctgtttaatttcaaagaaataataataataattttatcttaatgacaaaaaaattgccaattggtaaattaatgaaagaataaaattttattactttctactggcgctcattcgaaa

SEQ ID NO: 42759 - DNA, 985 bp, Heterodera glycines
cccccccccccctatcccaatcttctcgcatggcttttgcttttgaccccccccccattcccccgcagtgctctggccgcatccccaagctctaccctgtcgcatttggcacataagaagcggctaagaaggggggggggaagagcatttttccgccttcctttatctattagcagcacaccccgtccgttctatcgttgaagggcggcgtggtaagcatttttttccgcttcaggcaaaatccttaatggatggtttttttttgttgctcgaggcgatttcataaaactatgcttttcgcgtcaccgccatttcttgcctattcccagcagtttctttctcaaagaagcgccattcatttttcgttttcgcagatgcatagtttgaagagtatgagatggggcaggggatggaagcggaacccatctggtgctgattttctctcttttctgtccaaactcaattaaagccccttttttgaggtttgtagctcatttgtcagtggccaaagttgcaccgccgcattcatggagaaaattaggattttttataaattgattatgtttagcgttggtctaataaagattagatagactttgatcttatttttacaataagatatgcttgcaagtgtctgtcacaaggccaaatgcgttggttcgaaaatgaacaataaacgaattgccaaaaatgccattaggcataggcatcattggacaaaaaaagatgctttataagcattcgaatagataaatttggacagaggcttgaaagaaaaagaatgacagtgaatgggcaaaggttaaaattaaaaaaaacaatggggaaaacagttatttaatgaaaaaaaaattctactgtccataagattaaaaaaaataataatttaaaacataaaattaataatgaataaaataattaatgaataatgagtaaagcaaagaggaaggtgaaaaaaagaccgcaagcgaggtgaaaataggca

SEQ ID NO: 42760 - DNA, 945 bp, Heterodera glycines
ggctgtcaaaaattttaaaagacagcctgagtgatcttttcttaatataattgtcagcactaataaatctaccaattcatgctaaagaaatgccaaaataataatgaaaataaaattttcacattctaaaataaatctctcaagagcctttttagaggcaaagcagtctaaattttcaatgagttcaattatagaacaaaaaattataaaaaattttgaatggctgtcaaaaattttaaaagacagcctgagtgattcctacttaatataattgtcagcactaataaatctaccaatccatgctaaagaaatgccaaaataataatgtaaataaaattttcacattctaaaataaatctctcaagagcctttttagaggcaaagcagtctaaattttcaatgagttcaattatagaacaaaaaattataaaaaaattttgaatggctgtcaaaaattttaaaagacagcctgagtgatttctacttaatataattgtcagcactaataaatctaccaattcatgctaaagaaatgccaaaataataatgaaaataaaattttcacattttaaaataaatctctcaatagcctttttagaggcaaagcagtctaaattttcaatgagttcaattatagaacaaaaaattataaaaaatttttgaatggctgtcaaaaactttaaaagacagcctgagtgatttctacttaatataattgtcagcactaataaatctaccaattcatgctaaagaaatgccgaaataataatgaaaataaaattttcacattctaaaataaatctctcaatagcttttttagaggcaaagcagtctaaattttcaatgagttcaattatagaacaaaaaattataaaaaatttttgaatgtctgtcaaaactttaaagacagcctgagtgattctacttaatataattgtcagcact

SEQ ID NO: 42761 - DNA, 1161 bp, Heterodera glycines
  misc_feature (23)..(23): n is a, c, g, or t
  misc_feature (103)..(103): n is a, c, g, or t
accaattaacgcttttttctccncatggcacagcatccaatttatttatgggccgatgacgtgccttctgaacaaggaaaaatcggtgagtaaatgacacttngataatatcgcaaaatcttctaataaactgttgtgtccccgggtttaaggctttcagccatttcaaattaccgttttaggagagaggaatttattataaggaaaagcattgacaattaattatgaattgaaaaccgggaatatgtttgggtcaacaacaacctcagagcattttgggtgggtcagtgcaattggttatttgggaaaggattgccaaaggcaagaaatggcacagactgactcaccgcagacatctcgcagcccccgagggggaaattgagtggacttatatactggcacaatgggtatggactttggataggatgaggggtatgacggcataaacacaggaataagagagaaagggatggcatatgcaacagaggtgaatgggatagaaacggcacgataaatgagagggacaggattggcttgagattggatgaacagacggacaagtttatgacgggattgggtcgaggaatagggcaatttacattatgcacaaaatatggaaatttgaatgctgcggatacagcataaatggggcaaaattcgccaatatcatttgttttttcagtttcgatcgattagctgtccatttcgattccattcaatgccagcggtgacatcaaaataaattttaaataattaatttattactttactacatataatactttgattgtttttacttaatttattttatgacctctctgctgctttttgtacacagggctcacaacaaattttaaaaaaaattataataacaaaaggatggccaaatccaaatcgagtatcatgctaataaattttgttcaaaaatagacaatttacgaatttttcaattaaatttttaaaattcattactaaattaaagacattttgtgagcctttttttacattttttcatatatatgtattttgcatatcaaataaatttcattatttctttttttgtttatttcaccttattcaggacaagcatcaaattgaataaaaattgagttctaaaagtataaaatcaagttaaaatagagaaaaaaagaaaattaaaaa

SEQ ID NO: 42762 - DNA, 931 bp, Heterodera glycines
ttaatgtcaaaatgcccgacactagcgcatttctttagacaacgaaaattaattcctgaggaatttcccaatgccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaaaaacgctaatcatcagaatcatcttaattttccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttccttagtactttccaagaaccatgagaataaatatcgcactagcgccaaaatcgaacaagaacgctaatcatcagaatcatcttaattttcccccagtgatttgtgagtgataagaaaatagaagaaattcagggattaattcctgaggaatttccaaggaccacgtccatcattgctacaacggtgccttaatggcattttaatgtcaaaatgcccgacactagcgcatttctttagacaacgaaaattaattcctgaggaatttcccaaagccatgcgagctttgttagaccgatgccgaaatggccaatataattggaaaaggacagacaacaatgcttttcttatatcagctgatgttttat

SEQ ID NO: 42763 - DNA, 1091 bp, Heterodera glycines
atgccggccaagacgaccatgtccattggcaccattgtggacggactgatggaggcggccattgtcgggcacaaacgctacactggcgaagtgatgaacggtgggcaaattggggggggggaattgttattttccaaaatcataagtataatgacaaggataattcctcgggtacctttatttccaccccgagtcgttttcctctccaatttttttttaattttcaaacacaaatgttcaaaaaaaaataaaaatctatagctatttttatgatgaattgctatactagcaattagtttttccaaaaattttttcaaaaacttgaaattttcttttaaataaattttttgttttaattagattttttaaaaaaattttttttggggggggggatgcgtacggctggaggccgagaaattcaagcgagtgcatgttcacatttcgtacacgtatctgaaaaatggtcgatgaaggttatctggcaactggacactctgatcattgatgtattcagatcagcgggactgatcgaattctttcattaaaaacatgaacaccctgataagctcggaattagatcagcgagacttatcgattttcacatgtttatcttggcattcaatttggggattgcttcatgtcagataacaattaattaattgccgggtcccgctctgatcagacatttattagtacctaccgtcatcagcgggtacaatcggccgttacagcgtgctgtaacgtacagtagcgtctcattgaccgtagacggatagtcggggaagtgtacgaccggcggggacagagcggtgatcactaaaaattggccactggaccgcttctccagcgccagctgcgtgtccaagtcgacgtcctacaataatttttggccattttaatggagcacggctttctcagtgtcgtactcatttcgggacaataccatttccgtaatgcacagttacggtaacgcacagcaaggcgaagggtatggaatttttcatgggcctaatctcatcaccagggctgtcaaaaatatgcgcataaatatgcaaataaagtcgtgaaatatgcaccaaatatgaacaaaa

SEQ ID NO: 42764 - DNA, 1028 bp, Heterodera glycines
gatgtccggggctgcacgcgcgctacactgcaaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcacaaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggttggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgaggcttaagactcaatgagtgtcagctcgggcaccgccagctttttctttttttttcattatttttttttacacttctgttgaagaatgaattctagtcttatcggtggatcactcggctcgtggatcgatgaagaacgcaaacgactgcgataattagtgcgaactgcagaaaccttgaa

SEQ ID NO: 42765 - DNA, 1077 bp, Heterodera glycines
  misc_feature (36)..(36): n is a, c, g, or t
  misc_feature (42)..(43): n is a, c, g, or t
  misc_feature (69)..(69): n is a, c, g, or t
  misc_feature (108)..(108): n is a, c, g, or t
  misc_feature (114)..(114): n is a, c, g, or t
agtttttctttttctcattttttatacttggaaatngggttnntagtgcgaaattaaaagagcgatttntcgtaataaatttatattttgaccgcttttaaaattttntcgttnttgtcgatattctataagttattttttataaattcgcaacttaccaacataatatagatagaaatctattaattaataaggggttttattttctataattaaatttacatattcattcaacaactgtttggcatataccccacccccgcatatgccaaacagttgtttgtcatacgtcaaagcccccatttatgaataaaattatagaaaagatattatgtggtgccaacaaaatgtatggcatttgacacatatcattttcccctttttctctgccataatcttcatttaacatactgtctattctacattgtcttcgtatcttttccgctatcctttatacaaatactattttcatacctaccccatattctcatatgactttccatattagaacagattgtgaatatgaaaaaattattattatttattgttaggggaatagtgactgagaacccattactaatgaaattttcatttttccattatttatcaaaaagtagcctcgggttcccagtcaatttttttgtataaagattaaaaaattttttatagaaaatggtaaatatttcaataaatattggttctatttttttctttgcttttgccacaagcttatgtggaggcaagccaaatgatgacaaaaatgctgcctacagctcaagtgtgccaagcgaaacggaaaatcccaaaaacgaagagtcgaaaaagaatttggtgataattacggacatgggggcggatgatcaatttacactggagatgatcagcgcaaccgaattggccggtaaagtgttggcaattgggacgacggagaaaggaagaaaagcggcattgtcacaatcactgggatttgagaaagtgccagtgtatgtgagaagcagtggcgaggaattcgagaaaatgctttttatgaatcccaaagcagagtaggttcagtttgcaagttgaaacgtatgtcgg

SEQ ID NO: 42766 - DNA, 1334 bp, Heterodera glycines
tttgcatccaaaattttttttttttacattttttaagcttttttatttaagcaaataaatttcggggttaaatgtattttttaaatcagatttatggtagattgaacaaacctataaattggtttaaagccgtattgagtgcaaaaatggtcgattttttcgatttaaaaaattataacttggcttaagaacatttgaatgcagttttttgcatcttgtagagaattgagtatagaatctcatattttgttcccatttttccaaaaaaaaatttaaaaatttagaaatgacatatttttaactgaatttttccaaaaaatgttgaaatatgtaggtcaactgtgatttcgaagcggtgaaatagaattgtagaataaaaatttagggaacaattattttatcttaagactattcgtaaacattttctttttaaaatgtagaaaattttgaataaattaagtattattgatttccttgaaagcccataatttatgaattaactgaaaatctctcttttttaaaccaatttagctaatttcttggtcaaatacgttaataaatcgcaaatatttaaaagtgcacaagcctcgcctatcatcaaaaattaaaggaaacctgttaaaacaaaggaaaaaagttaaatagaacaaaataaccgacactttgttggaaaatgtaaattgatatgcaaaatatttaaaaaaaggtttgaaaaaattaattaattgcttagaaacacctaaaaatatctaattaataataataatgtatttttaaattaatttaatctttttttgaaaatttaaaaaaacatcggtcacttgaaataataaattctaaaattttgtccaggaaaatccaggttttccgtgttttgcctggacctggatttttttttcacattggacctggacctggatttcctggacaaaaatccaggaaaatccaggtcaggaaaaatccaggttgccgaaaaatgacctggacctggacctggatccaggaaaaatccaggcctggatccaggtccaggccgatctctagtgaaaatagttcagggcaatgccgaaggactttcccacggcgcccttctcaaattcagttttggatattttataaatattaaagcttaatttatcacaatcatgattaattatgatacaaatgaatcgaacattttattcttcaataaaataaagaaatcaaaatagtaaggaatttatatcaaaaaatattttttattcagaaagtagtaataatagagaccgaatttatggatttttcataattgataaattttagaatagatgttttatatttcggctattgatatt

SEQ ID NO: 42767 - DNA, 1040 bp, Heterodera glycines
aatgtggcgatagagtacatggggttgttattaccatggtaattgcgtagtgaggggccgagttaagctttaaaatttctcaggttgccccaaatgctatccaaacgaacgtcagcgccatttggctggtggaaggactgctgaagagctgtatgagcagacacagcggcgtttatgggagttggagcacacgcatgggcttgaactccatgttatatggggttgtgagttgaagaaaaatttgcgcacaaatccgatgcttcggcaactatacaatgatgcgtttgtccctcgcccgctggatccacgtgaagatgccctacgtggaggtcgcacagagccatttacactgcagcacgtttgcacccaaaacgaggaaatcattctcatcgacattgtaagtggatggtacattatgctttttaagatgtattacgttttgaggtgagcctttacccctatgtgatgaaagcatttgagtttccggttggaaatccacatgtaataacgcgagaggttctcttatgtcctccaacggcccaaaccctggcaaaattcaaattgcaacacttttcgcggacttttgtttgtttgtgttttaccaccaaatccggatgttcgccctctacgaattcctctgcttccgtaccggaccaatgatggacgactgacttttcctctctgtgcacgatgcgctgattttcgccaacagcgcccatgcacacacacggaccgtttacgctcatggaactcagcgtatgctgtttttttctttaaagtctatgtcaaaaaattcaggtatactcatgtcgaattgaacaaagcactcgaacttggatacacagtcacggatctatttgaagtaatctaatcaaatgaagatatatttcatcaaaaaaaaaaaggtttggcattatgatgcttgggatggtgaaatgtttcgtggatacatgaaaacatttgtcggtatgaaagttcaagcgagtgggtggcctgcggactgtgaaaatgagcaacaacgggctgagtacattgttgat

SEQ ID NO: 42768 - DNA, 1339 bp, Heterodera glycines
cagtcgttcaacttcctcaattttggcctttgtcagtttgtcaaaaacttcctcgtccaattcgtctaaatggtcggctattttccctgcctgaatattaaaattttgtaatggtccataggagtaaaaaccctcgaaaaacgtacttttatgtcgtgttcattcatttccctcaaacgttgctgaaatttcggctgactttcaaggatttggacgaccaattccaaatattttgagtagtgaaagtcgtatagattctaaaatttaacataatccatcaaacaaatacaaataaattggttactttgtccggttcttcttcttccacccgattttcgttatcattcgctttattctcatgttgaaattccgtcttctgtcttttagctggcggaggagggcaagaaaccaaggaaaaagaaaacaaataaaatgggaggaagaaaaggagggattttagaagcaccattttatccgcaaaatgggagaaaaggaaaatttaatgctgatgctgcaaaatcaccaaaaataaaacggtactaatgtcgtttacagaccataaaaaaatagttttaataaatcatacatttaaacatttctagggggttttcggggtcgctgatcacgaatctgacagtctgtaaacaacataagtaccaataaaacaataattttcatttctaaaaaaaaatatttttttttaattttcaagcaaatattaaaattaaattacctatgtattaaactactaaaaactaaacctgattccgtacccttaaaaattccgtacagggtccggtccgacgccgggcactagcactttacttggatttttagcaaattttaaaaatttgtctatttttcatttttcgaaaagcccggatttctatccgacaataagccctagcaccataaaatactaattttccaaaaagaatcgcaattatactgtccattatacataatttctttttaggcgtttattggactttcttttatcattatggacatggacaaaatactcagtgatatgcgacagcacatatcgaatttgcaagacaaacttcacgtggcaaattctgccgttagcaaaggacaaattgtcaatgagaaaatcacactaatgaaggaggtacattttcatttttgacaacccttcaattagctccaaattgccctggtcatccatactaatcattcccagactaattaagttaatcattttataattattttcagtatcaagacaaaatcgcatcattgaactcgtgctggagagccaagaatagaaacgcattagtgcacaattttgcacaggaaagtcgccaaatcattgcac

SEQ ID NO: 42769 - DNA, 1208 bp, Heterodera glycines
tattttatgtggcatcattcttcgtcacttcacatcattgccccattattttccaaagatgctaattgcttcttaaatgcgcaatttgtaataaatcggaaataattagctgaataattacacattagcactgtctttacgtgaataaattgaatgccttttgtttcattcttaaaatgactgctctttttgctaaggcacaaatttttgtttgactaatatattctattgaaattccaattctttttcttttcataggtataaaaatgattcatttttactaattgattctttttatatacttattcactcattcgaattaatataattttaccaaaattcaatgaaaaagtacaaatttgcaaacctaaaactttcttaaaaatatcgactcgaaaataaaaagatttgaaatgtacaaaatttaaaaaaagtagttttcaaataatgcacttttgttattagaaacattgccacatcactgagattcgctaggaaacctaattatcatttattatcatttcaattaacatgcataaatttaagacgagctttttcctcgtcagaaatcattctaataaaaattcttcaaattcgaaaattgttaatcgtatttttgaaaaatgtttatatttataaaagcacgaataatctgaatttagcagacattcttaattaagtcagctgtcacaaacagcatttgtttgtttgtttttgctgcattttttacacatatattttttagttggacgcctgaaattagcattttgccataaaatccaatttaaaaaattgtttaatggagactgataaagacacacatatgcatttttatattataatgaatataatattcactaaataattttatttaaggaaatttctttataatttttaatttgaattaataattctatttattaaataaattaaatataaattttaaaaataaattttcataaataaatttaacagttaaataaaatgaaaaattttagttgaaataatgataataaaataatttttatgaataaataaatattttttattttttaaataattgaataataaaaaaatttaaaaaaaaattatcgttttcaaaaaacaatttgctctttcttttgcagcttcctctcttacgccattactttttgccagttcatttacatttgtagagtggcatttgctaattgccccattcattcgcc

SEQ ID NO: 42770 - DNA, 1230 bp, Heterodera glycines
atccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttactgacacctgcgttacgctttgacagatgtaccgccccagtcaaactccccgcctgacactgtcatcggagcgtgtcgccgggccaccgcgtgtgccgacttatgacccaaatgggcaccctttcgggcgcactcccgttttaccgattaggtatagaatccatgaaagcacatgatatttcactggggccttgtcgttcccacttatgctacacctctcatgattcttcgcaaagtcggactatagccgagctcaataggttcttctttccccgctagatttgccaaggccgttcccttggctgaggtttactctagatagtatataggtgccgtggaaatctcgatgattcattcgtgcgcgtcggtagtgagacgacgaagtatttggctaccttaagagagtcagaggtactcccgccgtttacccgcgcttaatcaagtgtccttggcttactcttccgagcactgctcagaaatc

SEQ ID NO: 42771 - DNA, 1071 bp, Heterodera glycines
tacagcaacggcggcacttgcatccgatgcagctgccttgggctctctaaacctatttttattttttttctatctcttctctgaatggagttataacaatttttcacaacagttttgcatttaacagacacattctaaaatttctaattagtatagtagtccaagcctattattatttttttgacttgtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaaattctaattagtatggtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaccctatttttatttttttctatctcttctctgaaaggagttataacaatttttcacaacagttttgcatttaacagacacattctaaaatttctaattagtatggtagtccaagcctattattattttttttgactagtctctgaatggggttatcccagttttagtatcctttttgaaaaacaaaaattttaataactgatacggtagcccacatccattgccccatgtacccttcggtttgttcacgggagctaacaattgatg

SEQ ID NO: 42772 - DNA, 1073 bp, Heterodera glycines
acattgtaatgcatttaaaaaaattagaacatttagatttattaatttcttttctggataggaactcgagaaccaccgacacccaaaaaacgaaagaatctcgggcaagtcataattcttatttgattacatgtcaaatagcgcttttatgagtttgctacccagcctaaaaaatttcaaatatctttaaatctcaagtttgcatgagtttaattttaattttgaatttataaaagtttaaacaattatttttaaagcttttgttgtcttaccaattccctcccataaaacgagctttttgtttggcgatttttaagatttggttggattttcgcttaaaaagctcgccattcgcataacttttaatccccgctttttcctttcattctttcctctctcttttgttccttctcttccccttttccttttcttctttcactttccaccgattattttttgtctctatttcctttttctttattcaaataaaataaaacccaaaagagggataaaagccgcttatataataatttgcatataaaatttaggtgcattcctaaaaagtgcaaaaattggcgattcctaaaaaagtgcaaccaaaaaactgatttttcctatgattttttattttaattataaatatgttaaaatttaattaaattaatgcttaattacacattcttctaaaagacttttagatctcgaataaaaataataaagtttacctaatattaaataaaagcattagccagattactttgaatttttaaaatactttaagtcaattccaaatggactaaaattaaaaaataaatcaaattaaagaaaatatggaaatatttatatggaatgtatccgcttcaactcaagctaaattgcttgggcctaggcctcttttaggctttattttcgaaaatttatagatgccattgaaactttaaaatatttaaaaaattcaaagtaatctggttaatgattttatttaatattaagaaattttaattattttttattcaaaatccaacaaaatttaagatgtatttaagcatcaatttaattaaattttaacatat

SEQ ID NO: 42773 - DNA, 806 bp, Heterodera glycines
ggagagactatggatttttgggagactgacgacggaaaatgggggagggggggggaggggagggcaccgccgccagcacccattggttgtgtttggttggtgtgttgttgggcgaggcggacgacggacggtcgttggtcattttcacagtgtgtgcactgctgctcattgtgttgtcctccccctcgtggacaggtcgagactctcgagtcgtatttcgcgagaaaatctcttctttctgacggcctcgactcttgggcttatgttcgagttgtccaacgtgcccgcgctccttgatctgattgaattagacttctcgagaattgtcctggtaaaacctcggctctctagagaaaaatctcgaaattatgcgctcggtctcgttcgaatctcatcattatatgaaatctcgaccttaccgttcccgtgttatttgatgaagcaaattctagagaaatcaggtagttaaaccccattttatatattttcttatagttattacattttaaatgtcgttttttgctgttcagtgttcctattttaggctttataaaattggagagtgttttccttttttccgccagtatttgtcagtcacaagtcactgtgacttcttctgcgtcggatcatttgagtcgctctatcctgcattttcttcaacgattttcgcgctttcttgcccctttatacactaataatattggccatttcaacattggcttttttaaaaacgaaaccaaaaataagcgattaaatcttgggacttgcgatgagtagggctaatcatcacacaaaataataattaa

SEQ ID NO: 42774 - DNA, 1351 bp, Heterodera glycines
  misc_feature (189)..(189): n is a, c, g, or t
aattaataataataatgtgttttaaacttatttaatcttttttgaaaacttgaaaaaacatcggtcacttaaaaaaataaattctaaaattttgtccaggaaaatccaggttttttcctgtcttgcctggacctggatttttttcacacttgacctgcacctggatttcctggacaaaaatcccagganaatccaggtccaggaaaaatggcgggaggcggagtgatgtttgctgcgttagttcgcttcatgtcgaataagtagaaaagaataattgtttttttgcgatcttaattggactactacgtgtcgaaatgatttcctgcgatttatttataaaacatattttcaaagaaaaacaaacaaacttatcaaaaatagatataaaagcttattaacaattttataaaattaagatatcaagaaaatagtaactatcataataaatgataaacaaattaaaaaaagagagatgtacaaacaataatattaaataagccatgtgggtggagcagaaagcagactaaattctaatgcacttacaaaggaaggtccccaggtgtccgtgggatttccaaatgaaacttggttaggtgggtagagcacccatggtttcttaagaaaaatatttttattttctgcgaaatgaatctgagtgccgagttatgacgtgccaaagtttttaattttttctaattaaagaaaaggaacaattattttgttcactcaaaagcatctgatggtgcagaggtagtgtgttaggaaaatttttttgtgtcccaggttcgaatgcgttctaatacattttacaatttttacttttgcttttttatcgtaaagtcatttataaaaagaatttttaatgaaataaaatctttatttttaattttatttaattaaaaaaattcattaaaaataatggtgcaataaatatcctttcagttaaaaacaaattaattttgtctaaaactttatgagtaatttatttgtcaaaatggataaaaaaaataagattttaaatcaaaaaaatttttttgtgataatgataattgactttggcataaaaagcaaaaataaaaattaaaaaatgaaaaatgaaaatgcatgtgcgagatccgaacctgggtccagaaaacactgaatagcgcactaccgctgcaccactgaacactgcagaggtgtcaaacaattttttaatttgtttattcattaaaaaactttggcacgtcataactcggcattcgtgctcatttcgcagaaaataaaaacatttttcttaagaacccagggatgctctatccacccaccaatttcattgggaaatcccacggacacctggggaccttccttt

SEQ ID NO: 42775 - DNA, 1083 bp, Heterodera glycines
aaaaatgattttcggggccgtttggaggtatatggggggtatggacgggtcaaaaaaaatggctatctctttttttggcaatctggtaatagaatctcttggaaacaatgacagtggctgtcatcagtgttatgctctaaaaatgatttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtgcctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctgataagagaaatctctttggaaacaatgacagtggctgtcatca

SEQ ID NO: 42776 - DNA, 671 bp, Heterodera glycines
taggcacaaaaataggcaaataaattcttattaaacgctttttcggtagcaaaccacgtaaaaacttaatcaaacaacttaattttacttatacttcaattgttttaaagtttttcgaataaagacaatttttaaacaaaaatttttatcaagaaaaaataataaattttggggatacatttttgtgaaaaaatttttcaattcttagaaaggcgacaaaaatggcgaaatatgcataaaaataggcattcaggcattaagcacaaaatgtccaaaataggcaaagtactaggaattcaaaatgcttatcttttgcatagaaatatctccttttaaaatccttaaagatagcaaaattgttcgatttagtgcagggatgtgatcaaaaaattttcaaaataagaacattaaggccaaaaaataagattttagtgtcaaaaataagaacattttgcaaaattgcttcaaatcgttatttttacaatttttcgatcaaaaatgtatcaaatagtatatttttgtctcccattaacgcgattttaacaattttgggggaggaaattagcaaatcataaaattttagtgcattcgggataaaaaaaatcagatttttaacaattttttgcggcgcatttttccaaaaacttttgggaggagagaggggggggggg

SEQ ID NO: 42777 - DNA, 503 bp, Heterodera glycines
  misc_feature (66)..(66): n is a, c, g, or t
cgatactaattgttctggaatttgtttctcggcgcgctctcatagatctatatttggaaaattggntatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgataattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgata

SEQ ID NO: 42778 - DNA, 1240 bp, Heterodera glycines
  misc_feature (31)..(31): n is a, c, g, or t
tagagaaaataatttgaagagagagtgctantgggaagagaattcccttcccttcttcgctgaatcttttggtaagagacgcagattcctcactatgttctctgttctctctctgtcataaatctcttcccataacactcttttttaattaatttttctttattcttcttcatcaaaaatgttttgtctgaccagtactgaaagttcagcactctctcattttgccttatctctcacccaaatgttatttctcgataaaagtcattttttaaaaattgctttaaattttcaaaaaatgatacaaattttaaaaattacgttgatatttaagttgatggcgtaatgtttgttgatttaaataaatatcaacattgaggttgattctccgcaaaaaaaatatttctaagtgaaaaatgttgatttgccattctctagtcctctactcattttttgtcggtccgtattctttcacttaaaaattcttaattgtttctctttttcgattttttcattaagtttttgaaattttttaattttttatcatttatttagctaaatttattctgccattatttaagtttgaagtgttatgattgtccatgtagctgatttgtttgtgacctagtcgccaaaaataggttgaataatttttggaatattttctttttctaatttttatttttaataattatttacttgtggttgttataggagaataatataaatttatttttatggtgtttttgaaaccgttttgtgtaattttttactacattagtataaataattagtttatttatttatttagttaattttgtggtttcaaaacaacaattaaacctttttgttatgaaactatttttatagcatttcaatattgtttaagctgaattttagtgaattatatttattaaatttatttattgtctaaaatgtttatttattgaaataaagtgttatcaaatcacttcaattttatttattgaataattatttcattcacttttttctcttaattcaggatccttacagaaggtattttttttaattacataaataaattgttcttaataaatccaaaccaataaatgttctgatacttggaaatatttcgacaaaatcttcaaatgataaagcataatttcttcttcattgccgtccaccaaagacttcgaattttgcgccaaattttcccaattcttaaaatttttggcgcggaaacgcaaaaagtaaaagtttt

SEQ ID NO: 42779 - DNA, 1037 bp, Heterodera glycines
agtttcatcgaacctagcgcactaaaatcgataaaatctctccacaattttgcaggccttctccattgtaaaggactatcttaacctgaaaaaatgccaacgcttgttgtttttaaaattttcgaaattctgactttttcattaattatttattattttgcaaaattaattcataaatattttttagaacgtgctctgaaacgcaccaaatgttaattaaaagttaaataaggctctctgaagctttttctatcaaaagggagatgaataaaatttttaaaaatttttaattcctttttaaacaggccaaaaagtttaggcttatattttaaaaagtttcatcgaacctagcgcactaaaatcgataaaatctctccaaattttgcaggccttctccattgtaaaggactaacttctgaaaaaatgccaacgcttgttgtttttaaaatttttcgaaattctgactttttcattaattatttattattttgcaaaattaattcataaatattttttagaacgtgttctgaaacgcaccaaatgttaattaaaagttaaataaggctctctgatgctttttctatcaaagggagatgaataaaatttttaaaaatttttaattcctttttaaacaggccaaaaagtaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttagaacgtgctctgaaacgcaccaaatgttaattaaaagttaaataaggctctctgatgctttttctatcaaagggagatgaataaaatttttaaaaatttttaattcctttttaaacaggccaaaaagtaaaaagtttcatcgaacctagcgcactaaaatcgatataatctctcccaaattttgcaggccttctcccattgta

SEQ ID NO: 42780 - DNA, 1019 bp, Heterodera glycines
aaaccgaaaccgaaaaaaagctaaaaactcaaaaatttctcggtcggttttttcggtcaaaaaccgaaaaaaagctgacctgtccgatctctagtttttatggcatatttgagggatttttaatgcatatttggcattttttagtgaataaacttcaaaccctaattataatacataaagcaaatcgccagctctgtggtcgaaagtcgatttggcgtaaagattgaaaaagccattttcccattagccaaactcaaatttcagtgtttatccactggggatggaaagggataagccggcagtattttttagtcaatttttaaacaaatcatttctggcgactttttgccttcattttgcccgcctttggcggagacaatggcctgaattaagggcaattaaaattgattattatagcaaaaactaatgccacacacccaaattcataagggcagcggacggtcgggcaatggaaatccctcagatttgccgtgaacaaaaaatttcggtttaggcattccgatgtccttgcaaattgtgattgttctccacaatgtcagttcgcttttgccatcgaaatgtttgtccactaaaatgtcgaaacgaggcgaaagaagtgccaatttgaggccgagttaaggacggtcaaaattgggcaaaatatccatccaaatatccgtacaaatccaactgaaaattcgggaaaattaatatattaaaaatttgagatttcaaatttaccgtcggatcatttttacggctattagcacaatttgccgtttccaaatgattacacaaagagcagaataattgcggcgaaacgaaaattgaaaaacccaaaatttttaaagtcataaaaaccgaaataaaaatttaaatattttacgaaaaatttgaattgtcagcaggagcacttactaaatgaatgaataaaaatgaatcattttcatataaaatacccttttcctcctccttcatttcattaattccgttataattttcccccggttattttattg

SEQ ID NO: 42781 - DNA, 797 bp, Heterodera glycines
cagatcgtccgaatagcccgcgtttctgtccaccgtcggcgccggctcttggatgacctgcttaagctgttcgaacggcgtcttccatttgccgtaggggtgccgtccgttcgcaatttccacctgaaaaaattgttatggaattaaaaaatccaattaaatttcaaaattcaaattaccaaagtgatgcctaaactccacacgtccgcttgcactccataagcttcttttgactcgccctcaattcgttcgggtggcctaaaaaataattctgttaatttaaagatataaattaatcgtaactcatcctatctatatattttgcaaaaaaaaaaatggtcatatttcttcacttcgaatacccattcccccaaaagtgtcacccacatgtacggcttgcatcccgcattaattgttttggcgacggaattggtcaaatggcccgaaattccgaagtcacatattttcacctctccgtttcggttcagcaaaatgtttgatggctttacgtctgacaatgagattaatatacatatatatatatatatatatatatatatatatatatatatatatatataaagggacaaaggctgattatgattgattgtctgagtgctcacctctgtgaatgaggttcatcttttccttcataaagtttaggccttcaacaaccttaaaagaatttatttgcctaatttttttggatataaaaaatctaatatttttctcactgaatacgccacgcgcgcaacaaatttctcggggacttgacgacccatgtcgacacaaagtct

SEQ ID NO: 42782 - DNA, 1019 bp, Heterodera glycines
tttacccaaatccgtgcgggtgttttttcaccccgcgccgcgcagcgccgcgggaaggtcatcaatcatccacctgtcaccaaagtgacaggtgaaggaaattcaatttaacttttgcaaattttaatcttttgtttcaaaactttttagcgttttattttctcaatcctgaaaaaattttttatgatgatttttctgatcctgaaattaaaaattctttttgaaaattagccaaaatcgtgaggggttttcatttcctctccgccccgccggtgcgccgcgatgccggcgccgcgcgaagtaatcgataacaaaataaatacccaacagaactacaaattgggggaccgtcccaataaatgaaaaattttttatcgtctccctaacttcttttgagccattttcagatagggaagaatataatgatacatttcctctatttcagaattgtttttagttcccgtaattacgactttaccggtccagaaaattaacgctgtcatgcttttaccccgcttgaaatttaaaccgcaaaatatttccggttcataaaatgcacgacgattttttcgaaactcgttcagttcagtttcacgttcgaatttataggtcgaaacaatattttcaaccgtgtgtccggtgtaagaagcccccggacaccccgaacccttaattatttctataaatttttttatagcattttcacagtctatcagacttttcgtccccagacatatcattttcccggattcccataataatgccgtggctttgatggggcttatacatttgataaccgcggcattgaattttctagggttatacttaaattcgcattcagtgatcgtcagagagtttagtttaattccggtaccgagattagcgagagcaattatatttacgattatcggtttttgcattttgatacaatgtaccaatcaaatggtcctttcactcctagaatataccccttctataaatagcaaccaaaaataaaattaaattgaaaaaatgaactg

SEQ ID NO: 42783 - DNA, 1353 bp, Heterodera glycines
gtaagaaatgaaaatattcgtattactttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatagcagtgagacgccatgctgatttgttgtaatcataataaaaaggcccctattgttcaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgattttcaacttctttctattcggatacacccaaaatttgaaaagcatctgtaattcagcctcttttaaatcttaattttctgaaacccgaatttagaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattacttttcctcccttaaagctttataatgaaagcgtctttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgttcaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaaccaacctatctttgtctattcggata

SEQ ID NO: 42784 - DNA, 1240 bp, Heterodera glycines
ccaatcagcagagttgcgagccctaactataaataaatgcgcatatatttttttaaataagcaatagcacaatattaaggcacaaaaaaattatgttcatttataccatcgacgcagagcaatgtaaaaaatttataaaaatggataaataaaaaataataaagtatcaatttttgagaaaaaaattttcattcttagggttgtattttctgaaatttttttgggtaatttctcaggggtgtattttcatttcgaaaatcattcatttcgaaaatccagaaaataaacgtcaataggtttttcgtgcttatttgaaaataacgttatttcgagcgaattttttaaagaaaattaatgagttttaaatggggtcatccagcttttttgttgttgcttttcgcacaatgttggcagtgtgttttgttcaaagaaaatttcagggtgccggtaggcgccgccggagaaatttttgaaagttttgctccatttcttagcaaattttgctcgaaatgaccaaatttctatatgaacaatatgaattctgaattttcgatttatccagtttcacggaaaacccgtgaattgaccctgtgatcgtgaccgaaaaaaacccgtgaaattcacgggaaacaaagtttgtagaaaaggagcccgtgcattggcactggcactgaaattatttgaatcggaagtgaggtggcttattatctacttgcgcaggaagtaatttaatcaacaacatccggcctcttattggctggcaatataaaatcacataatggacattttacttcttcaaaaaaatttcctatcaattttgagtctcatttaaaaaaattaaggtccctcgggatttgcttgaaaatttgcaattagggttaacttttgacggcgcacccgggaaaaattcggtttccgctccggtggccaactaagcgccatggactgattttcatacatgatagcggtttctctattaaatctttttttaaaaatttcgaaaaaacgtggactactttcaaacaaacattttaatatcatttggagacatgcactaagcttccgtttgaggcggcgaagcggctgatgagctctataaaaattagagacgcggatgcaaaaaacgtcgaaaagcccttaataattttttagcaaccaaatagcttcaataccaaatgccatctagcttttatattatgtataatcttcaaacttaattttattagcataatttccatga

SEQ ID NO: 42785 - DNA, 591 bp, Heterodera glycines
  misc_feature (523)..(523): n is a, c, g, or t
  misc_feature (525)..(526): n is a, c, g, or t
  misc_feature (532)..(532): n is a, c, g, or t
  misc_feature (535)..(535): n is a, c, g, or t
  misc_feature (537)..(538): n is a, c, g, or t
  misc_feature (540)..(540): n is a, c, g, or t
  misc_feature (544)..(544): n is a, c, g, or t
  misc_feature (546)..(547): n is a, c, g, or t
agtgattagaagaggttcaacagtgattagaagtggtacaacagcgattagaagaggtacacaggaaatagaagaggtacaacagcgtttagaagagtgattagaagaggttcaacagtgatagaagtggtacaacagcgattagaagaggtacaacaggaaatagaagaggtacaacagcgtttagaagagtgattagaagaggttcaacagtgatagaagtggtacaacagcgattagaagaggtacaacaggaaatagaagaggtacaacagtgattagaagaggtccaacagtgattagtagaggtgcaacagtgattagaagaggtccaacagtgattaaaagaggtacaacaggaaatagaagaggtacaacagcgtttagaagagtgattagaagaggttcaacagtgattagaagtggtacaacagcgattagaagaggtacaacaggaaatagaagaggtacaacagcgtttagaagagtgattagaagaggttcaacagtgaaaaaagtggtncnncagcgnttngnngnggtncnncaccatagaggagaggtactacagtgattaaaagaggtacaaaa

SEQ ID NO: 42786 - DNA, 1144 bp, Heterodera glycines
  misc_feature (76)..(76): n is a, c, g, or t
atggaaacggcgggtgggggggggacgagctgctctcgggctcatagcaggggacgacgtagtgcacctgaaaatntagtccatcaaaaacccataattgataccacaaaataaaacattccaactgctgattgtgagtggtccttccggcgccccctccccttcttaaaacccttctccaatttttttggcattatttttagctgctccttttcacttaagcctgcaaagttcgattgactcgtttcgtttcagtctcggcaagtcaaaactcgcggtggcggcgactcagtttcgtattggcgttgtcaacagcgaattgacccactaagttcaaattgttctggtttgattcgacttgaaggcaaaaatttgacggtatgaactgtttccttttttgagtgaatttacaaatttagttcatcaaaggtcacaaacatccgcccgattacgcagttaataattcattgatgggttgtaaaaacaaacacatttttttggttaaggcaactcgcgaaattttagcaaatgtgcgcgaagaatacacgcggctgtatttggtcgcaagtcgaaagggtcggacgaggcattccgagcagggaaccgtttcctcggcctcgaattcagcgccagtggtacttcgtcctttcactgacagaggcgctttaagaagagtcacaagtcaaacggaaaggagagcaaacgatctgacggatgagtcggcgacgatggaaacggaagaactgatcaaatcaatcacggccaggaaagaactgttgaccgtcaaagtcagcccttccacgtgacacaagcaaatgtattgtaacataccaaccaatagcgctgccgacaattttctcgtcggctatttacatttttgcaatccataaaaaaatgattcagtcgtcgacacaatcgaattttgtccaaacttaaatcaatattttttctgttgttatataatgtgtaaccaatattttatgattggatcaaaatccctgtgagagcagaatttggtaattcggctaatgaagtttcgcattccctatgaatcgacttaaaaattttaaaaataggtaggtagctctaatttttttagttaaaagttggttttataaatttattcattttcttataatatgta

SEQ ID NO: 42787 - DNA, 1261 bp, Heterodera glycines
ttatttttacatgctttcggatgtgaactgtctgacttttcgctgtctccactcctacacaaacacaaaaacaaaacgaaaacaatattcataaaacaaatattgctaataatttcgcaacttttaaaaaaatcattgttttgtttttcatttttttgacctgcaccaccggggaaaaaaactcaaaaaaatagagggaaaaattggcatagatccataaatttggcaaatacctttttaaacaatatggaagtttcagcaaatttttggcaaacgatttttcaaaatttgaaaaggctttcaaaaaatatgtatcaaaaattatggtaaaactaaaattcgtttttttttaatttttatttttatcccttttataaatgcgcctcatttcagagctaattaccgaatacaaaaattttgatcaaatttccgagtgcaattttttttatataaaatgccatcgtcaatggatcggatgaaacatttgttgagcacgggtgagcattcggatgtgcactttttggtgggggacggagacgcaaaagaggcgagtttaattaaaaataaaaatttaattttatttttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaaataataattttaagggaaaataccaattatgctatttgttcttcattttgtctctgctaatttccctaattaatttttcaattagtttctggtaattgtcctgatgttgtggagatacccgacattgaagcagaagcgttcaaagtgatgttgagcttcatttacacggatgatttaagtgatttgaatggagacaatgcaatggcagtgctttacgccggtggatttatttttaaatttaatttattaattattttttaattagccaaaaagtacaatatccctgatttggtcgatcggtctttgcaaattcccatctccgaattgcgcaatgttttctttgcgtatgcccaagctctccttttcgacttggaggtgagaaaaacaaatttatttttaataatgcttttgttcgaattcgggttcgttgagttcgaaactcgtcgaaattgtgtgagattcatgatccaagtgtaagcaatttttaaggatttttccatcaaatgtttgcgttacatttgtcaaaatgcgggcca

SEQ ID NO: 42788 - DNA, 943 bp, Heterodera glycines
tggttacgggcctgaagcccggggaagtcatttactaattaatgccctcgtgagattggttattggtcttaatttctcaattttgttgcgaaattgtaaaaatattaaagcaaatttcgctaaaatttgataaatgttgcccatattcatttaaattaattttttaaccaaccaaaaacccccaaattggcactttaaaacatttgtttaaattggaaacacaaaaaatgccgtgttaggcaaattcgctgtgttgttgtcaaaaacattttttacccgtccgtagttggcgaaatgcgcgcagaaaaagccgctttatgcccgcgtcgccccaattcaaatgcacccattttgagcaggccagcgcaaaaatgatgtcaaactcctcgtgtacctggaaaattgggaggaaattaaaacgaaaaaaatttagatccatgccaaaccgtttccaatgccgcgtcggatggcaggacgtaattttcacaaaggaacaaaacattgtccgggaaatggggcccgtcagaggtggacggggcggaaatgggcccaaaattggcgccaaatgaagcggggaatttgccagacatctgcggaggagggagaaagattgattggcacatcgattgcaataaaatttttaaatttttcattttttgaaaaaaaacctaaattttatcactttttctatcaataaatgggtgtgagtactgaaagtgcccagttttccgacctttgtgtccttgtcgcaaaagtggcgaatgtttttgcgcgcagcgcccaccaaatgactgtcgatgtccacgccgagcacacgccgtggttggaaggcacgggccagctgaatgttaatttggaatttgcggcaattaggatgaaaaaaatatgttcgaatctcgggtggggcgccgctctgtccaagcgaaagcagtgtgtcgaatag

SEQ ID NO: 42789 - DNA, 1260 bp, Heterodera glycines
  misc_feature (1085)..(1085): n is a, c, g, or t
  misc_feature (1092)..(1092): n is a, c, g, or t
  misc_feature (1181)..(1181): n is a, c, g, or t
  misc_feature (1222)..(1222): n is a, c, g, or t
ggaaaaaacaatttctggaagaaattaggacgggtgagaaatccgggaataaattcttccgggggattccgggaagaaacgcaccggaagaaggaaaagccaaaattgccaccggaagaaacccagccgaagaaggaaaaggcaattttggaaaaaatacgctcggtggcaaagccggaaaagatacattgaaagatggcacaggcgattccagaagagatacggtcggtgtcgagtccgccagaaatgcagccggagagggaaaagtcaaaattgtcagtgggagaaacgcagccgaagagggaaaagacaattctgaaagaaatacaactgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaaccgaagaaggaaaagacaaaattggcactgagaagaaatacaattgaagaagaaaaagacaaaattggcaccagaagaaatacagccgaagaaagaaaagaaaaaattgcaaccggaagaaacacattcggtgaagcaaaaggcaattctggaagaaatacagccgaagaaggaaaagacaaaattgtcagtggaagaaacacagccgaagaaggaaaagacaattctgaaaagaatacagccgtagaaggaaaagacaaaattggcactggaagaaatacaactgaagaaggaaaagacaaaattggcattgggaaaaacacaaccgaagaaggaaaaaacaattctggaagaaatacgatcggtgagaaatccggaataaattcaacaggcgattccggaagaaacacagccgaagaaggaaaagacaaaattggcaacggaagaaacacagccgaagaaggaaaaggcaattctggaaaaaatacgctcggtggcaaaaccggaagaaatacaatagaagatggcacaggcgaatccggaagaaatacggtcggtgtcgagtccgcaagaaatgcagccggagagggaanagacaanattgtcagtgggagaaacacagccgaagaaggaaaagacaattctgaaaagaatacagccgtagaagggaaagaacaaattggcattgngaaaacacagccgaaccgggaaaagaccaaattggcactgngaaaacacagccgaaccgggaaagaccaaaatggcact

SEQ ID NO: 42790 - DNA, 1493 bp, Heterodera glycines
  misc_feature (19)..(19): n is a, c, g, or t
ctcatttagagtctgattntggcgcaattaatttttcaaattaattaaattaaatctattaaagcgtttgaaaattggagaaaatgttttttgaaccatttacaattttatttgagcaccaaattaaatattattatttttcaattgtccagaatccgaactttttttcacgccccgcggttaccttggtttacagctttttaagaattgagattaattataaaaagcttgtttgaaaattgtatattcatttttttgaaaatttcaaaatttccgaaaattgatttaaaatttagtaaaataaccattaattatttcataaacttggtaaaatgtaaaaaaagaataacaattattattattgtataaaatttaccatggtctgcaagtaatccttggattaatagtaaagaacaaataattaaatgaattttcattgcacaaatatattatatctttttataaaattataataaaaacgaaaaaatatatggaaaaaattataatagcattttaaaaatatctattcaatcgatttatcgatcaatttcaatgctaattttttattattttttttttatatttgaaatatataattaaataagctttaaacatggaaaaattgctcggaatccttcaatttaatttgattatagagtgtcgcaaaaaatattataatataatttttcaagaaagacctgttaaattctttttccgttaatcgaagaattttttgctcgaattttggtaagggggttggaggacgggggatgtttttttgtcaaaaattggcaaagttttgagttttcttcaaatcacaaattttttcagctcaatttgaaaattttacgaattctatgcctgctaggtcttttcataaaaactgccaaattgtgtgaatgatttttagaaaatttttttggatttccgactggaattaaaactgaatatgctgggggcaagagggtacccaatggaagtgctaggtcaatttcttaaattccgcctctgtgggcgtttcttaaatccgccaaggggtagaaaaaaaaattttaaatattataatttataacttggctcagtttcaactaaattaatatttcatggtatccttaagtaattcaggtgttttcaatgagaatattaaattagaaatttttttaaagtaaaaaaagggttataaaatttcaataactcttaagtccgaattttttcccatgagttagttgaaaatcaatggtttttcttaaaattataaaatttaatagatagacaagcgtttcaaattctaaaaagaaaaattaatttaattgcatcagaaaaaattataaagcattaaatatgctatgttttttccatcataattttaatttattacatagttttgtgccagcgggtaaggcatgtaaaatgccaaagtcggacagttgggcagtccttgaattttgttagtggaaaatgttcgaaaaaagccaaaagaagacagtttttaa

SEQ ID NO: 42791 - DNA, 914 bp, Heterodera glycines
  misc_feature (8)..(8): n is a, c, g, or t
gggggaancgtaagcgccaccgtgcaaaattttgtcaaattatgccaaaaagcaaacaaattaacaaataaataacttgttcaactgtgtgttgctaggccagtgcctacgcttctgaggacggtgtgctgaccgagcaaatgattgacacgaacacggcggaagtgttgcgacagcatcgacgcaaaatggaatggttggcggcggagcgagcgtcgtcgtcggcaatggcattggcatccgtcacggatgacggcgagtcggcaaaacagaagcggtcaaagggggcggctgctaccaagaaaatggggacagatggcggcaacggacagtgaatcattcattcattcattttggtgatcacttacacccatttttgaactgattgattggctcattgattctcgactcttggccaaaaaccaaatgtgccgtttgtttgtttgtttcttttttatgttttattgttgttgtttgctgaatttatcattattttttccatttttgaagaaaatttatagtttggccacgtttaaaacactatgttggattttctcttaatgatagacatgtcaattcaatttaaattaaaaaaaaaagatgaatcgaaaataataggtaataaaattgaaattccgtcacccctgtaaacacattaacccataaaacttaggcgaccgtcgctgtgacttgtctccaaataaaaattcaaattaagacacctgcattttaaattgggcattatttatatactagagaatggaattttgttagttccgggcccgggcctagacaattgaccggtacggtctgtccggtccaaaaaagcccgtgttttactgggcggcccgataaagcccgccggacacgtctggtctgtaatttatacactgcaaaacgcaaccgtttcgcta

SEQ ID NO: 42792 - DNA, 926 bp, Heterodera glycines
ttgctgtctcagaagaatagatattctcagagaatggctatcactttttttctacaccgttgtacatgtggggtttcctcaaaaacgcattactatctgcggttgagccctacaaaaggtcggtttgaaaattgctttctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcgggttgaaaattgctgtctcagaagaatagatattctcagaaaaatggctatctctttttttctacaccgttgtacatgtggggtttccccaaaaacgcattactatctgcggttgagccctacaaaatgtcggtttgaaaattgctgtctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaaacgcattactatctgcggttgagccctacaaaaggtcggttgaaaattgct

SEQ ID NO: 42793 - DNA, 1175 bp, Heterodera glycines
aggttagtaaaaattaaaaatttagtgggaaattatagggataaaacccaaaaaatcactcaaattttatagctttaccgtgatttgttgctacggtatgtgtgctgctgttttgcaggcttcgcagtacggtaatcaggagatttaaattaatttaccattcctaaaatagagcccccggtggctctattttcaatccctctaaaagggggggggctttattttagggggtgcgtgcattattttagtaaatatggtataattttttttcattttagccgacgagaaaagtgccgtcaaagagcggatcaattggccaaagcgcgcgaaagggtccgagctgcctccaaatcgttcatttccgtatcaacagctgtcagcccaacagcaattatgctcaaagaggtgccgcccaaaaaaaaacaactttttaatcggcattttctaagccgtctaattaaggaaaatttatttttcaatcctaaaaaattatttctacgagaatcaaaatttactaatttgtaagacgacaaataaaagctgaactcaaggccgagaactaagcccgagactgggcacgagacatcagggacataatttcgctaaattttcccaaaaatccacaaaatctgtttaaaaatcgagggaaaagctacaaaattttcccgaagccggatcctaaatccaattttcttaaaaaattgctcaaattcgtaaatttagttattttttagacaaaatctgttaatcagaccagagatcgggttcaattgtcgagataaagtcgggcaaattattcattctcgggattgagaggggatttgcataagtgttgaatgaacgcagtaaaatgccgggaattgatttttcatcactaattgcggcattccatataaattcggcacaaattccgcaaaatttgatttgcagataggactttccgagctgaggcaaggcaatgcgatggaaaggtggcatcattaccaccagcagagaacctcaaagtccgaaccaatcggtggccaaaaaaggggcgaaacggagacaaaaatatttttatttgacagatgggccaagggggaggaggaagaggagcaaaacaacgaaagataatgatgaatgaagccaaaagtgccattgtattaaatgaaatttgcaaaaaaaaaatatcgact

SEQ ID NO: 42794 - DNA, 1059 bp, Heterodera glycines
  misc_feature (894)..(894): n is a, c, g, or t
  misc_feature (913)..(913): n is a, c, g, or t
  misc_feature (925)..(925): n is a, c, g, or t
  misc_feature (973)..(974): n is a, c, g, or t
  misc_feature (1039)..(1039): n is a, c, g, or t
atgtgaacactaaaaatggggaggggggaattaattggacatttcactaattaattaattaattaattaattaatgggcaaggggccccggggaattgaaattgaaagaaaaaaaagccaagtcagctttatgtattggcttgattggtctctgaagaattgatgatggaaatgacctgttccatttggccggggaatgtttcgaagtgattgaccgaaggatgggcggacattgcaaaaaggcggacactgtcctaaacaaagagacaacaaagctgtgagtgtaattagtgagtaattaatgcaataaatcaaagtttgcaaattgcctcaggggttttgcgtaacgcgtgcccaagcaaaggcgaatggtcgacgaatgagtgggccttaaaagttgggaatttgcgaaacacttcgtttttggttgatttattttgagacctaaaatactggaacagcagcacatttatgccatcagagagattgaaacgcggactctccaaaatggcaaaatcgcccgggccgagcactcaaaaattatttttaaatcatttcgctttttcgaattccggcatttacctgtgctaacgaattgcccatttgtcgaagctttaaaatgtaaatttaattaattatttctgcatttgctttttacccggcctcaaatcggtgtgacgattcagcggaaaccctaagcaattgcttaccataatcacaaactgaaatcccatttcaaaatgtcctaccgtatcctttcgttcgcaaagtccacggcacttttgtgaggccgtggttcaaataatggcacgcattctctgtagaaaaattacaatttaagtaaaatcatcaaattttaacattttgtcatttaattttacactttcctaaatncatcattttagaattgaanttcaattttacncgttaagtcgcaattgagcaatttgcaaaagttttgttccccgcgtgnncaatgggtggtaccgtatttttgcgtggtagtgtacggtattgtgaatgaactgtaagcacttgncaatttcccattgctcattt

SEQ ID NO: 42795 - DNA, 1204 bp, Heterodera glycines
  misc_feature (59)..(59): n is a, c, g, or t
attttgaattttttttttaaatcaacaaatgttgcgttgttcccattgcatcaattacnatacaagaaaatttataactttttttaaatattcaatatttcttaaaatttttccagaataaaggattaaattcttgaaatgtttctttagaaaattttaatgttttctgaggattttaaaaacgcgccagcatgctttactccttcattcttccttccactttttcttaactaagatgagcgcagttggcctcgaaatcggctaaagcgcgcaacaaacaaaaaaaccaatagtaacacaacacggcacgcatcgccaaatgcttggctcctatttgtgcgagtgcctctggcgcaaagatgtttaaaaccgtggcgcaaatccatttgacgaaatcttagctcaaattgtggcttgtatgcccccgatataattttgccgcgacatttttgtaattatgcgcgctcgctttgttggtttatgttcaacattttctgtttttcggccggcgctcattaaattttcttctcactatagcttcgtatttaaatttgtttctcaccttgcacacattggccacctgtcgttcatccagtgtactctccatattttccttgataaattcactacccccaaaatcaatcactttcaacatttctatttcaatacctcctccttcctttttcttcacaaaaagcatattgtccgatttcaggtccaagtgaataatggctaaaatattttataatgtataatgcatatttttaaatttgtttgcataaattaaatttaaaaatttaacagagattctagagtgtctgagaatgggcaatgtaaaattggtgaagtaaaaaatattaaatcaggcatcaagaaaaagacaggtcaccatgaaaaaacgagaaatggctcaagaattgttcgggttataggttttgtaaaaaaaacacgtaaaaatctgtcaaaggccgcacacggacggctttagatgtagaaatcgcaacattatttgtctttccaaatctctccaaaaataaagacggtctttttattagggaatatttcaattatatcatcaaccaggacccgatgggccctgtgaaagcgccgggtgcgctttcaacactgggccagcaaggcaacagttgaatcctgcattttgtcgcgcttaaggtactcacttgaccgcttcgcggcctcgtac

SEQ ID NO: 42796 - DNA, 1091 bp, Heterodera glycines
cgacaatcacagagatatttttacatatgtcgttgaagactcatgaagatcaaagtcgccagattttagtcaaaataaagcagaaagcacaaaccaaaactatgtaattattttacacttttaaaataaaatcattttgaattggcaaaaattttaaaaaattccgaaaattttcgattgaaaatcggaattccaaccccaagtcaacatataattttaattttagtttttttactaaaattaaacgctaggaccaactttcgctaaatcaagtagggtttggacgccccccccccccccccccccccctcccgacgtcggggttggaaaagtcggggttggaagcgtcggggtcggggttgaccaaatcgttcggggtcggcgtctgggtttttcaatttttgccttatgccatatagtcaaaaaactttatattatttttgcttaaaagtatttattattcataattagggttggtatattttatgtgcatattttacgattttatgtgtatataattacctgccctagtgataatcaatactaacaattctcccgaaagacataggtatttcttctgtgggaggcctgaaacgtacgaagaacatgtttttagctttgtttgaagcttctaggagtatttccatatgcatattttgcatatttgtgcatatttcggcattttatgcatattttatgtgcatatttgggcattttttcaacatcctctattaaaacggccccctctattaaagcggccatttgggctctaatgaccgaaaatttttcaaaaatatcagatttttgggtatattttctggtaaaaaagtaactttttaaaaaattggaactttatgccaaaaatagtcagaaaatagaaaattctccattttttgctcaattttcttaaaataaattaattttactttattttgtatttttggttctaagttgattattcatactatatttagctattttcgggatttttatgcttaaatttaacaaacttgaagaaatttgaaaatttgccctcaatttggaatatgagcatatttttcactttatgcgcatattttgcgattttatgt

SEQ ID NO: 42797 - DNA, 1514 bp, Heterodera glycines
  misc_feature (1444)..(1445): n is a, c, g, or t
  misc_feature (1448)..(1448): n is a, c, g, or t
  misc_feature (1466)..(1466): n is a, c, g, or t
tgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacaacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcttgctgttccttcggggatggtgcgtggactagtggtgagagctgcttgtggagcgcttcagctgcgtgtatgctcgtcagggtatgcacttcggttggcgctgaacgaccagtttagaaaaaaaacgaactcggggaatccgactgtctaattaaaacagaggagacggatggtccttgtggacgttgaccgtgtctgatttctgcccagtgctctgaatgttaagccaaggaaacttgaataagcgcgggtaaacggcgggagtaactatgactctcttaaggtagccaaatgcctcgtcggctaactaccgacgcgcacgaatggatcaacgagattcccactgtccgtatctactatctagcgaaaccacagccaagggaacgggcttggcaaatttagcggggaaagaagacccttaaaggttactctannctnactttataaaaaatcatnactcagagtggagaagtgggagccgcaaggcgccaatgaaataccact

SEQ ID NO: 42798 - DNA, 945 bp, Heterodera glycines
gatgacgttaaaatttacatttcgcatgataatgacacgaaaagggatttactctctttagcgttggctaacttagcaaatggtctaaagataatggcatagccattgcgcatgagaaatgcgcagcattatatttaggaaaaaataattctagacatgagtataaaattggcgagaaagtaattttaagcgtagattgtgtccgtgatctgggagttttggttgatcaaaagctctcatttaacaatcatatttcaaaaattttaaaggcggcttatttcaaggcatatcaaattttaaaaatattaaaaacaaggaatatcaataccttaatcctagcatataaaagctatataagacctcacctcgaatacgcatccgaaatttggaatatctcctcaaaagaacagagtaaaagaatagaaaaggttcaaaaatatttcacaagaatcgtatacaaaaaatgtggcctcaaggcaataccatatgaaaaaagacttgagatttgcaaattggagaaattaagtactcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccatggaattgcttacccaaaacagctatggaaatcggaactttagctaaatttaaaaattttgtgaaagaattttattcagaaaataagtcctgagtggtaattaatccctttttattttttattttatgtatttttactgtattgaccatatcatatttttctaattgttattcattactttgttttccgctataagtgcaactatgttgccttggggtttgttcaaataaataaaata

SEQ ID NO: 42799 - DNA, 1027 bp, Heterodera glycines
ataaaacaaaatttttatttattagtaattggatttatttggtattattttaatgttttgttatataataagaatattcaaatttaaacttacttttatacgtgaaatatacattattttttaaatattgaaatttggtcatgtatcatgatcaaaatagttttaggatttggtgtatttgctctgaatgttgttccgcttgaatatattaaagcataaataatcaaaatatgtttttttaattatttaaaaaattagagctcatttttgacaaataatgctaacaaaggataatgatgtccttaattgtatcgtttatacgtgcaaattaaaatcctattaatttttttgcaattttctacttcattaactgaggtatttatcttctttaattcaatgaaattttgtattttgaactgaaaaactaattgcaatacttgcaaggtgtttatgctattatttcttattcccattgtataatttatcatagaaatataggttttcttgaaatgagaataatataataaatttataccaccattgtttttcaatgatacatttaaaaaacaattatcttgtcagaattaagtaatttttagccaaacaaaactgcgttttgagcgcttggatggtagaaaaagagttcatatctatggtcagataactggatttactaatttagcttaacgtaatgattgatatttttaaaaaatctaattttatgtcttacctaattctgtttttaatcctgattttttcaaagcttataaattatgggattttgtatatcatatattttgttttcttcttactaaaatttatatcttatgggattttattgttcaaaaactgtttgtatgttgtatatttttatgttttttcgactaagtttatcattatattttatttgtttcgatgaatagacgtaatgaaaaatccattttcttgaattttcaatagatttaatctattattatttttactttcatataaactggaaatatttattttctctcctctgcttttt

SEQ ID NO: 42800 - DNA, 1212 bp, Heterodera glycines
  misc_feature (6)..(6): n is a, c, g, or t
tactanttcttcaacatggctttaaaaatttttctatagacaattttaaattaatattagagaaattcaggcaaatgcattaacaaattgacaggtgcattcttttcaaaggggaaaataggcgaatcgccactttggcattaaaggaaattaaattcgcaaaaatatggcaaaagcatcaaaatgtaattagtgaatttaattttacaagaatatttacgagttgaaactcattattgttgtaattaaatagctgttttttgaaatttgtataataattggcaaatccgtttgggtgaatatcatgcaggaatttggatttttttcttttgatatttagctaaaatcatcattaatttgatggttatagtaaatatttttaaatgtgccttatgagaatctttcttagacgaatgacctagaataatcacagttttcttcagcacctaaatgatttttgaaaattcattgtttctttttgcttcttggggtttgtatcttttattttgctttcattatttaaatttttcttaaattttctttctattgaggcgattcccgtatttatagacggtatcagccttataattagtatgatgaatattaaactttttaaaaagtttgtataaaaatgcgaatttccaattttttttttgcggttctcaaacgatcactttttttgctttgcatttaattgtattatcaatagcttattcctatcaaaatcaccgagttttaatatttttattttaatatttaaaaaaataatttatttttatggaattgccctttttgtattgtctttttgtacacattgaaaaattaaactaccgttcacgccgtagaagcacaaattttcattcaatttccaatttttgtgtaatttatgtgaccattaagacaaagtatgtaaaaaggatcattaattagtttataaaatctgctaatttaccttaaataggtcattccgtgacacagtttattaccttttggcactttgctcttttttcgaattgattcatcaacctggctattttctttttgtttattacacggctttttctggacaaaatttcattgagtatcgtttggccgtaaagatcactttcatttcttggtttggaatcggtaaaaatatcatgatgaaatgtaaaaaatgaaactttatttaggaagtaaatttacgtttaaggcacaataaatttaaaattt

SEQ ID NO: 42801 - DNA, 1158 bp, Heterodera glycines
tcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattgctttctggacttgacttggtttagagatatagcaactgtgagtatacagtagttctaacacgtttattgcaatccctcggattttcagaactggttttcagaaaaaatgcgttgtggcggaggcgatatttcacaagtgactaaatatatcggtgagttcgaggaggatcgacacccatccttacccccccccccccccctccccacgatagttaaaatggaaaaacattggcagaacattttacagtgtcattcctaaacgtaacataaaataaatgtgcatgtttttttcttgtcgttcgctgttcgctcgacacgcagttatttcacgtcccaggcgtagtgtttgttgtgagcggtagtagggtagtagtcggactgacggttggttggaaacgagcgggatattcctgg

SEQ ID NO: 42802 - DNA, 1118 bp, Heterodera glycines
  misc_feature (48)..(48): n is a, c, g, or t
  misc_feature (1095)..(1095): n is a, c, g, or t
cctagaaatgtgttataagaattttcagaaatttaaatcaataatttncgggaccaaaatgatctaggcgattgcccaaatttgataaagttatttttattttatatatattttttaatatggccccaatttgccgtgaaaatttgcgttcgaccaatttttttttctcccttttttccgaattgtttgatcagcagatttgcacagatccttctctatcccctgctcaaacatttttccccgatgtagagaccggcggacgggctcgggcaaaattttgaaagaaaaaaaaattacagggtccgactcgcactttttaggcatggatccggccggcatttcctaaaattccaggcctccaatttcacccatttgtatttgcagatatggtctcggatgacacgcaccggatgggcgacattccggccgcttggctgcccggcgtgtcggggtgagttgaacaacgaacggcgtgtctaactaatcatttttggcgtttcaattactttcatttaatttttttttaaattgcaaattaaaaaatttcatggatcgattttgaaaaaaattttcaaaaaaaaaattctaaaaaatcgctcgaaaatttttgaaaaattccctaatttgatttttattttatttttattttgaggggtaggggaaacatagaacccataaaaatgaatttcatattcattcgttcagaaaaacatgaaattttacaaattttcccccctccattttcttgaggcgtcgtttgcgccagtatttggtgtacgagaagccggagctgtggattcaaatcccgttgaattacaccaaccgatcgttgcgcgacacattcgccagcaaaccgccgtgggaattgtggtgaaacaacaacaattaagtggtgttgacaatagggataaagaggatggaggggaaacaacaaaaaactctttttcttccttttttttgtgcaaacaaaacacaatgccaacgggacgccgcgccaaaatttgttattcaaaccccaaggatatttttggttggtcccggttttggttgtaagctttttttgcacctattaatttgatctcgcccagcttcctntggtgatcttctgttcgataaaa

SEQ ID NO: 42803 - DNA, 1374 bp, Heterodera glycines
caggtcataattataaattgcagaggatgaagtgggacaaaagatggcactgctcagggaacgcgtgcgttccaacggatggtccgtttgcgtgagcggagacgactgatgttggaagggcaacacgccgttggagaagtgcaaggaagcggacggttggaggtgtcgacaattactggaagggaggggcgataaatttgcggaagggacaaaatgaaatgagtggcgaccctcggggggggggggggggggggcttccatctgtgccgccgaccaaccaactcacaaatgtaaggcgggcattgactctttcctaagctgcgtcgcttctgctgccaatggccatgtgacttcgtgcctttgttgtctgtgggggtattggtgccattgggctgaccattgtgccgctttctgcggatgttggtcaattgtggatgagtaaatgttgtgggagtggcttctttggcaaaactccggcccgaaattgttgtttgtattgttggcgtaatcggccattgcattgggtgaagcaataaattgggctgatgggatggggagggggaaagggttggagttgggctgggggtgggcgaagtgttggcgcgcagcggcggcgggggaaatgtgctgctgctggtgatgtaagctgaagaaagggccgacagaagggcacaggaagctgaaggagggggggggggaaattactgaatgtccacgcagagaaagaggtgggatgttaatggtcattttggcatattcgaaagtcagttccgggactaagagaggctggcaacaaaattggcacatttgctggtggatgccaactgctgaggaaggggcgcgggagggggagaggggaaaggggcgaggaagaagagtgacgacgacgttcggccgagccgggccgccctcccccctattctgctgctgatggtgacacacctttttacgcactccccctccaatcttagcgtattatcaatagttgaagaatggggtgggatgggccaaacaatgttttaatggagagcaagaaaaaagagagagagagaaggcgaaagagagagagagagaagagtggggaaagaaagatgtgagagagagaaagagagaggagatgggaaaagaataagataagagagatgggagggcggagaaaaggagaagggaacttttgagtggccacggattcagcaccaccatcaaatagatcaattcgaacagagatcaagctgagcggaagaattaaaaggaaggggagtggtgcagcagagaacagcgacacaatgatcaatcagttcggcagaggatcgtcccgaagagagagagagggggggaaagagagaatggaggggagcggtacgaacacagacc

SEQ ID NO: 42804 - DNA, 1790 bp, Heterodera glycines
  misc_feature (1724)..(1725): n is a, c, g, or t
  misc_feature (1767)..(1767): n is a, c, g, or t
tttctaaattaattatgcttttcctcatttttatttacgttgctgtgaaaagagatgaatatatgcttaagcggatattatatatttcggcgaaaataatttcgaactaaattgaatgaggaaatttcaatcaaaactctagtaaatttttgttaaatatggataaatttatgggttaaaatgcaaaaatatcgcaaaaaaatgcaggatttgtgcggattaatccgcgctatttaatttctcacacaaagtgcactgacagttgtgctgtatttaatccatggaaatcctgcgcggaatccggttcttctactggtgcaattttaaataaaacgaatcaattgaatgaaaatgaaatgtaaaaaaaatataaaatttaaataatataagaacttattttaaaaaatatattttcagtttttaaattttaaaaaatatttaaatgttcatattatttatctcaagaagatttttaaaaaaatttttaattcaatataaaattcttaaattgaattacttaggatttcatctatttctttcaaaatttttaaatataaaatgaccaaatgaactaaaaacatagattttattaagaaaattttaaatacaaaatgaattaattgaactgatcggtaatccgttgatcaaaatctgatcactcagatctttcagcatgtaattttgatcgctgcgcaactgctggcactgcttggacaaatgatggcgatggcaatgccacctttctgatcgagtttctgtgttgttgtgccgatgaatcaattgttggcagccgagttcgtgccgttgtcatgccaccgttgcatggtgaacagaaacggtgccgaagttgattgaactgctccgaaaaggctgcacgaaactgaaacaataaaattccctaaaatttttaatttgaaaaatatattttgaatttattcagcatattaattcaataataataacaaaaaacttcttctttttttttagttttgttcctctgttaaatcagaaaacagacgaaaaattaaatcaagaaagagattcattcctgctattgttatcttcagcaaattttcaaaatcatcaattaaatattattttgaaaatctttttttttacaagttttaattattcatttatataggggggatatttggaattgaaacatgttaatagaataattaaaatttaaatataacaaacctgctcgttcaacagcgcataaagcaccggattccatatggttgaacttcaataaaaaaaaatcacaaattaattttatattatttatttaaaatacgattattattatttttttaaatatttaaagattatattttattttacctcatcgatatgcagtgagtgatgatgccaaacaaatattcttggctgagcacaaaaatgggcaaccactggttatcccgaagaaaattgaacagcacagtgggtgcccaacaacagaaaaacaatgcaaccattgcttaataagggcaaaaattatttaattatatttacaaaatattttttaaactttgcgagttaaatttacttatttttttgtgatttttgcctactttaaatgatgaaaattagtgaattaattaaagtaaaaattattcattggattatcaaaatttaatggttagggttcaaaaaatatggtataaaattacaaaaatggccataaaatatagactaaaaacgagaattattgaaacaannataaacatttaaaaataattaaattaaaaataaatattcttngagataattttgtaaaaaaaaaa

SEQ ID NO: 42805 - DNA, 1309 bp, Heterodera glycines
  misc_feature (1199)..(1199): n is a, c, g, or t
  misc_feature (1243)..(1243): n is a, c, g, or t
  misc_feature (1255)..(1255): n is a, c, g, or t
acaaaggctcaaacactccgcaagcagcgaacattgcgtctatataaacgatgcttattctgcaaagatcggcagattttaattaccctggaacggggaagaaatggggaaaaagtcaaaatcctaatatgggcaacgataattggaacccagtgtaatagaatattatcacaacacacacattggttgaattcccagtaatgaacttttgcctccttcacgagttgctccttctaaaaactggcattttgataccgtatttttctttgcaatattttttgtggccaaataacgagcaaagggaacgttcatatgtaaatttcatctgacatgtatttttgatttaaatttttatttaaaattccttaacaaaaatgcaataaaaatgaaaatacatcccccaagaattgatctaaaaattcttaaaaataaatccataaaaatttctttgtagaaattaaaaatttgtactcgtcgcctaattctaaaaggcgtagaaaaaaacctggtcaaatgactacgaagttagtggtagatccgtagaagaagaaaatgaccacgaaattccgtttttaccaccaacttttgtccgattatttaacaaaattcatgcgttaaattcatataaaaattttgtttttgtttttcttcctttttgggataatgtgggatatttggcacccttatagggataaaataaattacagtttggtttattttaaataatttttaaaaaagtttattttaaagaatttttttttaaatgtttaaattggtccaaaaacttactgataagtattttaaaaatccttttaaaatcccttttagcaaaagaagaagaagtcaaaattcatgagagacacatcattttggtatacgaaaaaacaaagaattaactaaaaacgcgcgcataaaataatttttccaatgattaattgtggcaaacttttgagtcaattcaccatttttaagaattctttaaaataaactaacagtaaattaaaaattttgtaaaagaaaagttattttaaggagatgaatttttgaatttaaacatcataaatcttttggtggctctaggaaaatgcgtaagtgtaaattttaatgtcataaaaacaagttcccttggtttttgtggtcactgatcacgaacccagtgtccatttcggccaattccaaaccccggcccgaattcgaancaaagtttgattgtggccaaaaaaaagcaggaaattatgagaanataacacacaantttaatatgatataaaatattttaaaatatatttagcgataattaatgttttga

SEQ ID NO: 42806 - DNA, 1236 bp, Heterodera glycines
aaaatgggttccggactttttggctttttgaaataatttgtgaaaaatatacgaaaattattttagctttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttacaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacgaaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttaccttttaatgttgattgcggacttatcgtattttagaaataaattgcgaagaatatacgagaattattttagcttttaattacaatgaacaatgtttttaatgcccggcgcgaggtgcgacagttccgcaatttcgcatcacatttcactgtggaaagacctagtaccttattgcagaacta

SEQ ID NO: 42807 - DNA, 907 bp, Heterodera glycines
cggggaatagccccaaaagtgtcggggatcggggtcagggaccggggagctcggggtcggggcttaaccctaatttagaacatcaaaatgatcacaacaaaaaatagtcatttttcaattaaaaatactcttttcccaccaatttccatcaccaatttttcacttaaaccctcattcttaccagtgtacttttattcccgtttttgagaaaaaatttacgggaacgggaaaacgaaaaagaacggggcgggattcccgaacgcgattcccgccttttttcccgttcccgtaaaaatcccgtcaggtaaaaaagacgggaaacgggaacggggtcccagtgttttcccgcgggaatcccgttcccgccgggctctaatcgaaattaatgcgcagaaaaaaggcatatgcttcaaaagtcggtctattgatcagaggcactaacataaacagacagtcagaaaagaagaaatacataatatacaattaatttctagagatatcattatttccatttaaatttgagtgtttaaattttttggctaataaaatcatgttatttattgtgttggattcataatggccagcaatttgcttaattaccgtatttcttgtaatataatcccccccccctgaattaatacccctcacctgaatcattatctcatttcaaatttgagtgtttaaattttttggctaataaaatcatgttatttattgtgttggattcataatggccagcaatttgcttaattaccgtatttcttgtaatataatcccccccctgaattaatacccctcacctgaatcattatctcatttcaaatttgagtgtttaaattttttggctaataaaatcatgttatttattgtgttggattcataatggccagcaatttgcttaataccg

SEQ ID NO: 42808 - DNA, 1424 bp, Heterodera glycines
atcattattggcaatttatgttatctgattcaaaaatcagatcgttaccatcaggattttttcgcatttctactaaaatctgtgatatttgttcccgaaaagaaacattagaaataacgaaaactaattaagcttctgtaaaacacaagaaaagaacaattataatagatacattgtcagatggccacttaaacaagaaaaaccggaaattccaacaaattttggtttatgttttggtcgattaaaaggagaacttaaacaattactaaacgagattttacaaaaccaataaaaatggatgttaatgaaattgtaccatttaaatccaaatatttaactcattatttagcatatcacccagtcattaaagaaacttcaaaaacgacactagacttagaagataaaaaaggaaaatttgaaaaattgtgtaaagaattaacagaaaatgcatatgtagacaactttgtaatgatatgtgaataaaatttaaacattcttggagtaaagaaattttcaaacttgcttcaatgaatttacgagaatttatttctaatcatgaaaattctaagaattaaattcagaaaattgagagctctgaaaatgccaaaaataagcaagattctttaataaaatggaacatagaaaatgatgatctaacaatatcaataaaaatcccaacgattaccaatggaacaattaaaagaaatgtaattcattttgcaaataattttatccaatgggatgggtttcacccgtaattttgccacataaaaatgctttcaaaacttatggaaatctaagaaagattgggatgaccaaacttagtaatgaagaaataaaacattggaagaaataacttatgaagaagaaatctatttaaagcatttcccatttagaaatctatggttcaaacagttgaactacacattttttctgacgcatcaggttcagcctatgcatatacagtctatttgaaattaattgagtcaaaacaaatatgtgtaatttttgctaaaacaagattagcacttgtaaaagaattaaagattatagttcatggacgaaattaattaattatattaaaattttactaaaatttatttcgtatattaattgattataattagcaaatgattctatgagaaattatttaagctaaatataagtaattgataaatgcagaaaaagaaattatatataatggtattaaacagttatttacacgcttctcaagacgtacaaaaacccccggcccaccacaatatactgctcattgcacaaaaaaattaaataattaaatggcacccaattctatcaataattcatttttttgatttaaataaggaatgcaataaccttttatgataatggaaataactcgtgtaggaaaataataaaagtcacatagtcattttaatcatgca

SEQ ID NO: 42809 - DNA, 823 bp, Heterodera glycines
tcagaaagggttctgaaacgcaccaaattttatttacaccgccgtgtaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaattctgaagggcggggggggg

SEQ ID NO: 42810 - DNA, 830 bp, Heterodera glycines
  misc_feature (781)..(781): n is a, c, g, or t
  misc_feature (807)..(807): n is a, c, g, or t
  misc_feature (825)..(825): n is a, c, g, or t
aaaaggcaggcacactaaccacttgaccactgggccgcctgccatcatgcattttaatgccctcttcccttcttttcttttattgcaaaaagctcgaccaaaagtgcataatttatttttctttataaaatatttagattttattttatttttatgttatttttgtatttatttaatattcaagttattttaaatttaattaaaaaaattatcattttataattaaaaaattattattttattataaataaatttattaattaaaaaacaaaaaaataaatctaaaaagaaaaaaagatgaattatttaaactaaacattgaatagaaaacaaacatcagcaatgggactcgaaccatccgccatcacagaaacaaagtcaggcacactaaccacttaaccactgggtcgcttgcctccatcccttttagttcccttttccttttccttcttttttggaagaaaacccgaccaaaagtgcttgtaatccctttttagggcacttcccggacccggacccaaacaaccctggtatcattcgaaagccaagagtttgtatatcatgcgaaattgtttcgatttttgatttgaccacttttaaggcatgcaaaaagcgttcaaaaataggacaaccaaaaaagtgcaaattttgactcgtttttcgaacacagttcgaacagttctaaaccgatcgaaaccgcactatttttcccttatagcccttgaaaaactgcgtcgattgaccccactcccgacccgtaacactcgctagaaagtcttanattagtttttaagcttggatcatggngtataatttcttatatancgaaa

SEQ ID NO: 42811 - DNA, 878 bp, Heterodera glycines
ttgaattgtatcttcccagcaaaatgatcactgtcgtcactttgtcctgggtttcttttattatgtcctttaaattgcatcttcacagcaaaatgatcactatcgtcactttgtcctggtcttcttttattatgtccattgaattgtatcttcccagcaaaatgatcactttcgtcactttgtcctggtcttcttttattatgtccattgaattgtatcttcccagcaaaatgatcactttcgtcactttgtcctgggtttcttttattatgtcctttaaattgtatcttcccagcaaaatgatcactttcgtcactttgtcctggtcttcttttattatgtcctttgaattgtatcttcccagcaaaatgatcactttcgtcactttgtcctggtcttcttttattatgtccattgaattgtatcttcccagcaaaatgatcactttcgtcactttgtcctggtcttcttttattatgtcctttgattgtatcttcccagcaaaatgatcactttcgtcactttgtcctggttttcttttattttgtcctttgaattgtatcttcccagcaaaatgatcactttcgtcactttgtcctggttttcttttattatgtcctttgaattgtatcttcccagcaaaatgatcactttcgtcactttgtcctggttttcttttattttgtcctttgaattgtatcttcccagcaaaatgatcactttcgtcactttgtcctggttttcttttattttgtcctttgaattgtaccttcccagcaaaatgatcactttcgccactttgtcctgggcttcttttattatgtccattgagattgtatactctcccaacaaaatgatcactttcgtcactttgtcct

SEQ ID NO: 42812 - DNA, 1059 bp, Heterodera glycines
  misc_feature (22)..(22): n is a, c, g, or t
agggctaaaaaattgccaaaanataaagaattttaaaaaatttccaaaaattatgaaacttaaaatagacattatattcgtactcagcaccttattttaccccagaaaaaaatttttcaccacccttttcaagcctaaaaaaattttcgaaaatttctagggggcctagctcgaaaatttttgaaattttccagtcatgaagcacaccattcgatagcatttaaaattctctacaaaaatgttctaagacaatttttcgctaaaaccaacccctgacgagttatgggcccaggactcaaatgtcccgctgaggctaaaatttttttctatttccgggaaaaaatcgaaattttccgaaaaaaataccagtcgatagagctcgaaaaactatgttttggaagtggtctccgtttctctgggaaaattcgttaaaaattcttaaaattcaaaaacccgaaaaccgttttttaggcctagctcgaaaaattttgaaaattttcgaaatttttaaatttcagaaaatcgagcttccaaaactctacaataagtctgctgggcacttttctctcagatcaaacgccgacgcagtattagcctggtactgaagtgtactttttgagcacgcttcagttgccattttctgcaggccagggggtggctctattaaaaaaataaaaaataccagcatgtagaggaccctttggcggggtgccctcgcagcgggcattttttgatcagagttttagaaaaaaagttatgggccttcaaacgcaagcaaaagtgagaaattagccgccgggactcagttggccaccggaccggaaaacccttatttttcccagatgcgcctcaaaaagttgtaagacccttccactactttcagggcgctcccggccttcggccgggagattttgttttttgaaacgaaatgcaacttttctctatggtaatataaactagcgggtgcgtgaaccgtcggatctgggcttgagataaagcgcttcgcgctttgggagcttcgcaacctagacaagctatgggttgtgaagatatttggaa

SEQ ID NO: 42813 - DNA, 1337 bp, Heterodera glycines
  misc_feature (88)..(88): n is a, c, g, or t
  misc_feature (1283)..(1283): n is a, c, g, or t
ttttgatagaaaaagcatcagagtgcctaaactaccatgtaaataaattgggtgcgttcagaacccttttctgaaaaaatatttaagnaattaatttgcaaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatgagaattcatgcgagattttctggaaataagcttaatagggcctagttaagctgtaaaaaaaatttggggcgatttgaatgagaatagaaatagccaggttcgatgaagttttggtaagccaaaaaaaaatccaaacatttaaaaatctataaaaaatttaaaaattagaattcatgcgagattttttggaaataagcttaatagggcctagttaagctgtaaaaaaaatttggggcgatttaaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggagcgatttgaaagagaatagaaagagccaggttcgatgaagttttggtaagccaaaaaaatatccaaatatttaaaaatctataaaaaatttaaaaatgagaattcatgcgagattttctggaaataagcttaattgggccttgttaagctgtaagacacccaccacttttgcacttaaaaaaatttcaaaaaatttgatcgtccataataatttgtaattgatcagcggctcaccaaattttgcagagatacgtatcggagcactacaaatgcttactaattttcctagattttttaaacccggtgaaaattttttgcagacacccaccacttttgcacttaaaaaatttcaaaaaatttgatcgtccataaataatttgtaattgatcaggngctcaccaaattttgcagagatacgtatcggaacactacaaaagcttactaatt

SEQ ID NO: 42814 - DNA, 544 bp, Heterodera glycines
aggaatggatttaattaaattctctccttcggggatttttttccattaggtcgtccgttagcgttcgattgctctagtcaatttttcaaaattttcgttgaaatatttcgtcgtgctccgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgtgaccttaggcactctgatgctttttctatcaaaaagggagatgaat

SEQ ID NO: 42815 - DNA, 1093 bp, Heterodera glycines
  misc_feature (48)..(48): n is a, c, g, or t
  misc_feature (1074)..(1074): n is a, c, g, or t
aagagatagccatttttctgagaattaattcacattttccgcagctcntacggtaatggaaaaaatttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttcctcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattatttcacattccgcagctcttacggtaatgaanaaaattttgaagaggctct

SEQ ID NO: 42816 - DNA, 150 bp, Heterodera glycines
cgtgcagattttaccgttgtcgttgaggtgtttgcccgcctctttcaggaagaagaacgcggttttggcgttgaccgccgtcatctcgtcgtactcggcttcgctgatgtcgaccatcggttttttcagcactttgccaacggtattgat

SEQ ID NO: 42817 - DNA, 1569 bp, Heterodera glycines
atatttgtctctcatcagtatcataaggtataacaaaacaatgttttatcggctaatttgtaccgattggcgaactattgttatgtcatagtgaattttattgtttattaattatttaaaaaacaaacaaaaaatatttaccatctatacgcctatgtcctatgtacatagggttgagcggtaccggtaccggtaccggtactggccggcaattaccggtttttttggtaccggtaccggcacagataccgcctatttcgacaatgaaattacggttagaggttagttattttccgatatcgttggaaaataattgaattgtgaattaaataattgtgtcccagattttagtatataacagtagaacaatgacactttaatacataaatttttaaataatgcttcgtttcaataatgatgaaatactcattttaattttaggataagattttcctttggatgtttcttgatcgatcagccgtcaacatttaccaaataaaatatgaaaattctaatgcaaaaccaccactacaatttagaagaaccgccaaaattggtatcgcttcactaagcaatggacagaggagaacaacatgtagataatatgaattgcacatcattggatttaagaccaacaaaatcaattgatcatatatatttgccccaataatattaattgttaattaccaaaaatggaaaaataggacataagaagtcacaagggagacgggctaatccacaggcaatcttcagaggaataggatttaatccgttcattaaatttaaaacattttcatcctaagacaattattatgagcatttattatttttaagaccacaagttttttcattttcttaaatgttcgcttaatatttcggattttttgcaacattttagtcaatgtttcagcattttttcgtaaatatttatttaaatattttgggatttttaataaatatttgtctgagccctactcatctccctctgcaacacatttagcaaaaatttaaacgcacatttcagaagtttattgtgtccgttgttgtcgctcgcggcatcgtccattcgtgcacgacttgttcaagaaggcggaaagtaaagcatattcagtcatcccaatcatcccaatctcttcaatttgcctcaaaaaatgatcgcgccaaaacgtacatattaaaatattttttcatttagatgaaaaattgttaaaaaattgtaacaaaattttcaaactttgccgaaggagcctgtcggcagcgtcggagccaaaatcccctaatctttaaaatttcaaaccaatatcccggccatgcatgtagtcaccgtcaaacccaaaaattcctaaattttattaaaaaaattggctcaaaattgcaaaatatgcctattttacggacaaaatcttttatcaaataacactcaaattttcaaaatttacggcggcgcctattcgcaccgcggccccttccataataagtttagaaaagtaatacgccaaaaaattgaaattttgttaacagatcacatcatagttaaaaattttagtacaacattcaaataaaaaataa

SEQ ID NO: 42818 - DNA, 1462 bp, Heterodera glycines
  misc_feature (8)..(8): n is a, c, g, or t
  misc_feature (1406)..(1406): n is a, c, g, or t
taaatttntctgagaaagtaaatacttcaataggaaaaaaacttaaaaaacgttttttggaatttgtcttgttgacaaattcatccaaaagataaattttcggataatttaaaaaaaattactggcggggatttctaaaaaggttgccccccccctgcaattatttattcagcggtttcaaaataaatgaattattttttaataaatttttgaaaaaatcgctcaaaaatattcaaaaaaaatttttcaaaaaatttattgcgaaaaattcctctttttttgaaaaactgtttggccagacttgttcaatgcgtttccgcatttgttccgcattgagttgctgtttgctgcgcagattaatgctgatttttgatgatgtcgaaaatggtgttgtagttgctgttgttgtggatgacactgtgccaagcccgacacggtcccctttgaattgtgtggcgatctgtcaggcaaaaaaaaattctaataaaataatgaaaaatattagactttttcgcgaaaaataattaaaaacataaaaataagtaaacccttttggtttacaaaaaaatttctgtttaaaaagtcatgaagaagttgtcgggaattctcgaggtctctcttctgaccacaagtctgacatccatttggacaaactccgagtccctaacgcgaataattaaattttttaatttggctttttgttcgaatttagattagcgatccggaaaagacagaaacgtgatcagagacccagaaaagcgctggtggaaacaaaagatttctcgacttttagttgaccgaaaaaaaactttcaaccctccggtgcttggatgccctggctgtgcttgccgagcccttggccttccgcccagcccatgcccttgagcagcttgaagcctttgttctccgcattgattggcactgttgcagccgccgccgcggaggtaatgccaacgccgtttttcagctgctgttggaattgaacagagtccggagagtagcctaaaggaagacagctgtagaaattataattttttaaaataggattttttttgcaaagacctcaaaagaatttggagtgaatccagtaaaatagcacaactcagacaggcagaccagcaggtcgtccccccccccgccaattttttgaaaaaaatttcaaagtaaaatttttaaaaacagattcttagaaacttttttacaatacaaatttcctagcattttttcgaaaattttatgataaattattgtttttttcaaaaaaaaatttttttttgaattttccttaaaattttttctaacattttttgaaaaatttatggttttgattttttttttaaatttcagggggtatgacggtagtcaaaaaacgtcgttgggttgaaatgtgccacttcaataactcncccgtgccattatccattatggcaaaaaatcattttcaagtctcgccgaaatgagg

SEQ ID NO: 42819 - DNA, 1542 bp, Heterodera glycines
  misc_feature (38)..(38): n is a, c, g, or t
  misc_feature (223)..(223): n is a, c, g, or t
ctttgtttacctcaaacggccgcttcgcgcccgttttntagcttgttaggctgcttcgcagcctcagtcggggcgcttcgcgccccgttttttccaaatttgttggccttgtacgggcgcttagcgcccgttattttttaacttgttacctcaaacgggcgcttcgcggccgcttttttttttaatgtaggtgcttcgcagcctcacattcgggcgctcgcgnccccttttttttccaagtgttgccttataggaattataagaggtacaataaatggtagaagaggtaaaatagtgattagaagaggtacaaccagtgatcagaagaggtacaactgtgattaaaaaaggtacaaaagtgattagaagaggtaccatcaatgattagaagaggtagaagggtaattagaagaggtacaaaagtgattagaagaggtacatcagtgattagaagaggtagaagggtaattagaagaggtacggtacaaaagtgattagaagaggtacatcagtttaaattttatttttttacaaattcaatgtaaattgaaacatgatattctttaattttttattcaaaatttaaaaattatttttaataaaattttctccaaaaaataatttaattcaaatgaaaaatttttatttgttattaataaaattaaaaatattttaaatgaataaaaattgaaaacagaaaataaatggtagaaaattaatgtacaccgtccggatccgaacctgccccccccctcaaaatgatgcctcagaatcccaatcacacagggattctgaggtcttaaccatgtctaaagtaaaatctgattacgatattcgtgatcagcggcccaaataacccctaaaatcatattttggaagatttttggtgaaaaaaattttccactcaaaaatcctggtcacacccctgtggtcccgaatctcaaaatcacttttatttttataaaaattctttaaaaagtgataaaaatgtaaaataaaatttatattatagagaaaaaaattgcggatttttgtagtattttacttttcccgaatagcttttcagaaggcagctacgaatttttttctgaaaaatcgaaaatttccagaaattctggaataactttttttgtttttgtggtataaatttcaattaaatctcataaaattctcccgattttttgctattttttatgctttaaatgagctgaattggaccattttgaggcgagttatgaatttttaaaatttaggttgaattttcaagggccaaaaattattgaattttcaaaatttttttaccaccctccaaaaaatccaaaacgcaatataaagtgcatattcgtgttcagcccctcaaattaccccagaaaagtattttttggcaattttaggagcaaaaaaatttctcacgaaatgcaaatccatggggtcccccctttggttttgcgtttcaaaatcacaattaaagttataactttttttaaactcatggtaaaaataccgcagggaggacattagatagagctcgaaattctctac

SEQ ID NO: 42820 - DNA, 1109 bp, Heterodera glycines
taatctgtataagtttacagtaggaaattgtaatttagggggttattggcgatttcaaatcgatccttccggaacactgatgctgtttatatttagagcgtaacgagctcgaaaacgtcagaattcaaaaagtggggtcgcgaaaatagtaaatctcgaggttattcggcgcttatcaacctcgatccgtccgcaacacttaaacagtttatatttaaagcctaattagcagaatcgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctcaaatttacaattttcatgatcacttttgtgatattctcaatatttcaatttcttatatccaaatgtaaatatctgtataagtttacag

SEQ ID NO: 42821 - DNA, 937 bp, Heterodera glycines
cctttatacatcccattatgagcgctaaaattattagacttcacgaggatcgcatgtgatctaggcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatagcgctaaaattatcagagtgccgaaaatcgcatgtaatctaagcctagaaaaaaatggtttaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgaaagaaaaaatcgaattaccctcaaaaagcttctcaaacaattttagcgcttccaattccttctacaaacgcctttatacatcccattatga

SEQ ID NO: 42822 - DNA, 1534 bp, Heterodera glycines
  misc_feature (1521)..(1521): n is a, c, g, or t
caggccccctacagtctaggaaaaaaatatggatttccatataattccccgccctagttataacatgaaattgcaaaaaagtcaaaatttttgagttttttaaaataactttatatgctaattttttttctatttttttgtaaggctaatagagcatctgaggagttttcgaatgataccgagattgtttaatttggcccacacaaaaaaaaagctataatcaaaactcgggctggcgccaaaacgacctgctggtcccttaaatttagcccccaatttctttcactatttttcattcagactttcaaaattttaaagagcattttatcagctgtacatatatatttttacgcaacgacatttcatgtaaataatacatacgatcacataacaatgacaggaacataattaaagggaccgaaatagtgggaataataagacagcaatcacatgataaacagaggttatcgaaaggtcacatttcatctgaacacagcgaacgctttcaaaggccaaataaggcgagaatgtcggcgcgtccgccctcaacggcaatgtcgacagcgcttttgccttaaatggggggggggggagataagttagttgaagcatcacaattaacgcctttgcggtttacccaccgtcaattcccatatggtctgcgttcgcgccgattgccagcaaatgacgagtaatttcaatgttcttttctttcgcagcccacataagggcattgtatccgtccatgtcagcgtggtcaatgccggcgccgtgttcgatgagaaaaacggctgaaattggggaaaaattgagtcggcttttgtaccaattgctcttactaatgtccaagcgtccgcggatgcatgcgcctatcaaagcagtgatgccgtcgatcgcttgctgattgacgtcagctgcccactcgtccaccagtaaacggcacacctccaaatgaccattagcggcggcgttcaaaagagcaaatcgggtccctgaaattgaaaaagacacattaattagggcaataattattgagaaacgggcaaaaacccaccgctgttatccatctggtcaatgtttgcaccgtgagaaagtaagaagcgcaaaatttctgtctaaagaaatgaaaatgttttcaaattttgctgcctttctcacgtttccggaacgagaagtgttcattgtcggcgttgctccttcgctgtccccgagattaacgttgacgccattctccacgagaagggtgactgaaatggcaaaaaattttgatgagaaattagtccggacaattgcttcaccgatttctgtgctgcctttgtcacaagcgagcagaagcgtcaaggaggcgtcacttcccaagtccacgttggcaccatgagcgatcaacacacggcacatctccaactgcagcatattgacagcaatccacagggacgtaacggctgaaaatggggcaaaaggtgaattagccaacagcacaatcggtccgaaaaacacatttctcacccatgttcacatggntcacttgacgaac

SEQ ID NO: 42823 - DNA, 832 bp, Heterodera glycines
ggggagcgccccgaaaacaaaaaaatagattttttcaagtgaccgtgtggggtgctcacacaattatggggagcaaaaatccaacgcagaattaaagtacaggctatagggaagatactcccgaaggattcggtctcccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcataaaatccaacgcagaattaaagtacaggcaatagggaagctattcccgaaggattcggtctccccacaaagaagggcgcatcggatcggggggtctgccc

SEQ ID NO: 42824 - DNA, 1043 bp, Heterodera glycines
ctttacaaaattgtacccctggggggaaggggagcggacaacaatatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcaggaattcaataaaaataacattcacggtgcgaaaaatggcggtttgagaagtttattgcaggaaaaaagactttacaaaataatacccctggagagaagggagtgggaaacatgatttcaaaattttcaattttttctagtctatctactcaa

SEQ ID NO: 42825 - DNA, 1178 bp, Heterodera glycines
  misc_feature (446)..(446): n is a, c, g, or t
  misc_feature (598)..(598): n is a, c, g, or t
  misc_feature (601)..(601): n is a, c, g, or t
  misc_feature (746)..(748): n is a, c, g, or t
  misc_feature (849)..(860): n is a, c, g, or t
  misc_feature (862)..(862): n is a, c, g, or t
gggggggggggggggggggggggtttttttttttttttcccccccccccccccccccctccctttttttttttttttttttgggggggggggggggggggggggggggggggggggggaaaaaaaaacaacccaaacccttcttctctttttttttttttttttttttttttttgggggggggggggggggggggggggggggggggggggggggggggggcggggcccgccccccccccccccccccccccccccccccccccccccccttctttttttttgtgtggtggggggggggtgggggggggggggggcgcgacacaaacaacaaaaaaaaaaaaaaaaatacaaaaaagaagaaaaaaagagaaaaaaaaaaaaaaaaaaaaaaataatttttctttttttttttctttttcttttttctttttttttttctttcttnccctcctaaaaaaaaaaaccacacacccccacacacaaccccccccctgttttttttttttttttttgtttttttcgcccacccccccccccccccccccccccccccccttttttttttttttttttttataaaaaaaaaccccccccgcnccncccaaatataaatttttttttttatatatatagggggcggggcgggcgccccccaacaacaaatttttattttccccaccccgaggggcccccaatattaggggggggggggggaaaattttggggggggggggggggggggggnnncccccccccttggggacaagcgggggggggaaacccctctaaaaaaaccaaaaggggttttttgggggggcccccctggtaatttgttttttccccccccnnnnnnnnnnnncncgttaaaattaaaaaaaaaaaaatagttcccctccccccccaagtactagtcgaaattaaaagcctatctgtgcgatatatctttatatcactgtctctcgctgtcgcaatgttgtcgtctttctttctttctttctcgccttcagcgtctctattataccttctgttcgtctctctctttttctatgtcttttctctctctcctctccatggtttcctttgctgttctttctcattttcgttggaagcattttctttttatgcatccacagacatcttcttccatctctctgtaggggtatatataacatccaca

SEQ ID NO: 42826 - DNA, 1513 bp, Heterodera glycines
  misc_feature (1436)..(1436): n is a, c, g, or t
  misc_feature (1455)..(1455): n is a, c, g, or t
ttaaaaagtgataaattttgaattttatcaaaaaccatagggaggacccttttgtttaaaaagtgataaattttgaattttataaaaaaccaaaggggggacccttttgttttgcaaaatttttagaaaaaaaattcatgaatatacttttactcgccataattgtgctgttaatgtttaatattcattattatttataaaaaattttaaaaaattcgaccaaaaaaaagtgcaaaaaaattggttctgttccgctttatgcgtcccatgaacttttatgcgtcccgtgaccttttatgcgtcccaaagaattttatgcgtaaaaatttattaaataagaaaatgataataaagaaaagtacacagaaaatgctgagaaggaagacatttaaaaacactaaaaagagaagcaaacggctaacaaataagagcattaaactgggtattctctacgcatttcctccaaaatgttttggaatattttgatgtttgaatgataacgacgaaatgcgtactgatacaaatatgttggcaataagtcaggcgtagtcccatgcaaatgttttaggctttgttttaaagccctccaagtcgcttcaattccctgggtgtgtatttgagggttgtttgggtccacaaaatacatttggtggtttacccattgatggttatactgttgctgcatgttatttattccaccgtaagctgcccaaccgtccgaaactatcgtactgccagcctcaatattatcagcaataatcggaagaagcgttgctgcagtccggtcagcgacaggaaaaaaccttacacgattggttccacgttcaatcattccaaatacccactcataagggcgatttaacatcctccctcgattgtatttggccctatacattttggtctcatctatttctataacggtgcccatccctcctagcttcccttcctcttgtttcctaattgcccagtcctggcataaatctctaaaaaagttataaaaatcaacgatcgtgtctttgcgagttactccggtttctctcattactgcatccatagtgcttgttggatgaacagaccagtagtagcaaagtttcatgacttggtgtagagacagatgcacctggctgaaaaatgaaccaattctgatggaaaatcgacttgagctttcgctgccaggaattgcttttcgacaatgactgcatcgccacttaaaatcaatgttataagaatattttacatttttttcactataaagccttcagggctttgtgcatattttacaagtgaagcaacgtgctgctgacattctggacaagttaacgcattagcaataagtccataacgagcaagccatttgatggtttgctcgtatcctcaaaaaatcaaatacataatacttaatatgtgcataccggctggcccatcttctccaaganaatccctgacaagtatctncaaatttatattctccaatgcgaccaattccccgggaggcataacaggaccatcattt

SEQ ID NO: 42827 - DNA, 1385 bp, Heterodera glycines
  misc_feature (32)..(32): n is a, c, g, or t
  misc_feature (43)..(43): n is a, c, g, or t
atgattatcatttttatgtgctttttgtaatntattaaaaatntaaatcatttattttgactttatagcaattatttttaattctttatagtaattaattgttttattgtagattacaaaatgtcgaaagaattcatgatttgaatttattttttattttataaatatgtattaattaaatttcatttattcagttcagttcatctcttttatttaattaattgtaaaataattttatttaatatattttatctctttttactctttaatctcatggtgcaaagtggtttttcctgtcaatgttgaggttcgcttttcgaaattatttgattcgcttattattaattaaataatgatatgcttaaacttatgagtacaaattaaattgcctttattatttttattaagattagttcatttctcagtaattaaaaaagagttaaatttgttttaatgatgacatttttgaaaagtcaaatttcttttaatttctttttctttatctttctatttttattattttataggttgccttgctataaatcttgtgtttccccaccaaataattggccaataacaaaatactaaattaataaattttcgcaaaataaaagtaattttttaaattttttttattgtaaaatttttggtgtcttaaggtgcttaatacatgatttattctaatttaaattttattactattttgtattttttactaatttatttttttattttgtttatactttttggtatttttattttaaatttcaaattcgtattctcacgacgtagtcaaagaattgaatatggtcatttcaaagtattttaatgatttattattattcatttaatttttgtttattctcatttttaaatgcccatatttattagcttgcaaagcgtctaatgattatttattttctttataacgtatatttgtttaggaaaagcttttacaaattcgaatcggggttcggaataggtcaaaacggacgatttttacgctaaaaactcctaaaaatataaatttaaaggggtaaatctgaaggtaattaaagcaaattttgttgtgcagtggatggttgggcaatggaaaaggtgctgctacatttgcgcccctacatttgcgcccctacatttgcgcccctacgtttgcgccccatacatttgcgccccttacatttgcgccccgattgtgaacaaaaaaaatttattcatgaaattgcctttcccaagggctaacgggagtgattttatcaaaaaatcatcttgcacatccaaacaactcttgttttccttctcctttgaccgcataaagcatcaaaaggccaagatccgcctttgaatttttcaatttctggtcgccattgtttttgctttattaa

SEQ ID NO: 42828 - DNA, 856 bp, Heterodera glycines
ataacgccaaattagcgtaattggcgtaaattattgcgcgcttaattcaaaaattaccactggaaaaatcccttttttgtattttttattttgatccacccatacctcgcttccttccccaactaaagtgaacaaatttggtatctaaaataagaatttgaaaaggggaatctttttctaagcgaatgctaagcgatttaagtcatatgaaaaaagttgtgagagtttcaaattttttatcacgttataactcaagtcctaaactgctgatttcaaccaaaatgcgaaaactaatccattttctattgattctaagtgttcaaagtgattttgtagcctataaaccaaaattgttagaattagcgaatttgatgtttttcatgtgttagagacgatgaaaattagtacgccaaaattagaggaaaagaaaatgcaaaattttcatcatcccttaactttaaaataggatagaaattcattaaaaccttatagaacattcgattcaaaatttttttgtctatcgatttgcaaaatttaaagaaaatctgtaaggcgaaaaaaaagttctatagagcgaagtgaatgttgtttttttacatcattaaaatgaagagatagtacgccaaagaaagagtaaagaaaaagagaaacgacgagatagtactaggcttttctctgcacagtggagttgacccatagtgaatactgtgctttgtccccccacccttttcgaaaatattttttttgtttccaaaagtcatgaaacatgtttccaagggtttttggggttgctgatcacgaatccggcattcttttcgaacaattccgaccccgggcctgaattcgaacaaaaagt

SEQ ID NO: 42829 - DNA, 1305 bp, Heterodera glycines
agcaacatattaattttaaattccaacgccaaattacaacgataattttctctgtcttcaatttcttcatttcctttcgccaggggcggagcaaaagcagtcaaaatagctaaatttcaaaatccattgtgtaaacgatggaaaaaatgctaatttatcgtttcaaatacacccctaagaatcgggcgaaaaattttaaaaaatacacccctaagaattgacttttcggatcggtacccccccccccccaagcccaaatcctggatacgtccctgggtgctgccggaaaaaaaaattgaaaattgggagtttttggtagcattttttacataaaatatttaagaaatctgaacaattttcgtcgctaccccaaaatcagaacatttcttataaataacgcactcttgctggcgctaacgaaatcagatgattaaagtgaaaaaaggaagatttacgagcatttaaaaataaaaattgagtttttcgttaaaaaattttcgtagatcactacccgatcggggtccccgacccccgacaattgagctcccccccgacccgacccccgacaagccgcccccacaggaccccgttcctcttaaactcgcccccccagggcccgggagatagaccatgataacaacagcaagacaagtcaaagaagcaacagctgatccacaataatattaaaaagaggaccgacaacacacacccgaacgaggcatgactatggaaaaagaacccctaattgataaaaaaagatcatgagcacccaaaccaatgaaacataaacgagtctcatgcgcgacaaaagaaacggacaaggcataagaggcccaggactcacgcgattagaatcgccaaccatccactcacaaagaaaaaaaaaaggcagaaaagattgaggattaggcgtaacgctcagacttagaacctctcaaaaatcggcggatacgatggaaaatgacccaaaaaatgagaaaataccatcatggcgagcttgacattaaaagtcataaaactaagaaaagttaataactattaacaaagacgagctgaaaaagtgatacttacttgaaaactagaaaaatagaagaattgaaacctgatgatcttactattcagactatttaggcaattcataccgcagtctaaacgaaaggccacacgagaactagagggccggatgggactaacaccctgaatacccggcttattcgggccccgaaaaatcaagagacccgcctaaaccaatccaaacttataaatccgaaagctcgaacagacagagctgatgatggggctccc

SEQ ID NO: 42830 - DNA, 686 bp, Heterodera glycines
aagagacctacaaacagattacatttaataattagaattgcaaaaaataatcagtgttaaggccttcagaaatccgacataaaaataaaattatttttattttactttgcttttttaactttaattaattaattttttaagtattgtgtttctatgggaatggtgcatattttatttgaaatttagaagagtcgttccactctcccatctttcaaaaaattttcaagaattttcttttaatttttcctgaaattattcgcagctttttaatatttgctgaaaatattcaatttttgctatggaaaattcattttccacaattttcggcaatcagaattacacaaaataatgaactcaactaccaaatttggcattaatattttgtcaaattctgaagtcaaaacatcatttcaaatagatatgaacactaaaaatcaaaattagttaaaattaaatttaaaattattttattttatttttacataattttcagatgctggcaatttgtccactttcgcttctcctttttctgctactgatcttccgctgtttccatgcatttctatgggtgattcgggcgatttgattaaagcaaatttcggaccgaacttcaaattcgacctcaacaaatgccgcaaacaatcgcaataatttcatatatttttgtaatttttcacattttattt

SEQ ID NO: 42831 - DNA, 870 bp, Heterodera glycines
  misc_feature (864)..(864): n is a, c, g, or t
atttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaanaatttt

SEQ ID NO: 42832 - DNA, 990 bp, Heterodera glycines
aaattttaaaaattttttaattgctttttaaatatgccaaaaaattttaggcttaactttttagtgaaagtttgatcactcatattttttgctaattgagcagaagcataccaaacttttgcagggatactccccgggtaaaggactaacttaccactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggcgagaccgaatccttcgggaatagcttccctatagcctgagcccccccccccccccctcccttcttcccttactctttttccctctttttctttcccttttgctcctcccccattttacttttcttttccttctcattttctctttccctactctttttatctcttttctctcctttccctccgtcacttgccaagttgttctgataggaggtcaccgcgatgaattccgtttcggcaaagctcgtcgtt

SEQ ID NO: 42833 - DNA, 1127 bp, Heterodera glycines
ccgattttctaaaagccgaattgtttggcggatgtgtttctgtcaccgctccgcgactgatcacaaacgaacgcgacgatttgctaatgagccaagcggtgctaaagtgtcgggcacacccgctccgattgaacgcggacgcgcatatcaccacttcccttcggtggtggatgttgacattggcactcgcccgacgcgcactcaaatcgccgtttgatgatcagcggattcaaaccaatgcgagccgaagtgtccgcacaaaatccgtcgactcgtttggcacgggatttataaccaattcgaatggcgcgacgttcggcggttgtgcttctaccaccgtcaaatggaaatggcatttctaaaggcacgcgggccttgacttatgaggtggatacagtagggccttaccatatctcatctttaatgattactaaaaacactagattaaatctttatctcgcgagaaatgtccgtgcgattatgttgtaaagtccaaaggcaaaaaaaaaggcttttaatggttccggcggaaaattttccgattatccgttacgacaattgctcatttccattttattttttatcaataaaatgtttaaatattttaataatttagaatgattttaattggcttaattattattgccttcgtgactttttgtcttctgttgagtttcattgggtttaggggtattttttggttatgctgtcacaaatgataatgattccttttttaagctcgttcgcgctctgcctctgtgtatgagcgctcccgtcgtgtttctcaaactggcactcgcgcacatgttattgactttgatgaaccaaatacaagtgccggagcaaaccctgttcgtggtggcggtggcgggcgttttccaattgacgatgcaatgtggttgtccatgtttcgccgcttggtgggtttaatttaatttaatttttacttaaagtttatgtttttttttgacaaaaaaaattttgaaaacgaattttttaaaaaataaattctattttaagctttttttaaatttatttatttatttttttaaatttattttttttttttattttttaattttattttttttttaattaacttaactatttttccaaattaatcaatg

SEQ ID NO: 42834 - DNA, 1005 bp, Heterodera glycines
  misc_feature (25)..(25): n is a, c, g, or t
aggcaacttggttggtaccaagttntgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgacaaaaaagagatagctattttttggtcaagaattttttttgtttgcgtttcaaatatcgtaagattgtttgatagggccagacaagagaaggcaactgttgttaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaatgagaaaaagagatagctattttttggtcagaaatttttttgtttgcgtttcaaatatcgtaagattgtttgatagggc

SEQ ID NO: 42835 - DNA, 725 bp, Heterodera glycines
ttcgcggcctcaggacgggcgcttcgcgcccgtttttcaaaatttgttgacctacagggattataagaggtacaataaatgggagaagaggtaaaatagtgattagaagaggtacaacagtgatcagaagaggtaaaatagtgattagaagaggtacaacagtgattagaagaggtagaagggtaattagaagaggtacatcagtttaaattttatttttttacaaattcaatgtaaattgaaacatgatattctttaattttttattcaaaatttaaaaattatttttaataaaattttcaccaaaaaataatttaattcaaatgaaaaatgtttatttattattaataaaattaaaaatattttaaatgaataaaaattgaaaaacagaaaataaatggtagaaaattaatgtacaccgtccggatccgaacctgccccctcccccctcaaaatgatgcctcagaatccccaatcacacagggattctgaggtcttgactatgtcaaaagtaaaatctgatcacgtattcgtgatcagcggcccaaataacccctaaagacatatttttggaagatttttgtgagaaagatttttcaactaaaaaatcctatccacccctttggtcccgaatctcaaaatcacttttatttttataaaaattcttaaaaaaatgatacaaaaaggaaataaaatttatattatagagaaaaaaattgcggatt

SEQ ID NO: 42836 - DNA, 880 bp, Heterodera glycines
  misc_feature (28)..(28): n is a, c, g, or t
  misc_feature (834)..(834): n is a, c, g, or t
ggggggaaagaaggggtaggatacaccntttttattcatctattcaatttagctaaaaggagtgaaggggatgagagaaagagagagagagagagaaaagtgataaagcaaagaacggataatttcgtaagggtttttattcggcgacacaattttctttctaaattgtctatgcatcttcgcaacccatccttcgttccgtttaaaaattggcgttctgatgcatcggttccgccgtgtccaacaaccattggtccgtctgtacccatttggtgcccacgcgctgtcgccgctgcatgtgccttaaaatttggcattcgctttgaacattttccaattttacttgttcagctgttttcgcctttctgaattaaaaaagtttagttgctgagaggaaaggaaaagactcgcccgagggcataattaagtagagaagacgcgagcggaggggcatccgcgcgaccactgcgtcgagggggcgacggctgtgcttctctgaacgggcggctgactcatcagtttttgcattaaaattgtgtacaatgcaatttcattttatttttatgatcgttttcattttgaacaatttgttttgcatcgataggctctgccgccgaaagaattttcgaaaattcaaaaacattttcaaaaatatggcgtgactttcgccgttttccttctgccatttcctttcctcactttgctcttccttatccaatcccttcgctctgtcaaattcaatcgcccgcggcgcctttccgtttgccgccatttcctttctctgcccatcgatgggttcgatttggtcctcgtccaattcctttggcattttanaaatgtttttttttctggggcatttcttccccccccccccccccat

SEQ ID NO: 42837 - DNA, 1174 bp, Heterodera glycines
  misc_feature (31)..(31): n is a, c, g, or t
  misc_feature (37)..(37): n is a, c, g, or t
tcaagtgtccgtttggggtactcaaacaaantatggngagcaaaaatccaaccgccagaattaagtacaggctatagggaagctattcccgaaggattcggtctccccattaatctgggcccatcggttcggggggactgccccgaaaaaccaaaaaaaatcgatttttccaagtgtccgtttggggtactccaaactttaaaaaatgagaaattccatgcgaagatttttctggaaaataagcttaattagggccttagttaacctgttaaaaaaaatttggggcgatttgaatgagaatagaaaagagccaggttcgatgaagttttggtaaccgaaaaaaaaatcctaacgtttaaaaatgaaaagagctagagcttgattagtaaaaagccatcgagagagccttatttaacttgtacgataaaatttgatgcgtttcagagccattttctgaaaaaatatttatgattaatttttcaaaaaataaataaacagttaaaaactcgagaatttctaaaaaaatttaaaaccaattacaattgtcattttttcaggttaagttagtcctgtaccggggagtatgcctataaaatttggtacgattttattgattattgaaagagctagaaccgaagaaaatctttttaatttaagcctaaactttttggcatgtttaaaaagcaattaaaaattttattcatctccctttttgatagtaaaagcatcagagagccttatttaacttgtacataaatttgatgcgtttcagagcactttctgaaaaaatatttatgaattaattttgcaaaaaataataaacagtgaaaaactcagaatttctaaaaaactttaaaagttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaggcatcagagtgcctaaactagcatgtaaataaaatttggtgcgtttcagagcagtttctgtaaaaatacttatgaattaattttgtaaaaaaataaataaataatgaaccctcctccttaataattttcctgcgcccaaggtctcactcagcctcttcgcggcctc

SEQ ID NO: 42838 - DNA, 1046 bp, Heterodera glycines
tcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaacttcacgattcaaaccaattttcgttgctctaattaaccgcgataaaaacattcgaatcaattaaataacttctgagataataaggtttatcataaaatttcatttaaaaataaaccctcaattattggtatgaacgatactttccaaacatgcacgcgttttgcgctcgagctattcatcatcgggcttgtcaatctaaagcgaaacaacaaagatggtgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgaaaagaacatccgaatcaattaaatagcttctgagataataag

SEQ ID NO: 42839 - DNA, 852 bp, Heterodera glycines
aaaaatgctctaccctctcctcccctttttcccttcctctcctcccccctttccccccacgccctccgccctttccccttccttgttcgttcgttcgttggtcgcctttccactgcctctttgatcgcccacccatccgtcatccctccacactttcccacatttgatccttttaaattttatccaaatcattcagatatattcattcgtgcatcacaatctctgctgtcattcatgttctccgccacctctaccaccagcgacagcaacagcaacagaagcaacagcaggttatccaatccgatccgttctcatcccatcacatcacatcaaatcattagacaactgaaatttgaaagagaatttgacaaaatttgagcaatgaaaaagttcaagcaacggatcagcaaagcatttagcggaggcgccgttgaggagagagaagggcaaatgcaaattcaaattgggacggagcaacgcgggcacgggggagtaacgccgagagagaaggctttccgaacgcagcagcggcccccccacccccagggcgattccatcgctcgccaattaagcgccgcctctttcgcttcgtcctcctcccaatttttccccggctcttccgtccccgtggacccttttatccctagcaaatatttcccagcaaatgatttttcgggatggaatcggtgagagaagaaaaacaaattcgaatttggcattttgccatcagcaggagcagataccggtggagcttatcagactcattgtctcatataaatgaaagaattgggccgatgactgtgcaagaggagggaatagcggggggagagagtgccaaagggggaaaagcgg

SEQ ID NO: 42840 - DNA, 1005 bp, Heterodera glycines
  misc_feature (74)..(74): n is a, c, g, or t
  misc_feature (89)..(89): n is a, c, g, or t
  misc_feature (160)..(160): n is a, c, g, or t
  misc_feature (162)..(162): n is a, c, g, or t
  misc_feature (257)..(257): n is a, c, g, or t
  misc_feature (364)..(364): n is a, c, g, or t
ccccatttttcgcaccgtgaatgttatttttattgaattctgaaccggtttcaacgaggagagtagaaaaaatngaaatttaagaaaanaagtcttaaaatgggttataaaaggggtattattttgtaaagtgttttttttgaaaataaagttttaatanantattttttgtagagtgaatgttatttttattgaattttgaatggttttgagtagattagaatataaaaaattgaaaattttgaaatgatgtttgnaaatttatttttttaggggtattattttgtaaagtgttttttttaaaataaaatttttaaaaaatattttttgtagggtgaatgttatttttattgaattttgaaangttttgagtagattagaatagaaaaaattgaaaattttgaaattatgttttaaaattatttttttgaggggtattattttgtaaagtattttttttataaataaaattttaataaaaaattttttgtaatgtgaatgttatttttattgaattttgaaaagttttgagtagattagattagaaaaaattgaaaattttgaaataatgtttggaattttattttggaaggggtattattttgtaaagagtttttttttttaataaaattttaaaaaagaatttttttaagagtgaatgttatttttattgaattttgaaaaggtttgagtagattagaatagaaaaaattgaaaattttgaaattatgttttgaaatttatttttcaagggggattattttggaaagttttttttttaaaataaaattttaaaaaaaaattttttgaatgagaaagttatttttattgaattttgaaaagggtttgagtagattaaattagaaaaaattgaaaattttgaaattatggtttcagttccttttcccaggggattattttgtaaagtcttttttccccaaaaaattttcctaacccattttttccaccgggaaagttattttttattgaattttgaaaccgttt

SEQ ID NO: 42841 - DNA, 748 bp, Heterodera glycines
tcggttgacagatcatcagtcagcgttttgttgtacctagtcaatcaattaataattaattaatcaattaattaattagttattaattattaattaattattaattaagtgtttaattgattgattaattgattgattagcattgttttgtttgtttatttgtgattaatcgccactttctccgtcctttttctttcttttcttctgtcccatttttctcttctcctcccattttcattttgttttctcttttccgattgatctcatcgctttttcaccgtacaaaaatgtacaaattattcgaataaattataaaaaaacaataacaaatcatttcacatataataaaacgaatattggacaaatcggagaaaactttacaaattgaaaatggacaaaatgagaaaaagggaagaaaggccgaccgattctttgggaaaaagcgcactttattcaaatgttcgtccgttggctcccatttggccattcgtcattatttcccacccaattgtccaattgttcactcattccctctcaatggctcttcgtttttttggcttttgccccccccccccgtaaatttcctttttttgtccgcttttataagggatcgtttgctcttaatgcatttccgcgactttcattcgctgctgccaatgattgaaatgaatgagaggaatttcatcgtttgcggtcggccttccctttgccctttttgtttaattgactgaatttgaaaattggtgcc

SEQ ID NO: 42842 - DNA, 1181 bp, Heterodera glycines
aaagaaaagaaagaggaacaaaggaatgatgagagtaaaaaagaaaaaggagagaatgaagagaggaagagcaaagaagaggagaagaaagagagaaagagcaatcaagaagagaaaaaagagagtgatgaagaaaaagaggaagaggttaatgaagaaaagaaggatgagagtaaaaaagaaaatgaaggagtgaatgacgagaggaagcgcaatgctgacgagaagaaagaaaatagggaagaaaaacaggaagaaaaggaggagaaaagggccaaggaagaagaaaacaaggaagagagtaaggaagaaaaaatgggagagaggaaggaagatgaaaagaagaatgagagtaaaaaagaaaaggaaggagagaatgaagagatgaagagtaaggaagaagagaagaaggagagtaaggaagaaaaaaaggaagagaataataaaaaagaaaaggaaggagagaacgaagagaggaagaagagtaaagaaaaagaggataatgaaactagggaagaaaaactggaagaaaaggaggagagaagggccgaggaagaagaaaagaagaaagaaaaaaacgacgaaaaagtggaagagaaaaataataatgacagcgaggagcaaaaagtcaaagataaaagaaaggacaaagaggaagaaaagaagaaagagaaaggcggaagagaaaagaaaactgaaaatggggcagaggaggaggtcagttttcaaaaacaaacaaaaaaacaaaaaaatttaccaattcagtcccgccgtaaggaaatgggcacgaacgcgggttatttgtcggcgaacgatgaatgggactgagatggacaagggatcagcggaggagagagagcgaagcgattggaggagagggagacgagagagacgaaatgatcggcgcaggagagagatgagagagagagagagagaagagagagaaagagagagagagacaaagtgattggaggaaaagagagacggaaatgaatgtttaatttttgttattttaaatgttttgattgaagatttgatttttaaaataaatttattctttattttcgtacaaatggcatataattaacgaatttttgacttccccgtccatttgtccctccgttcgccctttttttcaccgcttttccgcgcccttttcgccgacacttttcgccaatttt

SEQ ID NO: 42843 - DNA, 980 bp, Heterodera glycines
ccaatggtatataacatatatgaattttccgacttacagttcgggtggttcccttgttagtataggagtaagggattttagtgtgaaaaactttgaagtattattttaaaaattttgtcattgttaagagcatgattaagcctaattctgccgaatctgtcccggtcaactgttccgtttgtagtcgaaagtgccctcattctgacgtcaaatgttgtgaaggtgtttttttataaaatattagaaaagaacaaaggttgaatctctaaaaataatgaaataattaaaataaaataatatttgtgtttttaattaaatgttaataattcagcttgtaaacatgttttccgtcgctcaatttcgtcgatgaaggaatattattgcaaaagtgccggagagtgcgacgtcgaaaaaggcagaaaatgtacataccgtatttcctaaaatacagaccccccccttcctgaaataaaatgaaaacgactgtcccttcatcttcttcctgctcatccttaaatatgttggtttgcagccgtaatgatgggtccgacgatgcatgcatatcgatcaacaaatagccatagggacgtgcggtcgctttccgataggcgtcaagaaagaagtcgagctgacgcggaaacagctgaacgcctatgtcgcggatggacagcagtgaatttggggcgcgcatcagtaccaagtattgggcggacgcggacaggcgggccacattgatcttgcgctcaaacaaattttgagtgacaaacacaacagcaaactggtgatggtgagcctttttagtgaacaaatcggacaagtatcgctcgtcgacggacagcatctcgagtatgagcaacaagggctttggaagacgtttgattaattcttcagatggcactcccgggtacacattgactcccgccttttgaagcacaggcaccgctgcattcattttcacaaaacagtagagcatggacaca

SEQ ID NO: 42844 - DNA, 1326 bp, Heterodera glycines
gtcagcacctgtttcaaaacaaatcggcaacactttaataaaataacaaaacaaaattaattacgacgataaatttaaaccgaaacaatttataattaaaagacgagaccacaacaattcaatgagaagaagtcagcatcaaaagaaattcaaaacaattccagagaagacaagacaaaaaaccaaaaaaagaaccgaacagtaaaaaaaactcactaatattttaaggtccataaaaaaagaaaacaaaacgccaataaatataattcaaacataaaagaagtcaaaaggtcaattaagtaccacatccccatcctctgaagaagacggtcccctcgtcttagaacaataaatatgaaaattgagaaattgagaacagaaaggtggggtcaaaggcatttatggcttaatggcgacggctacggctactgtacgctttcccatcactgcggctttgagtgttgcggctcgagcttggctggagagaatatggatggacccgatgaccccgagaaaaatgatgaggacgatgaattgacaattcggaaaattgagcgggtacagaagggagtgagcgagaagaacgacgaatgccaaggaaattgtcatcgggaaaaacagaaatttgagtgaatatccatgccctgaggcatttcagtccttcaggcagaatctttccgtacccgtgtcatgtcgaaagtgtctccgaatctccacatttcaatcaaactcctgccattctcggtcagcgcaatgaaccattctgcggcaatgtgctccaatccaggaatcaattcgttgtactgtgcgtgcttttcacgcacatacggaggcgggatccacacaaatcaaacatgttcaaattgtccgcaaattgatttgatgcgtttgtccaatgcgcggatcacgtctcccaatgtcccttgtacggtgccgatgaagtgagcaacaatttggttatttgtttaagcacacagtagtgcagcgccagagtcttctataatcactctcgtctgatggaccaatgttgttttgccaatagcagcggttgcgggacttttttcaatcatcatgtgccagcattagatcctatttcgcatgtaattgtatcgcgttaccacacatcagaaacagaaattgttacttgtaatcatatgtggtcgaatctcgtgtgtttcaatggcttgagagcagatggtcatgtgattgccccatatttgcaaatgaattcggcttatatgattaaggggcaaattcccgatcacacagcatcaccccgttattctacatattttaagagatggaaatcaggttcggaagtcaaaa

SEQ ID NO: 42845 - DNA, 1494 bp, Heterodera glycines
ggtcttccttggcttcttcgcccctcttcagactttcatggcgggtgccaaagttccggctcaataggctcttcccaatttttgagaaagtcttctcccgggcggaaaagcagaggaaaggcggcgcgttcttcggcaccgtactccgttgatttcttcggcacttcccggacttggcgaagctaaaacccgaacaattgaactatttgcatagcaaaaaaacaaaaaaacccacctcgattgttgatattctcgcgtacagaatcgggaacctccaaatcgggaaagacatgcaaccgctcgaaacaacgccgctgaacaactcgattccgagtcaaaaatttaaaacacatttttttctaaaatagtgttgaattttaattaaacaattcatttcctctcgaaaaattggagtgcttttattggccttctgtcgtatttaaaacatttccactttttccttaaattcggatttgtattttattaaggacattagctcaatgttcaacaattcggcgattttcacatcggaaaattttggagtttcctttttcataagataatattgcttcattatttccattttttcgacaattgtgaacctttttcgctctgtaatatatttaaattgaaaaatttattttaaatttaaaaataaaagtttaattgaatttaccttttaaattagtttgtttaattcctaatttcttggccatttttcaatcgtccaataactcacaccaaacatttgtttaatttttgcattaaatgccttccattccttctgcgaatgttttccattttgcataaatttaatttttacttttaaatatttttcaacaatttctcttttttcatcatcagttttttgatttttcaccatttttccatcttttatttctttcttccatgtataaatactgctgatatttgtgcccaaatgttttgctattattttttggcattttttcttttttccttccaattttccatttaatttcatttttaattttgcatatatttgatcaaattgctttaacattattcttttttcttcaactgaataatttttgttcgtcatcattccaagttcgctcttccatttgtaaattttcattttatttgcacctaatttttgtgcaatttttctttcaattttattccattcttttgttgaatgtttctttcccatttgcttaactttctccttaattttatgaaatttttccacagtttctcttttctttttatcaattgcttttgaaaaattatcacaactttgtccattatttgttggcattggcaattgaccgcccaattcatcacaatttgtggacatttcatcactctcttcttctttaacttccaaatgatcaaattgtcgaacattttgtccaaattggttattctgatcagcattttgtcaataaattatttgatcaattcgacaaatgttttcttctgctccatcgtcccatttttgaccaaatattt

SEQ ID NO: 42846 - DNA, 1016 bp, Heterodera glycines
  misc_feature (793)..(793): n is a, c, g, or t
  misc_feature (841)..(841): n is a, c, g, or t
ggtaattgtctaattgccaagcaatagtttagaaacagcttctaaacatgtaaaaaaaatgcatttcaattatatcttcttttaccccatatatttgaaattttcaattattaaactacatattaaaccaaaaatatgtgctgcttctatcccattagtgtactttgggccgttcaaaatatcaacaaattacgttttgttttcgatttcttccaaatattctgccgctacacaaatatttttcttcataatacaataaaaacaaaaaacaaatattttatgcaaaatttatttttgattcaatttaatttaaaattagggtcatgaattgattttatatctttattggcaaaaaaataatattgaaaatgaattatgaaagtcatcatagccaagaatctccgctttgcctcttcagctatagtaccgtatttgctctaattatcccccaatctccattaatcctccaatctccaattatccaccagtctacgaggtggttgaaaaataatcccccatgggggataattagagcaaatacggatgccaattgtttctcattgggcatagtttttccaatcccattctaacaaaaattaaaataataattattatttcaaaaaacgaaaccaatgactatggttaatagaaaataattttataaaaatttcatttcttaagaaaaaagaaaaagtaaaatcattgaaaatataagataattaattattgaagattttgcgcaccctttaattaattagcaattaatatttctgcggaagtttcacattagaanatgtctttctcatttctaataagtccaatgtttttattcatcatgccnaatcacaccaccatcattatcatcaccataattactcattaccatcactaatatcattcatttcatttaaaaccaataaaaacacaaaaaaatgtctacaaaacttcattgatgcgtaggcgagaaaaatatacaaaatacaaaacattcgctgctcatgactgatgccgctgct

SEQ ID NO: 42847 - DNA, 1716 bp, Heterodera glycines
  misc_feature (1649)..(1649): n is a, c, g, or t
  misc_feature (1680)..(1680): n is a, c, g, or t
tgttttttccgtttttattttaccaatttctaatttaaatttcctgggtgacacaaacataagctcaccctccccaaccattatcaatattttaatcggcggcgcggcgtaagtctgttagcattgtcaaccaaccattcatacaaatgacctccctccccccggtcggatttttcgcgacgttcggtatctcccacctcaaatttattatttttaatttgtttcgaactttcaatttttcattcacatttattaactctgcaatttaaattaaattttattttacaaattcaaaatttcccactatttttaatttccattttctaatgtatttaatttttattttccatttaattttaattggttttcaatccgttccaatttatttattatttttaatttatttccaatttaattactaatttattttattttccatttaatttcatttttaatttttttcattccgttccaatttatttattatttttaatttatttccaattttaattcctagtttattttatttttattttcaatttaatttcatttttaatttttttcattccattccaatttatttattatttttaatttatttccaatttaattactaatttatttttattttcaattaatttcatttttaattttttcattccattccaatttatttattatttttaatttatttccaattttaattcctagtttattttatttttattttccatttaatttcatttttaattttttcattccattccaatttatttattattattaatttattttaatttccattttctatatttatttatttctacaattcaattaaaatttaatttccaatttaaatttaaaaattttttaaaatttctccttatttacaatttctaatttccattttctctatttatttatttccacaattacattaaaattaatttctttaaaaatttttaaaaattaatcgaccatttttaatttattacgcaacaataatacaatacagctcacgaattgtttattttaatcatgttatcataaattttcttatatttccttttgaatgccccacaacccttcacccatcgaggtaggggaagtggggcattgtccgtcgccatttggccactgtcgcgtaacattttcttcaacttttcaacctccagtcccacatctgccgattccaaattcccttttttgcacacatcctcccgaccttcagtcccgtcctccaccatctcccccggggcagagcccatctcttttttcgcttcctctgttgtttccgccccatcagtttcttccccgacctctgcttttccttcattcgtgccctcagtcccggcatttatcgggagctgttgctgcaattcttcctccgctcccttcttttcgtcctctttcttttcctccttttgctccttttctcccgcggccgtagccattcccgagacttttctcttccgctgtcccgtctttttcatcttttcctctttcttccgctctctgtactctttgccttctcgatatcgctgccaataatcatttatggcctcttcacagttctgaatggggggtgggggatgaagaaaaggatttagaaatcagataccaatccccgacaggtatccaatcgatgnggtccttgggaaacccacccactttaccagntagtggtggtgggcgatgacgcgcttttggccacat

SEQ ID NO: 42848 - DNA, 939 bp, Heterodera glycines
gggtgggggagctcaattgtcgggggtcggggaccccgatcgggtagtgatcaacaaattttttaacgaaaaatccaatttttctttttaaattctcgtaaattttctttttttttcactttattaatcaaattcaaaggttaactagcgccagcaagagtgcgtccaagttggcctttaccataaatagaaagaatcaaccgaaatttttgctattttgcgaaggggtctgaacgtcgaataggacgacctttttttgctttttcaaaaactgttttttttgcggcgtgctttttccaaaaaacttttggaggaacaaatgggtccggcggtgccgctaggcgccatcgggaaaaattttgaaaatttgattgacatttgttaacagattttgtccaaaaaggaccaatttttgcgattttggaataatttattaagaaaaattaatactttttggtggcaggaggtgccgataggtgccgccgaaaagtttttcggaatttttaatgaatttattaagaaaatttgttcaaaatctcaaatattttcaatattttccccttcgtggatgaattaacctttaaatttttacaacgctcggagtccccaatcccccgaattagtgtcggggggtcggggggcaaaaagtcgggggtcgggtaccgccggggggcacatgtcgggggtcgggtcggggggctcggggtcggggctgaaacctacgtttttccatggaaaatcatttcatatattaatggcaagtaaatacttgaaaaatagggcaacatgcttaacaattcaagcgtgcttgaatttaattatgtacttgaaaattgcccattctgccgaaaggtcaaaaaattcgacaattttaattaaaaagtaaaaacaattttttttcttttttgtatatgatgagaattttcttgggattttaag

SEQ ID NO: 42849 - DNA, 1330 bp, Heterodera glycines
tacatcccattatggagcgctaaaattatcagagtgccgaaaatcgcacgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatcgtgatctaagcctagcaaaaaatggtgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcattattttttcagaaagtgctctgaaacgcaccaaattttatttacaagctattttaggcactctgatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgctcagaagcgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatgaataaaattttttaaaatttttaattcctctttaaacaggccaaaaagtttaggcttaactttttagtgaaaattaatttactcatttttcgagtagtgctcagaagcgcacccaggttttgcagggtaacagctgagaa

SEQ ID NO: 42850 - DNA, 550 bp, Heterodera glycines
attgcgcaccgccctctctatcatgctctagagcatttgtatgtgtgtaaaatttatcaaaaaaaaagatagccattttctgggataacctctaaatataaaaatcctatgtgagaattaaatcggcgattgtagcacacgtcctcctgtctcatactgcaagatgcttttgtgaggtataaaatttctcaaataaaagacatagacatttttctgggatagagatataaagttaaaaattccctcaaaaataaaaggtctattgcgcaccgccctccctatcatggtcgagagaatttgtctgtggataaaatttatctgaaaaagagatagccatttttctgagataacctctaaatataaaaatcctactgtgaaataaaatggggtattgtgcacaggcctcacactcatacgcaaacgctctttgagaggaataaaatctctcacaaacaagagatagacatttttctgggatagaggatacatatgaaaatcccctcaaaaaaatgggtcaattgtgcaccgtcctccctatgatgctcaagag

SEQ ID NO: 42851 - DNA, 953 bp, Heterodera glycines
ctttaaaagctaatcaggcatttaatattttatataaatggtataccaaatgtagtgagcttcggctaaacccctgcgggcgttgtccacctctctctctctctctcttcctttgtctgtctctctttcctctctttttctttgtctctcttccctccctctctctttctcgccctctttctctgtccttttcatccgtttcccttcctcctcatcatttgtcatcaaaaaacgtgtgttcttcgcctttcagccatttactatgtttgtagctattctcaccctccctttgttctctgaaattctatcggtattgcattttattttgcatcaattatggtacagatgtctgtctgcctgtctaccatctaaattttaaatcatttgtaaatttagctttttttgtttataaagaaataaaatatttttgtgttttttttgtttctactaaggatacacttaatggaaaattactatttttgtgaagaccacatttcgcaagaattgacctcaagaatcggggatgaatcttccttttgtcctacttggtcacattaacgaaagcttaagctctggaatttataaatacaagaaagagcaaatttcgaaactttttgttcgaaatcggacccgggtccagaattggtcgaaatggatgcctaattcatgatcagcgatcccgaatgttgcaatcattttgactaaatttaggttgttttgatcagtttatgaacaaaagagcgaattttggatttgctttttgttcgcaggtccgggattcgaaattagtcgaaatgaatattagatttgtgtcccctagggctggtcgggaccggggcgggaaatcccgaaaaacagaaatcccggtcccggttttgccagtcccggtcccggcgggactaaacaagcactggtaagaatggggtctgggtgagaaaatagaggggaattag

SEQ ID NO: 42852 - DNA, 922 bp, Heterodera glycines
  misc_feature (788)..(788): n is a, c, g, or t
tcatcagaccaaccgcgccgagtctcaacttgccgggatcaaactcgtcatggggttgaagtttccgggcgaagattatcacaaaaacgtattgcaaatgttggccaaggatgtagatggattggaaaaatgggttgatcataaaaaccaagaggcggaacactttgtcatttatgtggaacacgctgcggaacacgctgccaagaagcagattgacgcgctcacgtcacatgccaaggtcagcgggagaagtggctaatcaaagattggtgtcaatgcacgacaaattctgaaatatgaataataatcatctgaaagtaatgtctttttggaaaccgaaaagttggattatttggtctgaaactccagacaccttacttggtctactattgccacttttccccaaaaaatgtatttagctcctcctaggaaatcgccgccggattccccagtttccacataaaaatatcggatttgacatttaattttttttgttttttttcaaagagtcgtgctcaagttgtggagctgtgagaattgggggtggtttaatgaagtcaatatggcagggcatcaggcgaatgatgttcgagaatttcgaaattcgaatgacctttgatctgagaaacatgaggatatagtataaccgggggctattattgggctttccacaatgaaattcttgccggattccacgttgcagcataaaaaacttaagaatatttatttatatttttcatttttgtcagactaatcttgatatggtggcatcgtttctttcgaattgngagcagttccatgtgagcgccaacgcggcagggcatcgggcaaacgatgttgagacgagcgaggcgattgtcccgtcgtctgacgcacagattgagcgactccgtcagcttgagatgcgtttcacactttcatc

SEQ ID NO: 42853 - DNA, 986 bp, Heterodera glycines
gtcgtatgtctcagttttgttgccaaactgctgtttaaaattttgtcgttttatggctgagacgggattttgtcgggacgggattttgtcgtttttagctgaggcgggattttgtcgtttttggctgaggcgggattttgtcggggcgggattttgtccgcgcgccaaattttgcattttttattttcaaatcccaaaataagcacgtaatgctgaaataagcacaaatcttagaaataagcacattttaggtttctaagatccggcccctcaaaataagcacaaatcttagaaataagcacacttgggagccctgaaaataaaagttgtcattgtttaaaagtttttctttcacaaattaggaacttgcataaatcaaaaactaaatcggtcattgaaatcaagacttatgaattgttcataaactcaaatttatttttaaaaaattcttgaatttttgcttgggacggagttggccttttttgtattgggacggagttggtgacggagttggcgggacggagttggctcgggacggagttggcctgggacggagttggcgggacggagttggctgggacggagttggcgggacggagttgacccctaccgcatctaaactattaccaaaaataatttttattcactgattgctagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagattgccaaatttcgaaaaaattctcattaaaaaaaaagaa

SEQ ID NO: 42854 - DNA, 1306 bp, Heterodera glycines
  misc_feature (12)..(12): n is a, c, g, or t
  misc_feature (23)..(23): n is a, c, g, or t
aaatttttattntttttcataancaagaatttttgattaataaattattttcaatacttaatttcctaattttttttatttttttgaatgttttgtcattttacactcctaaaaatgaggttttaatgcctattttctatttttttagagcctagcgcctacctatttttgcagtttttagaaccttaaaatcttatccctagttataatttagaagagcatttatctgtctctttatgaaagcatttctatttgcgaaactttgttcgtctgcatcaaagtaattttaacaagaattattttagattagctgattttaaattaattgtaattggataaattttaatataattgagaacataaaaatgaggtagatacattaagacaaacgttgctctgaacaaaattaatttgggggaaataaataattataaagcccatataaaaataaaatttcaaaatttatacactacattttccgtaacccactgacttacgaattggcgaaattgcgatcaggaatattactgatcaggtctctgaattaaaaaaataaataaaacattatcattaattatcaacatttttacccacgcaaatattggcaaaaggtagcttgcctaatatgaaataatttaaaattaaataaaaaatttagataaaataaattaacttacccagaccagtaatggtagaaagaaactcgaatgggcggggctcgttcctttagaatttgttttttcatagaaatttaataaaaagaattgttttaccatctaggtttctttgctgcaatttcatgcagttttatgtttgttgtacgtttcttttttatatttacggaaaataattggtttaataaggttaattaattttaaggacaaattaaaggaaaaaacattataaatattaaataattttttttttttcaaggtttctgattaaaaaatatggcataaataactttgggtttcatgagaaatcgtataaaaggtaattgacaggaaatttggacaatgaaatcattcgacgaataaattggacaaatatacactatcagccgtcggactcgctcagttgggcgcgcacggttgggcgctcacgtttgggcgcgcacggttgggcgccagcacgtttttccactatagcttttttatttcttatccaaatccaacaatcttgatatcattcgaaagctcttaacatactctattagccatacaaaaatcaaatagatttttaagcctagaaaaaattttattaagaaaaaatttcaaaatttcgactttttcgcaattttcatgta

SEQ ID NO: 42855 - DNA, 889 bp, Heterodera glycines
tgtgagtgtttggtagagccaagactagagaaggcaaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttt

SEQ ID NO: 42856 - DNA, 640 bp, Heterodera glycines
accgggaaccgggaaaaacaagcactggtaagaatgggggtctgagtgaaaaattagagatgaaaattggagtaaaaagaaaaaatttagaaataataattaaatatattcgataaagtaacaatccaactgtgcaaatgacctaatggcttgtctccttgcctagtaatcccaaaaaccagcctttttttgttgaaaatctgttaacaaattacactcaaattttcaaaattttccccggcggcgcctatcggcggacgggcacgactgggccccgccgactgggccccgccgactgggccccaaccaactgggccccggattaactgggccccaccaactgggccccaagagacagtaatttttccaccattattgtataatattatttatatatttttcattacatacacataggtatgtgtgtttcgtttacaataatctaatttgtgtttatatttttttcgttcagtgcctaactacaataactttccttcagctattttttaaatttaactatcatttcatggcaaataatatattatcgcagaataaccacaaaaaaaattgagcatgaagggcatctttatgttttcgctaacttagtgcggatggttttatcaaattttggaggtgtgag

SEQ ID NO: 42857 - DNA, 1178 bp, Heterodera glycines
gatccacgtaagaggccccgagcggcggttcaaatccggccttccaccccaatttttcgcctaaataatagttagtaattattaattgtgcttgttgtgacgtcgaacaccacatattattcgccatgctaattagggagcgcagcatactgtaaaaataatggggaaacctggcgagaatacggtagcgtctctgtatgacgcagtaagcaaaggttgtttggggagaagaagcccagaaaaatgccgcgcagctttggcaattattttatttgtgtaccatattcattttgaattttgtgtgtttcatgcgaaagcaattggctgtttttgtcgagaaacctgttgcataaaaatgtgccataatgagaagggtggaggcggggattggggaacataaaaaaagaaaaaattaacaaattatacaacgaacgacgtacgaaaagtgaaatggaattttaaaattggcaaaatgttagctgaccccaaaaatgccagccccagccccgggcatcgacagaattctcgcgatttaacttggacctttaaagtgccaaatattgtgcatcaattcaaaggtgtattacaggatatgactctggtttgaccggagtctcggtttatttaaagtacaaatttaaaaatttttaaatttcaaattcattcatgtaaatttcttagaccgaaacgattagtgtatttgatcaccgatgaatcgttggcatgatcggaagtgatagatggattaattttgtcagaaagtaaaaaatgcagtgatagaaaaaggaaaaattagtgattggtcaattcaacaccatcaatcagttgtgatccgcggtcatcgtcagaaacagcgtcaaactgatcagaatccgattgctgcgatgtgtccggttgatcagccgccaaaaagtgctcatagtcaggaacagaattataaccaccattggacaatgcgacataaatttgtttggcacaaattctgaaatcgcctcgtaaatgccaacacagtggtaaaaggtgttgaagtaggtatgcaaaactaaattcaattaaagattaaattcttaaaaatttacggcgacgtttagtccgggcgatgtttcggcagcgacgtttttgagtgaatcgacggggacgacgaccccaagggggtggcacgtacgacgtacctcccg

SEQ ID NO: 42858 - DNA, 920 bp, Heterodera glycines
cgtcaacccaatgagaaatgactaacagaaaagaggcagtaaagggcattggcttaggaaaacagcttataataaaggagagacgagcagacgatgagtgagagaaaaatagtgtaaaaatggtcaactgctgcattggcagagtcagagaggggtcacaaagagctcgcacagcatcgaatatttccttcattttgggcgtcattcttccccactgcacttctttcttcggtttaattacccaagtttgaggtacttggcgtgtcctgcacataatatctgtggcatggaataaattttggaactgcgctgcctaacggcgttgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccatatctgtggcatggaataaattttggaactgcgctg

SEQ ID NO: 42859 - DNA, 1163 bp, Heterodera glycines
aagaatggatctgacacttgaacaagaccgcgagtggtatatctcattcattcgtgacaatgtaccggagcacctcaccgaagcagatctgtcgcatgaagttcatttgggggcgtttaatctagcgatgcaaatgtgtcatgcattgtctacaacagatttgaatcccgctccaaaggacatcagctttactagaccattcacaccggcaagtactcagagataaacgcctctatcggattcggtctgaggattttttaagcattttcagccataattgccattttgtaccgtttaattgggtacttatacacctacgccacattaattctgatagttatgtcgttttctggggtattggggtggccgatcaagactatgacagtgaggttcatctatttagaaccacggatccgatttcgaacagaagttgaaaattacttattcacatgtatagttcataacagattcaagtgcactcaatgcccgtgagtctctattcacagctaaacgcctgattgggtgaatcggtcatgtccaaaaattgtgcttaggtcgaaaagttgatttaccccctctcatgttcgatttcgggattcggaaagtttaaaattggcagctgttgggggtgagttatattacaatgtgagagtttttgtatacggttcatttccatactaaaaacttggcccgctgcctgcagccgatgcgcgtacacccctgggtgaattctgtcgggaacgttcgttggatgtaagattgaattatgtttccaatttcggttttattttatatccgggaaaattttttgtaatttcgttctgatttgttaacagattttcaccaaaaaattaccaaattttgccataaattttatatttttttttgtaaaatagtgacattaggccataaatgggaaaaagccattaatttttgtttgaaaattgttgtgctttttgtattcaaaagattttttgactgataaaacatgggaaaatcatataataaaaagatttatttttttgcgtaaaaatttcggaattccgcgacacataagcgggaggagaaccgatctggggtttccggcatttttggagtcggcacaccaacaagtttgctcgtttttgaagcccagaaattccaatttccgaattttttttcgc

SEQ ID NO: 42860 - DNA, 958 bp, Heterodera glycines
  misc_feature (29)..(29): n is a, c, g, or t
ctcaaccgtatatagtaatggcgttttcnggggaaaaccttatgttgaaggctgtaggcaaaagagatagccatttttctgagaatatctattcttagttatggagccattttccaaccgaccatttgtagggctcaaccgtatatagtaatgcgttttcggggaaaacctcatgttgaaggctgtaggcaaaagagatagccatttttctgagaatatctattcttagttatggagccattttccaaccgaccatttgtagggctcaaccgtatatagtaatgcgttttcggggaaaacctcatgttgaaggctgtaggcaaaagagatagccatttttctgagaatatctattcttagttatggagccattttccaaccgaccatttgtagggctcaaccgtatatagtaatgcgttttcggggaaaacctcatgttgaaggctgtaggcaaaagagatagccatttttctgagaatatctattcttagttatggagccattttccaaccgaccatttgtagggctcaaccgtatatagtaatgcgttttcggggaaaacctcatgttgaaggtgtaggaaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcggggaaaacctcatgctgaaggctgtaggaaaaagagatagccatttttctgagaacatctattcttagttatggagccattttccaccgaccatttgtagggctcaaccgtatatagtaatgcgttttcggggaaaacctcat

SEQ ID NO: 42861 - DNA, 702 bp, Heterodera glycines
ttggcgctatttgcaaagagtaaccttttgaaattttttttcactttttttggtcaatttttttttgtttatttttacacataataatgaatattaaacattaacaagacaattatggcgaatgaaattataattatggcgaacaagatcacagaaagcataaataatagattttcctttacccaaaaacccatcctttttgttattgttttttgccaatgtcattttgttaaaactagagtagagcgggaccgggaccgggccgggaattcccggtcatccgaggtcccggttcccggattttgaaaagctcaggtcccggtcccggtagggcaaccgggaaaaacaagcactggtaagaatgggggtctgagtgaaaaattagagatgaaaattggagttaaagggaaaaaattaagaaatagtcataaatatattctttcaaagaaacaataccattactgcaaatagcctagtggctagtctccttgacttttcccttcttctttcccctggttcaatccctctacagaaattaaaatattttgaattttctttttgtatactcatggcgctttcctatcgacaaaatatgattcctcatagttttttttaattgtattttatcattttttaaagaaaatccgtaaaaattgagcctagtaatcccaaaaaccagccttttttgttgaaaatctgtta

SEQ ID NO: 42862 - DNA, 1333 bp, Heterodera glycines
  misc_feature (13)..(13): n is a, c, g, or t
  misc_feature (39)..(39): n is a, c, g, or t
  misc_feature (53)..(53): n is a, c, g, or t
  misc_feature (152)..(152): n is a, c, g, or t
attgggtcactcncacaaattgttcaaattacactgttnaaggtgagcaattntatgctttttcaaaaattgtgctgcgaatgatttattatttgtctttctccaattgattttttaaaagattttcgacctgttcaaatgctacgagtgtnggaaggccacacatttggagcgaattatgtcccgtcgaatggacagagaaacgcgttctcgtcgagttcgtttggataatcacagcactcaaaggacaacgacatcaaaaacagtggaagttggggcagaaggctcaacgaccaaccaaagcagaataaaagctgagggcggcgagcacagtgacgatgaggtgaaaaaacaacaaacgaataattacgaaagagaaattttgttttttattaaataaaaagccaaactcggtgcatattctttaggaaagtacgcttccatgggctgggttaaccaagcaattaatttatgccttttcagactgtcgccgatgacccgggcgtggacgattatcgcactttgtgcactgtgcgcatttccttcttcaagggctttggtctcagctacccaaaacggacaattcaggtactgtttatgaattaggagctgttcgctttagccatcccactgttccccatttgttttacgcttccattaattcccaggaaacgccttgttgggttgagctgcacctgaaaagggctcttcaattgctggacgaggtgatgaacactcctctgatcgaccatttgacttagcctttcccctcatttttaacatctcaactcaaatttccctttcatacggaaaactcatcaagtaatttgtgcggaaacacactaacgaagagcagacacttcgaaactaacaattaaggcctattaacacaaattccctcccgccatttcgagtacaatttaagctgggaatgtgatgatcacttccacctgacctaacattttcaaattgtttctcttattttttttgtcatcacatttccctagttgcccatctctttcattctcatcaactgtccacctcattaatttatttattgtttcaaaaatttttaatttgacattgaatcgatgtggtaacattttttgcgcacataaatttacacacaacaaaagattgacaaagcaaacggaagtaattaatcattggggtttttaggtgcaaaaattttttgggagcaagaaattgcgacgcaaaacaattacccactaaatagtaaattcaaaaaacaaattccgagcaccatcttatttatcctttttggactcctctagaacatcttcatctcttacattcgatgcttcttgttcgg

SEQ ID NO: 42863 - DNA, 1102 bp, Heterodera glycines
  misc_feature (1021)..(1021): n is a, c, g, or t
  misc_feature (1080)..(1080): n is a, c, g, or t
gaatctagttaaatttaggtattttaagcataaatttttttataaacccatgaagtacaataatcatgtatgtgcaattggaaattttagagtttttcattaatccgattactttttttgtcgcttcaaattcatagaaaacattttacccctaaatttttgaacttcatgaattcttcaatatgggttctcatttattagacaaaattttaaaaaatcaaaagtttattcttgctgtgttctgctgcccaaaaggcataagatttttttacaatctatgacttacaataatttataagtgtaattctaagttttagaatttttcatttatccgtagacttcaaaaatttaaattaaaaatttgtttttttgctgttgttatgctgctactcacctgttgatgtacaacactggcacatccagtgctgcagttaagcttaaaaacactagtaacatgctgttgatttgccaccgggtcaacgggtgcatcaacggcgcattcatgtacacaaatgcgtaggtcagttggccaaatgtccaaccgcaaaattgcaggcaaagaatgatacacagcgagcggaagatggactgacgagcatgaacagctgagaataaattcgaattgaaaaatatttttaaattttaaatgacatacatgaaatttattgtttattgtttattcataaaaaataaaaaataaaaaagtcatcagaagaacgaaaaccacttactctgacgactattccggtaaatgtgtcgtagagtaagtgacaaaatatatggatgatcacaggaattaaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcanagggaatgaattttttgcccagtttgtattttgtgttaaatctataaaaggggatgttnaaagcgtgctgatggattaaaa

SEQ ID NO: 42864 - DNA, 1040 bp, Heterodera glycines
  misc_feature (27)..(28): n is a, c, g, or t
  misc_feature (33)..(33): n is a, c, g, or t
  misc_feature (53)..(54): n is a, c, g, or t
  misc_feature (101)..(101): n is a, c, g, or t
  misc_feature (108)..(108): n is a, c, g, or t
aaaaagtgattttcttcatgtgatagnnatacnacagaaaaacagtagacacnnagcagaataaatcaaataaaacaaatgattgaaaattaaattttctntaatcanataaataaatatcatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaaaagataaaagagagagagagagagcagcaattgactttgttgtggtggatttaatttgaaattagtgggacgaaattcccgttaatgacaaaccgagagcacaaattgaattctcgaaactctcgaacagtccaatagaataagtgagttcaaaaaagtgattttcttcatgttgataagataacacagaaaaacagtagaacaacagcagaataaatcaaataaaacaaatgatttgaaaattaattttctttaatcaaataaataaatatcatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaaaagataaaagagagagagagagagcagcaattgactttgttgtggtggatttaatttgaaattagtgggacgaaattcccgttaatgacaaaccgagagcacaaattgagttctcgaaactctcgaacagtccaatagaataagtgagttcaaaaaagtgattttcttcatgttgataagataacacagaataacagtagaacaaccgcagaataaatcaaataaaacaaatgatttgaaaattaattttctttaatcaaataaataaatatcatctgaaaaatgaagaaaagatgagaaatatttccaattttacta

SEQ ID NO: 42865 - DNA, 1102 bp, Heterodera glycines
tgctttttcttgtgccgtttttagcatttcctttaccttttggtcaattgtgctttgatcagttggctttccccatcatttttcgcgtttcctcccccataatttgctgctttaaatatttgttcaaaattttgcatagaaatgaccgaatttttgaatttgaaggcattttctattttgtactgattgtacctgctgaatttggcatcaaaatagaatttggctattcggtttagctgtttgacgaaatcaattagtgtcccgaaattttcaatatttcggataagcagcggcattaatccctgtggttgttcgtcatctgaaaaaaagcaaaatttctcggcccttccctaagaaaagcacaaccttcagtgtacacacagaataaatagccgtacaaaatgtccaaatattttcggtatttttggcattccgtctgcgtatgctttccaaatgctttcccaatttggcacagtgccaatgctctctcatcaactgaactgtgccaagatgggctccgtatctttgtgccaaatgctcctttctctgatcaaaagtgacactttttggcaatcccttgtcaaacaaatagttgtccttttcctgtatgcaaaaatgctcaaaattggattgtcccttaacaaatgcgaggaatgccttgtcatcaatctaaattattttatttattttttttttggttttcatttgattgagaaaagcatcgggatttctaattagccttggcgcaattaatctttttgatcagcaccaaagcttagaacataatttttttttaaagtatttgtttttgtgggtaccgagtagggctgtgcgagaagtgatttttaccgggaaccgagaaacgagaccaagaaatgaccccgagaaacgatacgagaaacgagacctaaaaaacccgagaaatttctcgactcgagaaatttaatgaaatttattcaaacctattttttaaaattaaaaacacattaaaaagagggtaggtcaaacggaatttttgcgtaggagtctcaacattaaagtgacggcatttttttttgcttttaaaaacgctttttttgcgcactttttccaaaaatttttt

SEQ ID NO: 42866 - DNA, 907 bp, Heterodera glycines
  misc_feature (868)..(868): n is a, c, g, or t
aaacgctctaaaaattggctaattgttgaaaaagtgaccggatcagtgattggtcggctttcatcagtttgttccccctgctgaaggtgttcaatgacttggaaaaatggctgtgcgagttgactggctacgacgccttctcacttcagccgaataggcaaaaaataaaagcaaagaattgaaatggcaaaactgtttaattcagtggggccaacggcgaatacgccggacttttggccattcgtaaatatttcgaagcgaaaggggaaacgcagcgaaaagtgagtagggaaacaactcactcacttggagatttggcctcattagagaggaaatttacgattaaatactcactaatctgtgcattgattccccccccccccccgaaagatttgtttgattcccatctccgcccatggcacaaatcccgccactgcgcacatgtccaatttccgagtggtcccagtggagtcggacaaacacgggaacatcaattacaaggacctctcagcaaaggcacgtgggagaagggcagtggggggaaaggcattgaagcatttcagtgtgaaaagcacggggcggagttggcatgtgcgatgatcacttatccggtaggattttagttggccattgccaaattggcctccatttctagtcaactcatggagtgttcgagtccaacattttggatgtgtgccacaaagtgcatgagtttggtaatggcgctctgtttgcccattcaatattatttagcgttattttcccaggaggtcaaatttacttggacggtgccaatttcaatgcccaagtcggcctttgtcggcctggcgattacggaagcgatgtgtcgcacttcaacctccacaangtgacagaaaagtcatcaaagcataaactttaccctaac

SEQ ID NO: 42867 - DNA, 1195 bp, Heterodera glycines
ttcagcgggtttaaaaatctagaaaaattagtaagcatttgtagtgctccgatacgtatctctgcaaaatttggtgagccgctgatcaattacaaattatttatggacgatcaaattttttgaaatttttttaagtgcaaaagtggatgggtgtctgcaaaaaattttcaccggagtttaaaaaatctaggaaaataagtaagcttttgtagtgttccgatacgtatctctgcaaaatttcggtgagcccctgatcaattacaaattatttatggacgatcaaatttttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaataagtaagcttttgtagggttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcatttgtagtgttccgatacgtatctctgcaaaatttagtcagcccctgatcaattacaaattatttatggacgatcaaattttttgaaatttttttaagtgcaaaagtggtgggtgtctgcaaaaaattttcaccagggtttaataaatctaggaaaattagtaagcatttg

SEQ ID NO: 42868 - DNA, 865 bp, Heterodera glycines
  misc_feature (600)..(600): n is a, c, g, or t
atcttcgtcgcactcactcattgtgttttattttttacgcatggtaaactgatcgtccgaccagcctacccgtccaccactcactcgtcgccccacctccaccaccagcagcagacacagcagcagccattgtcgtcgtcacattcctccgcaacagcagcaccagcaacttcggcgacgacggcgaagacaacgacgacgacttttgtgcccccttaaaaaatttttatttaaaatgatttgtcgctccatttttttcctttttggattttgtaaattctgatgattattgttttttcgatcagttacctacatatgtttatgctgcgcctcaattttgtgtggaacttttgcaatctttgattcccgcacccaattgttttttgccttgaaccaatttctaccattcttttgtgaatggtccaatttaattaatttattttaattgattgattgctttgtccatccattctctctttctctctcgggcaaaagggtcattagcaattagagttcacagagttcgttctcacattcccatcgattcatcttctccctccccccttcatccgccgttgttctcatcctcctaattgatcngcctccgtcatccctctccccccccacccccgtccaatcattcattcattatctcatcactattcacccccctccccaacatccagttctacatacatacatactgccctcaactgacactgccccccgccttccccgtccgttccccgcgtcctctcatcgccccatctttcttcttcaccgatcacaaccatcatggacatgcattctctcactcatcatccccccaccccgcccccctaaaattctttcatcaaatctccaa

SEQ ID NO: 42869 - DNA, 988 bp, Heterodera glycines
  misc_feature (883)..(883): n is a, c, g, or t
tctcagaaaaatggctatctctttttcctacaccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctcttttgcctacagccttcaacatgaggttttccccgaaaacgcattactatatacggttgagccctacaaatggtcggttggaaaatggctccataactaagaatagatattctcagaaaaatggctatctcttttttctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacaccttcaacatgaggttttccccgaaaacgcattactatatacggttgagccctacaaatggtcggttggaaaatggctccataactaagaatagatattctcagaaaaatggctatctcttttgcctacagccttcaacatgaaggtttccccgaaaacgcattactatatacggttgagccctaccaatggtcggntggaaaatggctccataactaagaatagatattctcagaaaaatggctatctcttttttctaccaccttcaacatgaggttttcccccgaaacgcattactatat

SEQ ID NO: 42870 - DNA, 1128 bp, Heterodera glycines
ttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcatcactggggatgctgaacctaaagctggtggtgaagttggtattccttggaaagtactatttattcgattttaaaaagattagactgaagattactaaaaataataaattaattatgaaattatgaaattatcgaccagattaagactgaaatgctgaatttcgtattgtatgttttatttaagcaaaaaataccgaaatgattccctcgatttgaattttaaaaaataaagaaaaaactactggtagaaaaaacaccgataaaaatacaactaaagaaaatatttaaaatttgccacatcataattcttttttatgggtgatttctataaaatccatcaaagcggcatagaaaccttctttatgcccgaaaataaataaatttaataaaaatagccaagccaaaggtatgaaaataattaattctcagtcagaattctttactcaaaaaaagaacttattttcgtgcttgttattccccggaaaggaatttatgaaaaaaacttttttgttactttgttatttgcataattttgccaacgggaatatttttcaccaggtatttcgaaatttttttttgttgttttttttaattttctggttattcgttatcttattatttattattattattattatttatttattttggtacgagacattcaccaacgactcccatttttgacccatataaatttttcccgccggcggtggtcttcgctcgcgggcggaggttcatttttagtgcagcgaattgcaatgcatagaagacagtttgcctgccttttagtaaatgata

SEQ ID NO: 42871 - DNA, 981 bp, Heterodera glycines
ctgaattgctgacctacagcgctattagcgtaactcacttataaagaaatctcatattgatcggtatctgcggtatcccgaccggtagtatgccgatcgtatttctaaaatcttcaatattacctgacccttatgtagggaacagcgtcttattgaggaggagaccaccctgctatatatattttttattattcctgattctaggactacccaccatgtgactgaaatatgtaatggataacaatatagagtgtaatgcaagttatacggatatggagatctctacactatttctcttttactctattatctctgactgtctctctctagaacacactactcgccctactctaatacggcccctccttattacagacaccccccaatgataccaattagagagatgaggaaactcaagaagaatatgaccattttgtcatctattttctaccctggacattcaaatttttggtggaaattcaattttactgcgcttttcattttgataagtggttgtgctctcgtaaccagttgccttaacttctcgggagcaggcccactagtactatacagtaattgttttaaattttttatcttttgaatgctttgtgaattttaaactgacgatggacaacacaacaaggacagactttttgacactgaactcatttggacaaaagagcacaattgggcagctgacattacggcagtgaatgaattttttctattataaatgacttttgcaatgaaaacatatctatttttaaatgatcatcagcgtaaatttctcgctcgtgttgttttttattttttgacactgcgctgaagtgatccctgctctaaaactacctaaattcagaaaatattttggcattaattaaaaaattggtataatcaactcggattcggaaaatatttaatcatattgatcaaattcaaaactttccaaaattgatgattttaaaacagccaataacgatg

SEQ ID NO: 42872 - DNA, 953 bp, Heterodera glycines
  misc_feature (94)..(94): n is a, c, g, or t
aaaaccgcgaaagacttagaaatgacaaattttcgttgaatcaaaatcaaaaaggaaaaatttattcagaaaaacctcatttattaatttcttntaatttgagaagctttaattatttttgtgaatacgaaaattttttgaaaaaaaatgtttttgttaaggaaagattttttcaaaaacttcgtgcttcgaaaaaaattgggcttcgccttcggctccgagtgttaagccgagcttcgcccagccctgatagagatagagaaaaatatcgaacatttttattgcttatttaaattttttaacgctcgatctaaagcgcttcaaaaacaaattttctaacacattttttttggtactttcctgttatgaggaggccaaacccaaaaatttaaaaaaatcaacaaaagggcgctatttatgcctcctcaagtgtcatgcgcttgcttgattttgcgcgtcattttgttgattttttttttaatttttgggtgtgaccttaaaacaggaaagtacccttttttctaatatctctaattgattaggcatttgcttagaaaaagctgtaaatgaggtaaaaactgtccttccctcggatgagagaatttctttgttctgtaattttcagagaaagtaattttattttgataaattattctgtgcagcgatgtatggatttaaattaatcagatatatgactaatcattttgaactaaaaatgttgaatgagcatagattgatatggagctaaattggacaatgaaaaaccaaatgccaatttacgacatgattttgctgttggcaattgatacatattatggatgccaacaaatgaaaaaatgttctgatttgtcagaaatgttctgattttggggtagcgaccaaaatttgttctgattctgatttcttagataaactcatatttttgaaattttgtgggcatatgttactttttt

SEQ ID NO: 42873 - DNA, 888 bp, Heterodera glycines
ccagccctttttgctccgccgcgagctgctccgctactgttggaatggtagaggcggggggggggggggagcacaacaaacacatacggctataccaatttatgcatttagatgtgaaaattttgcgcaccgcctgcctgcgcttccgcgagctggtgggggagtgtgcggacggcatggaaccctttctggccgcaacaacaattgccagcctggccatggctgtgttccgccagcaccacctccgccccaacacgatggtgcacacgccggagggcggattcctgcgcggacgccgagcatcggtggagtctcggcgcttcttcacgctgctggccgccgtacggcccgacctgggcccgcttcgcactgcccgctggtccatcggcgaagctgttgtggggaacagcgggcgctcctaccaccgccgccgccgcgacaacaacagcaccaacagctgtgccggcgccgacgatgacggattccggctcgactgcgtggcctaccgtcatccaccactgcgaccgttgtgcatcgagttcaacggctgctacatgcacggtgggagacacacacacacacacacacacacacacacacacacacacacacacacacacacacacacacacacacacacacacacacacacacacacacacacacacacaacacacacacacacttacaataatgttttaattctgagctcaattaaggttgtcgggagtgctaccccgaccggcacatgctgttggcagggggacgcagcgcggagttgctgtgggcgcgcacccagcaacgggcctgggagctcgccgagctgcacgggatggaggtgctgtcggtgtgggagtgccagttccggcgcactctgcgcaccaacat

SEQ ID NO: 42874 - DNA, 1284 bp, Heterodera glycines
  misc_feature (27)..(28): n is a, c, g, or t
atcccttttgaaaatttaaagtacacnntttttggtaacaaaattatgaattcagagagatgcctcccgccaaaaacccgaaaacatgcaatgattatgtaaaagtcgctttccgacagcgttttatccagggaatcgcccatttccaatcacagccataattacgtccaaaaccgtattattaaaaacgtacctctccatcaccttggcaatgaatggcatttgcatctccaaactgtgttcggcctcctcattccgcacggacatccattcgaaggagtcggcaccattggccgacctcagctgctcattcactgacaatgaacaaaaatgcgatgagcaattaaaatgcagaaattcagcccatccgacccctttttatgataatttccctcttaaaacctgcggtgtccacgaaaaggtcgcccaaaggagtggcgtatttgctgcaagtggtcaaagcgcagccggacaaataaacgacgtgggaagggccgagcacgaaaatgcgctttctgagagggaacgaacgcattgaaaagggcggaggagttaaaaaaaaggcacaacattttgtccggcacaatttgtttgaaggcaaatgctaaaagggaaaatggcaaattggagaaaaaagtaaatggagagaaagagaaaggcacctgcagtttcaccgcaataagtgtacccggcatgactgaaacagcaaatgaataagtcaatgccaaaacatacggaagcgaacacaacgcctaaatttactcccccccccacaaaagtggaaatttggtaataaaataaatgctaaattatgacatattgcaaatgatgcgactaaagtgcattcaaatcaaaaccatttccaagtaaatttcttagttggtgagggttaaccatccgttttcaaatgagttcttaatgcagggcaattaacgtgctgattatgcgaaactgacggtgatattatcgcacgcgctgccccaacggtcggaccggccgcgttgagccaattcgtcagctgacggtccaaccctttagcgttttcggaataccttaacatagagagagggaaattgatcattctgatgcgtcggtcgtaccacgacccggcatgggaagccggtcggactcggtcctcaaccgcacctccgttggtcccattgaaagcgctgtcgtagttcatttccgttatgctattcgatcaaattcgtttggtcagcggtcgacggagggatgagcaaacaacgaatgaattatataatgaggaaaatgagacgcgctaaa

SEQ ID NO: 42875 - DNA, 1069 bp, Heterodera glycines
  misc_feature (1039)..(1039): n is a, c, g, or t
acaaaaaaatccgattttttcaagtgtccgtttggggtactcaaacaattatggggagcaaaaatccaaggtaaaataaaagtagaggtatatcgaagctatccgaaaggattcggactccctataaatctgggcgcatcgttcagggggactgagactcagaattttgaaaattttttataaaaattatttaaatgaactgactagctaatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaatttggtgcgtttcagagcaatttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatatcgaagctattccggaaggattcggtctccttataaatctgggcgcatcggttcagggggactgccccgaaacccaaaaaaaaattttttggataaaaattatttaaatgaactgactagataatatttaaaataggttatttctcttcctttcagtatccctgncaagtttggtgcgcttctgatcagtttctg

SEQ ID NO: 42876 - DNA, 1144 bp, Heterodera glycines
  misc_feature (1070)..(1070): n is a, c, g, or t
  misc_feature (1077)..(1077): n is a, c, g, or t
  misc_feature (1116)..(1116): n is a, c, g, or t
ttttgtatagcatctaaaatctcccttttcctattctctctaattaattgtaatacatttcagcgaatttgtctcttttgtccgccttttctcctcctttgctcccgcctcaacagaattcggtccttccgccgatccttccctcgcctattcctcaacaaatcgttccgttgagcaaggaaatcgcctcgcagggccttttgcccgtcgaaggctgtcgtccggtcagtagatcaaagggatagtcgggaataaataagatgtttttaatttgggtcaccattggtaacagttctgttgtgtaattttgtcattttatttgcgtttttaataaaaattcatgcataattaagcaatggaagacacaatttgtaaattattaagcatttgggaacgtcatttttaggtagaaaaatgcagaattaagagaaagaagttacaatttgtaaattattaaggagtggaagatacaatttttattatgtgcacgaacttgtcatttttaggtagaaaagtgcataattaaggacattaacatgcatgcagaattaagcaacggaagacacaatttgtaaattattaagcatttgggaacgtcatttttaggtagaaaaatgcagaattaagagaaagaagttacaatttgtaaattattaaggagtggaagatacaatttttattatgtgcacgaacttgtcatttttaggtagaaaagtgcataattaaggacattaacatgcatgcagaattaagcaacggaagataaaatttgaaaattattaagcatttgggaacgtcatttttaggtagaaaaatgcagaattaagagaaagaagttacaatttgtaaataattaaggagcggaagttgcaatttgtataaacttaaaaacgaaattgtcgtttttaggtagaaaagtgcattattaaggtaacatacatgtgtttaccaataaatgtatgctgactgactgcattcatctcgaccatcattgttgtcgtcaatttcttcgtcctcgtcaattctgccaaatcgtttgacatgaattgagtcgtcctcaatttccgtanacaattntccaagccatcgttccttgtattcgtcatccacaatttncattagttccattgggtagtatctgtct

SEQ ID NO: 42877 - DNA, 952 bp, Heterodera glycines
  misc_feature (369)..(369): n is a, c, g, or t
aaagtatactgtctacaccgagcaattactgtgcaaagcatactgtctacaccgagcaattactgtgcaaagcatactgtctacaccgagcaactactgcgccacacgctagttaatatatacgttatattgacaaggagtttcgttgctaaaaccattttctcccggccgaaggccgggagcgccctgaaagtagtggaagggtcttacaactttttgaggtgcatccgggaaaactatagagaaaaattcagcgcggacgactgagtcccggggaccgatttctcactttttcttgcagtttagggcccctaactttttttctaaaacccgaatccaaaaagtgcccgctgtgagggccactccccncccacccgtcctctccatgctggtattttttatttttttattagagccaccccctggcctgcacgcttggctaactgaagtgtgctcaaaaagtacacttcagtaccaggcgaataactcgccaggggttgctttgaccgaaaaattgtttctgagcaaaaatgtgtagtatttgaaaggctatcaaaccaagttttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacgtttgagtcccgggcccgataactcgtcgggggtcggttttagacgaaaaatgccttagagcgaaattgtagagttttttaagctctatcgaatggtgtgccatatggccggaaattttcaaaaattttcgagctaggcccctctagaaattttcgaaaattttttttgggttgaaaa

SEQ ID NO: 42878 - DNA, 947 bp, Heterodera glycines
tgaaatctatccgagtcaataacagtcaatctattctttccgttgttgatttcgttcagttgaatagatttggtgcaatatattgaattttgatgaaaaataaattttcgactttttgttcgaatttgagttcggggttcggaattgggcgaaatggatgcggattcgtgatcagcgaccccgaaaaccccagaaaaaatgttttacgtgacttttaaaaatttgaaatttttgccaaaaaaggggggggggaacaaaccccagtattaccttattttttttcttcacttttcagtgtttttaatttttcacaattcgctaccttcgccaatgcttgcaccaattccaataattgagccggcaactgtcactgttccgcccaatgaagacgttgtgggctcagatgatgagaatcagcaaagagaagaggaactcctggtcaatcaatttgtcatcaattcggaagcgatcaagcgcatattggacgacccgcgctacgctgacaaaaaggtccaaaatatttttcaattaaagtgactctgacttaatggaattttttcattaataatttatcccaacttttttttacaaattttggtaaaatgtcgatgagctctatttttcggcaaaaaaatcattaaaaaggtgaaagctatatggctaaacacaaacatagcatttattttagccctattccgaatttcacttcttaaaattggaacaaatgccgaaaatatttatttacggataactcgataaatacaatctcaaattggctgggattcggaacaggccaaatgaatgtcacatttgtcttttttgccatataaaagtaaccatttgttttccttttaggtgtgtgtagtcagcgtggcgggcgccttccgcaccggaaaatcgtttattttaaacttttttctgcgtaatgtgcgttggcgctcagcacc

SEQ ID NO: 42879 - DNA, 1216 bp, Heterodera glycines
aaatacggtataggtatttagaagtgtccaaattgagataaaaacaaatgtcaaaatttttattgtactttttcgaaattttgatttacatttactgctttttaaggaaaattggcgctagttgcaaagaggtccattttgaaaattttttcacttttttgacataatttttttgtttttgaaaattttttccctttttttgacatattttttttgatacggaatttactttttttactagatggtacgtatttcacgctatttattaattgattatgacaatctgcaggttcggccagcttctttggacgaaatcaatttacgttggatttacaagcagaattcagaggaaatactacaatttctggcttatcatggacttatcaaaaaccaaatggagtgcaagaagtgttttaacaaaatgtcattgacaaagaaaaagcaaaaaatggatagtttttggtaagcacaagttttagattttttaaatttatttttttagtggaaaggacttcagaaacaaaaacgccatcaaagaactgggaatcgcaaaatcaacttgcgtcaattggttcaatttttgtcgcacccaatgtgttcaacaacaaaaaattggtggcgttaacgtcgtggtggagctggatgagacctgttgggtgaagcaaaaacacaaaaagcctaaaaaaggctgcagcaagtggttttttggggccataaaagaaaacgttgtacaaattgataaagaaatggattcgtccaggctcagtgatcatcagcgacgaattggtcggcatacccgaaagtgggctcttcactttccacagtccgaccacatgctcttcagacaccaaaaatcgaccggtggtggcttgtcgaaacttgtcatgctcccggacggcaccgaattcaacgtcaatactaataaatgtgaaggactctgggctcaattgaagcaaaagacgaaaagaatttatggaaccagtacaaatttaacaaattccaaatgtttgaacaaatttttcgacttaatgctagggctaaaggaaaaactattattaatgctttctgtgatcttattcgtcataattataattttattcgccataatcatgctgctaatgcttaatatttatcattacgtataaataaacaaaaaaaaattatgtcaaaaaacgtgaaaatttttttcaaaatggacctctttgcaactagcgcc

SEQ ID NO: 42880 - DNA, 979 bp, Heterodera glycines
cctccaagtaattttttttcttctaattttaaattatccctttttctggaattttatcacattttaacaattaaaatcataaaatttgtcatttttggactaaatttgttcacaatgtaaattgaaaatttcaaaatttttcacggcggcgcctatcggcaccgccggatctccaaaatacccattattttttttaattgactcaaaaatcgcgaaaaacctaacgaatttttttgttttgtgcccctttgaaatgataaatactgtaccaaattgaatcaaattaaaaaaaaaccaaaattagttaagaatagagtcaaaaaaaatttttaaacggtttttaagcgaataggaaaattttttgaaaaaagtctcgagtctcgggttttttgggtctcggtctcggggttttcggtctcggtctcggtgtcgagtctcggtctcgggatcgagttttgttctcgagtctcgggaaatttttggtctcgagcatcactattgttggggagtacgcttacagcacaaaatgtaaatagttggaaaaatctaaattctttttagagcccggacgggaacttttggtactgatactggcttttttctctaactcaagaattttttccgtgattgatttttaaaacagggcttttcattaaaacttttcttaaaagcaatcgggtaggtatcaaatttagcaggcattaatgttaattatgagtcattttttgagaatttttcaaaattttttattgagaaactctttagttagagaacaaaaaagcccgtctcgtaacaaatttccatctgctgggcttgatgttatgcgcgttaattgtgatgatcagccgcaggggtaaaatttcaaaattaaaaattttattcgaaatatttgaaattttaatttttttttcgtagcgtattatttccttgttaattaatgatgaaaatcccattagctgcacctctgtgaaagagtcaa

SEQ ID NO: 42881 - DNA, 508 bp, Heterodera glycines
tttttccaaaagggcaaaatttaaatttatatgaatacctttaatgggttcttttttgtgtgatgaatgacggcgattaaccgataaaacactaattgtaacgaaagaaaagttacacaatttgtgacaaaacggaaaattaacacattttaataacgaatttattcaacggacttttggcgatcggacaaaaaaaaaagatggatttacatgaacaaatcagcgggaaatgctcaaaacatttatcgatgaccaaaaaagtgcaattgcgtcgtaattccatcgctattattggcctttgtacgtggaatagccaaagttactcaaagtgattggcacgtggtaatgggcggtgggatcatcaatttggaaaacgatctgaaaataaatgggggagagaaaagagaaagaacaattggaacgacgaagtgaagggacaaaggcaaagaaaaaagaaatgcgaatttggaaatgaattgtcaaaacattggtcaaaattggggggggg

SEQ ID NO: 42882 - DNA, 782 bp, Heterodera glycines
tctttgatgcgtttggcacgtcattgttggaggaacattctcccatttaggacacttttagtgtgagcgataaacggcagaaataaaccgaaataaaagcaaataagtaatgagaccaaaatactaaataaggagatgcaaatattgtgagaaaggtggaaaaggaaaaacaaaattaggtacataaatggtgagaaaataaaattgagaatgaaaaaaaacaaatacctatttggtgagaagaaattattttgggcatgaaagtccttttttcgttaagttgatggaaacgtataagtatatattttcatgtacatagatgtagttacagattttaagaatttattcaatttttgtaaaatctttgggattaaagtgacctgagattttcccacaaataaaatatatgctaattgggtcaaattcagcttaacacgatgaaaaaaagctgttttcgcactaagtaaatggtttgatgatttactcgttgttctattttttaaatgagacaagggagaaagggcagtgagaaaagggaggaaagggggggggggggggggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggtagtccccccgaaccgatgcgcccagatttatggggagaccgaatccttccggaat

SEQ ID NO: 42883 - DNA, 1524 bp, Heterodera glycines
tttttaattggataaataaaaaaattgtttaaaatgaaaataaaaatgataatcactaaaaaaattttccccaaaaccacctttccggttatatttatcatgaaaaatacgcattttaagaatgtgtttttatttggaataaattatcacaaaaccttcatttcctgttattttagcttgaaaaatacgcattttaagaatgtgtttttatttggaataaattatcacaaaagcacatttgcggttatatttatcatgaaaaatacacatttcagaatgtgtttttattcggaatcaattatcacaaaaacacatttccggttatatttatcatgaaaaatactcattttaagaatgtgtttttatttggaataaattatcacaaaaatacatttccggttatatttatcatgaataatacctaatatcaaaagagatattagtcattaaattttatgaattaattggtctttttaaacttcatttcatttttgtattgccataaaaatatgacacatttaattccttaatttaaagattctttattattcagttaaattttaaaaattttaagtttaaaaaaagtttgggacaaaaatattgagtctcgaatttcgaactttttagttatattttttgcaaatttttgttagaatcaattaaaaacatttcatatttttcaatatgtcctgatttttcacgtttttttcctgtgtatgaattctatatgcattttttgttgtaaattaatgtaaaatgattctcttttggatgaaaatcattgataattgtactgatttttttcatttgtacttttataatcaatccaaacaaataaattctcattttcttcatttattaaaaaatagcaaaaaatttcataatttccgttatcaaattgtaataataaacaaaaatttattgccaatcgcaaatgaattcagatatttcagtagtattaatgttttttttaagcgttatacctggtaaagctgaatcagtgaagaaacaattgcaagaaaagttttgtgaagatatttttggagaaaaatggcaatataaagaagatcaacttcgcaatgatgagatgatcagtgaaatgatccgaaacttctataatttaaacgctaatattaaccaaacaggaagaggatattattcagtgtgaatggacgtaatgtcatttcgcatcatagtgaagaaattggggtcatattgaagtgatatttaacgatcgatagcgtacctaacttcggttcgtgactctatatcaatttggggacatattgaagtgatattgtaacaagcgcatctcttccctaaaatagggtgaggttgtaggtaagcactcagttgaagccgcgtctgtctgacgcaacaatagaagtcacgataaggtaggggagtattaacgtacggtgtgcagattatgagtgatgaggggggcctcggacgatgctggaagacaaattgcaaatgtaaaatggctggtaattatttggtcaaggcataaaaaagtggcat

SEQ ID NO: 42884 - DNA, 916 bp, Heterodera glycines
ccaggagatgggccaaattgaaaacttttatttgcgaaactgaaaaatacgaaatgaaaaaaaagcgaaatgcgaaacgccagaaaatgcgaaaagcgaatttttttttaaattttaccaatagcttttgaggttgtgatgcaaaaaaaaatctgcattttccggttcgatctttttctcagataaaaaatgacaaattctacccattttgtggttaaaatttcaaaaattaaggtaaaatgaaggtccggcggtgccgataatcgccgccggaaaattttttggaaattgtaataaaatatggtaggaaaagttgttaaatttcaaaaaatttactatttatttcaaaaaaataaatcgcaaaaaaggcaaaaaaatgctccaaaaagttcaagataaaagcttcaaaccaagttaaaaaacctggaccgggacttaccgggaccagaaaagtcgggaccgggacctcgattttcgtccgggactgggaccaaccgggaattttcccaagtgaaattttttgaaaaaaaaatttgaaaatttgagtgcactttgttacgaaaaattgcctatattcaaaaatgtacccataaaattttttaattctcgtttgtggggagaaattagaagaatttttccattatgcaattttgagtgtaatatgttaacagaaaataataaactgaagcattcgttttaaaaattaaattttcaaatatattcattcttaggggtgtaaatttcgcatttcgcgccaaagagcgaaatgcaaaaagcgaaatgcgaaacgccaaaaaatgcgaataatgcgaaaggcgaaatgcgaaaagtgaaacgtcggcccatccctgatccatatccaactcatctaacaagggaacattccgagctgtgactaggaaattgcatataaacg

SEQ ID NO: 42885 - DNA, 918 bp, Heterodera glycines
  misc_feature (873)..(873): n is a, c, g, or t
gtttaatttctgggtcacaccaagttctataaaaggcggatttttgaataaacttttgtgtttaatttttgtgtcacaccaagttctataaaaggcggatttttgaataaacttttgtgtttaatttttgtgccacatcaagttctataaataggcgggttttgtaccaacttttaggttgatttttgtgtcacactaactgctcggtttaatttctgggtcacaccaagtcctataaataggcgtatttttgaataaattgctgagtttaatttttgggtcacatcaagttctataaaaggcggatttttgtataaactgttgggtttaatttttgggtcacatcaagttctataaaagacggatttttgaataaattatgggctaattttgggtcacaccaagttctataaaaggcggatttttgaataaacttttgtgtttaatttttgggtcagtctataaaaaggcatattattgagataaatttgagttattttttatgtaaaccaagttctataaacaggcgaatttttgtacacacttttgagtttaatttttgtgtcatcaagttctataaataggcgggttttgtaccaactttaagggtgattttggtgtcacaccaactgctcggtttaatttctgggtcacaccaagttctataaaaggcggattttagtacaaacttttgtgtttaatttttgtgtcacatcaagttctataaataggcaggttttgtaccaacttttaggttgatttttgtgtcacacccaagctctataaacagtcggatttttgtacaaacttttgggtttattttatgtgtcacaccaagttctataaaaaggcggttttttgaataaactgttngggttaatttttgggtcacaccaaattctataaaaggcggatttt

SEQ ID NO: 42886 - DNA, 1809 bp, Heterodera glycines
gatatattattatttgtatcgtagtcattgtttaaaaattgaagcggttttgtgcataaatgtgaatttaaataaatggattttaagtttgttttattgttcgaatccgggttcagggttcaaattacgtcaaaataatgagtattatgttctacttattttgaatcatttataatttattttaaacaattattaattaaataaatatacatgcattatatgtggactaaatttttaatttgtaaacgcgcgagcaccataaaaggcgttattacgctgatttactgccgtttcaaggttgcttgattacccgatttggcagtgctagctatcgtcatttttttgataccttcataattattcttttatttaattatttttcatttgttagatttcagtttttattttcttctttttttttgcttatcttaactttaattatcctttatgtttctcaaaaattctttgattgtttatttaccaaaaagttaaacatttattgttttgataattggcaaaaattaaatttataaaattaataaaaaagtaaaaaaagggattttcaattcaaaaatttagtatctcatcaaattcaagagtttttcccgtcaattctctttcatactttttttatgtcctccaacttttgttgtaaatcaattactcgtctattgacgcacgcgattcaacttggaggctggaggatgttctattcttttttgttctcacatatttaaatgataatatttgttttaaatttcattatttattttttattttgtaatttttagtcacatcttatatgccatttaatgcatataactctgcctagattttattgaaaaataatttattttttttgttgagtaaattattattcgttttcaaacttgatagaaatcaagttagagcagcattcctgcgtaatgaaacatttaatatagttcgggatcagtaatcatttctagtaatctttgatcatttttatttattttatttaccaattagtattttctttcattattcataaggtctttaatttaattgatttgaacaatattaatttttgaaaatatatatactcatttgagtatgtttgtcaggtaataattcattgccaaattttttcatcatatgtcgcttatgatttacaatattcatctcttcaaaccccataattaaatgtttatttatttattaggtagcaaaaaagtttacatattaatcaatttattgaaattgttataattgtcgccttttgaatattatgatatattaaatttttttattccattaatttatgcactacattttttaaataatattcatttaatttttgataatttattataatttaaaatttttgttgaactttattttctttttatgaaagattttaatatgttctgacgacaattcccattgtcaatgtttactttgtaattatttatattaattttattcatttatttctaattttttttattgttctgacatgtaatcataattttgtattgctgatttttttattcacgtgttgtagttatgttcaaattgttttccaatcttatttggtttgttgtttaacgacaaaaatatattgaccaaatattcattcatttttgttcagaaataaataattatatatttttataattttatcatttaaacgaaaattattttatataaattaataacacttcttttttattatctcgtcaaatctcctctaaattggtaagtagcttcaccatttttttcttagaaaatgtaaaaagtttccacagttgctcataaaaaatttaattt

SEQ ID NO: 42887 - DNA, 1554 bp, Heterodera glycines
  misc_feature (253)..(253): n is a, c, g, or t
  misc_feature (339)..(339): n is a, c, g, or t
aaaaaaaattttttggataaaaaatatttaaatgacctgactagataatatttaaaataggttttctcttcctttcagtatccctgcaaagtttggtgcgcttctgatcagtttctgaaaaaaaagttaagcctaaacttttgggcctgttaaaaaaggaattaaaattttttaaaaattttattcatctccctttttgatagaaaaggcatcagagtgcctaaactaacatgtaaataaaatttggtgcgtntcagaaccctttctgaaaaaatatttaagaattaattttgcaaaaaataaataaaaacgaaagactcagattttcgaaaaattttntagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccctaataaacttttcaaaccccatttttcgcaccgtgaat

SEQ ID NO: 42888 - DNA, 594 bp, Heterodera glycines
  misc_feature (63)..(64): n is a, c, g, or t
  misc_feature (99)..(99): n is a, c, g, or t
  misc_feature (122)..(122): n is a, c, g, or t
  misc_feature (144)..(144): n is a, c, g, or t
aagtttttttcaaccacatatgccaatataattcttgcagatttaaagctatccatgctgccnnggttctcggcacagcaaagcactaatagggtgttngactaattccttacacaagtttnttacacccacttattgccaatntaatttattgcagatttaaagccatccattgcctgccggttctcggcacagcaaagcactaatagggtgtttgactaacttcaaaaaataattcattacccaaaagttttttacaaccacttattgccaatataatttcttgcagatttaaagctatccattgcctgccggtctcggcacagcaaagcactaatagggtgtttgactcacttcaaaaaataattccttaccaaaagttttttacaaccacttattgccaatataatttcttgcagatttaaagctatccattgcctgccggttctcggcacagcaaagcactaatagggtgtttgactcacttcaaaaaataattccatacccaaaagttttttacaaccacatattgccaatataatttcttgcagatttaaagctatccattgcctgccggttctcggcacagcaaag

SEQ ID NO: 42889 - DNA, 308 bp, Heterodera glycines
ctattcctttcctggtcattaccactttaatatttcttaacacttttaatatttaattcctttgcatataaatgtgaattttattatttaattatattatgttagattattttattgattaattaatgtgttaagataataattctcatgaggctcctctaaactatttacttatctcagtctatttttattttgaccaatatcataaatttaaaaattatctataaaaattaaaaattataattgaattgtaaactttttttccgctattattgcgtatttaagaatttatttattaattttttttt

SEQ ID NO: 42890 - DNA, 734 bp, Heterodera glycines
cgataattccgcccccgcgggggcgggggcgggggttttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggccggcggtgccgataggccgcctggcgaattttgaaatttaagctcgatttctaacagatgtttacaaaaaaaataagatttttacgataaatttttgtttttttaatatattaaattatcatgatttactcaagcaaaattggaactcagatttgtaacatattttcttgaggcacatttttccaaaaaaaaaaaaaaacttggtgaatgtgcgagcgtagccggcggtgccgataggcgccgccgggaaaattttttgaaaactgatggatctgttaatagattttgtccaaaaatgataggtttttgcaatttttagagaatttttttaataagatttacgaattattgagccctgcgatgccgataggcagcgccaggcgaattttaaaattaaaaaaataaattaaaaaagaaaccgtcaacctgaatcgaactcacgacagaaagtaatgtcaaggttgattcactaaccactatacaccacactacacatcaa

SEQ ID NO: 42891 - DNA, 1370 bp, Heterodera glycines
ccgcccggattcgaacttcccccccccccctcaaaatgcttcctcagaatccccaatcacacagggattctgaggtcttaacgatgtcaaaagtaaaatgtgatcacgtattcgtgatcagcgtcataaactacccctaaagacatgtttttggaagatttttgtcgaaaaaattttttcactcaaaaatcctggtcacccccctttggtcccgaatcacaaaatcacttttatttttatatctttttttaaaaatgtgataaaaatgtaaaattaaatttatattatagagaaaaaaattgcggatttttgtagtatattacttttacagaatgacttttcagaagggagttatgaatttttttctgaaaaatcgaaaattttcagaaattctggaataactttttttctttttaagatagaaatcccaaataaatctcataaaattctcccgattttttgctatttttaaagctttattgtatgaaaattgaccctctctgaggtgagttatgaattttccaatattcgcctaaaatcccgagggccaaaaaattgaaaaatatttttgaatttttaaaaaattctaaaatttcctagactgaaaatgatcatcagattcgtgctcagcaccttaaaaatacccagaaaaaatttttcaccctctttttcaacccaaaaaaaaattccgaaaatttctagggggcctagctcgaaaatttccggccatagagcacaccgttcgatagcatttaaaatgctctacaaaaatgttctaagacaatttttcgctaaaatcaacccctgacgagttatgggcccaggactcaaatgtcccgctcaggccaaaatttttttctatttccgggaaaaaaccgaaatttttccaaaaaaattaccagtcgatagaactcgaaaaatgatgttttggaagtggtctccgtttttcccagaaaaatcgttaaaaattcctaaaattcaaaaacccgaaaaccgttttttaggcctaactcgaaaatttttgaaaattttcaaaattttaaaaactggaaaaatccagctcattgaactccacaataagtccgctggagccccctcgctcagatcaaacgctgacgcggtattcacctgggactgaagtggacaaagttggtactgaatttctcctattttctgcagcccttcctactataggtagaggcctggaattttttttgacttttagacaacacttcaacttagccccctctcagcggacattttttgattagagtttcagaaaaaaagttacgagccgtcaaacgcacgaaaaaatgagaaatcagtccctggtactcagttggcccttggaccggaaaacctatatttcc

SEQ ID NO: 42892 - DNA, 1230 bp, Heterodera glycines
aaaaattgttcataatttttttaattaatttcgctatttaaaatattaaaatacccttttttataatatttaaatgtataaaatttaatattaatatttttggaaatagacaaaatttaaatgtgaatttttaatttttggtgacgtcattaaacaattatttttccaataaaaacattcacaaaacaatactttctgtgtggaaaattgtttttggcatcggcatgaaataatttatgcctgaataagccccttccgtaaacgacccttgctcctcaaaaactagggtaaaacggaggtccgacggtgttgttacgcaccgccgggaaccctaaccaaaaaaaatttcaacgcactttttcataagttcagggcgaatttgggtcctacggttgggtcgtcgggaaattttaagaaatttttcaattggtattagaaattttatgcacatttcccaagtcatttatttacttttttggcgaatttgcgtctagcggtgccaatttaggtcgtctggaaatactttaataattgtttttttttcgttgaaatttgatgcatatctaacaaatttgtaaattttctctcccaaaattaggtgttgaatgaccccgagccgggtgcgacgcccgaggtgaaggcgttggccgctctgtcgctgggcctcgtgttggtcggcaccggcaacacgccgcccgcgaaggccgagttcgtctccagcatggacgtggttgccgacctgatcaactacttgcactccatcgacgtgaacgagccgaatgcacgctttgtggcgctcggcattggcctgattttccttggttcgttgcgtggtcgacaaattgattttataaatttttttttggaagttaatttaaaataaaattccgacaaaagcgtttgaaaaaaatttttactcaaaaaagtttttgcgggtgggataaacaagctactccatttagttcaataattcaaggaaaaccattaaaaaaataaggacagatcgttcgttttccttttaaccggacttttttttgaatcaaaaaatttcaaaaatatttaaatttaaaatccaaaaatttttttttttgattcaataatttactgtttttctaatggaattaaatagtgtcaatgcgaatgcaactgaaaaattgctgtttcatatgtcaataatgcttttcccttcgcttccaggccgtcaagacgactacgacgacaccatttgcg

SEQ ID NO: 42893 - DNA, 1082 bp, Heterodera glycines
  misc_feature (11)..(11): n is a, c, g, or t
  misc_feature (109)..(109): n is a, c, g, or t
  misc_feature (176)..(176): n is a, c, g, or t
aaaaataagcnaaatttttctttaaaaaatttttgtcttttgttttaaataatttttttttataaaactgtttataatcttttattgggggccctcttttaaccaaatnttcttcaaaaaattacattaaccatacttatttctttgaagtatttgagataagctaatcacgaatntaaaaccgagaatgattgtgacagcttcggtgtgtgttggcttaagcctgttttttgcaccataggagggcgttgatttaaattttaaaaaattgttaaaaagctcgatttcataccccaagctgcgcataaaaattaatctttacttgaaactttaatatggaagcctgtcaatcttattattaatcatttctgacagctgtttaaacattgggttagtgctgtggcgaagtgtcaaaagtatcgatgatgggtgatcgaaagaggcgggtcatttcagtacagaaaattaatttaaataattaaattaattaattcatttataattgaataacaatcttttaataataaatatatttgtctctattttagtatacacgacccttcaaaaaaacgagaccatcaaataatttgacaaatttaatgcaatccaacttttttacaagcatataaattaagcatccatggtatcatttgatagccctaagtgtcctctattttcctgtaaaatttcaaacgatttggttgagcttcaaagaagttgtagccaaaaatatttaaggaattttaagcgcagcttgggtcgtttatttaaggatgaaatcacagcctaatttaagaataattttagtttttttttaataattaaagtgcaaaactttccgatgcccaatctttccactgtgaatccttaaatgtcgcccattgtcttgcaccaatttttttgtaaatatttttggtcccactgatttaaatttatataatttagagcacatttaattctctataacgaacctaattattaacttttaatggagcatggatatttcggcacgttgttcttaataccaatataatgcctgtttttagttaaactcatgaaatcaaattacattaaaggatttt

SEQ ID NO: 42894 - DNA, 739 bp, Heterodera glycines
cacttatttctttctcaaattgcttcttccattttgaaatgcttgttataactttgctcaaaagcaacaaaattttaaaatttttatatcattcgatagccctaagtgtttcctattagcctagaaaaatttcaaaaagtttcattaagaaagttatgactaaaaatgttgaaaaaatttggttttttgagtttctcagatcataacttttttggaacttaaagaattttaatgatattttgcaaaatgccacggacacatagttttttttttttaatttaatagttttttttttaatttttttaatagattttttgaccacgataataaatttaaattgttgtataaaaaaaatttcatgattattttattatattattttaaacaaaaaaatttaatggaaaattgaaaaaaaattaatctgtggccgcttattagtctattaaacattaatgtactaattttaagcgacattctgaagttatttcaacgatatgtaatatgaggtttatgagtatttaaaatactcgacatgaaaaataaaactttaaaaaataaaattgaaaatcaccagcagcaacatattatttgttttagaattaatttaaaatcagtaggataaaatgtttatttaatcatggaattattttattttttatatcatttaaaatcttattaaaattattttttggataattagtgaaaaaataattattatttttttaaatcttaaatttaa

SEQ ID NO: 42895 - DNA, 751 bp, Heterodera glycines
  misc_feature (670)..(670): n is a, c, g, or t
  misc_feature (700)..(700): n is a, c, g, or t
aataattgaaattctgaaactttacacctccaaaaaattttctgacaattcatgcgaccaaacttttgatgctgatttttattttagggttggtctccaaccttcggcgagagaaaaaggggggatcgaatgttattataacttctgtttggcaaaccattcattatttgaaaattataaggtcaaaactttgaagacatgtaaatttttgaattttatatttcaataattttgggcttttgtcaatgttttgttaacattttggcatttttcggatttttcatgtaaattcagaaattctttgttactaaaagccaggatcgggaattaggacctccaacaataccggaaggaatctgcaataaactaaattgttaaagaattttcaaaaaaatccagtaaatttgtaatagaattttaaaaaaaaaatacaaaagttcacacgacaatttattccatcattcgttttataattccgaatttgctgaactgcttcccaaagtttgtcctcgttttggaaaatttttcactcaatttgtttgttggcattggccaaatgcattttggacaaaagtccttgacaaattggtggcggaaaatgctgctggtgaacaacaacatccaactggacaacaccaaagtgcacaagtcgttgatccacggatattgngtgtagacaatcggtggatagtcgtacaanaagccggtgcccataataaatctaaaatataaaattaaaaatattttgaat

SEQ ID NO: 42896 - DNA, 1292 bp, Heterodera glycines
  misc_feature (17)..(17): n is a, c, g, or t
tcataataaatatatanctaatttatcagaaattcacaaattaagattttccaatgaaatctgctaaatatggtcaaattcttaattggaccctagaatcctttatttatcttacaaatttgctcaatttgaaaaatttggctatttttgtggacaaatctgttaacaaatctcattaaaaattatttaaaaaaatctgggagccctgagctaaacagatttttaatgaagttcaagatttttttttatcaatcacctacttcccttgtccaatcgagctgattttttatccagtataataaataaataattttatattaaatatgaaaagatataaatttaatttcaaataaatttaaaaaatatatatatatatatatatatatatacatttcaaccagaataaataataaaaaaaagttgatttaaaggtccatttttataaaatatataaaattagtaataaatttaaagcaagcagcattcttttaataaacttctaaacagggattaaaaaactagtgaaaaaatttaaaatttttcttaatattaaaaatttaaacagcaacagtctatgtaaaattcacaaaatgcagtcaaaatttatctattaatgaattttaaaaggaaacaaattaattattcatttctctaaatgtagtttttgaatttattttgatatattttaaaattatttatagttcttttaataaaaattttttgatttatattattcattcatttagatatttatttgattcaacacattgcttttcacattaagaaataaaccttatctctgaatgataagaactttgtattattaagctattttaatcttttgctcaaattaaatatctgttgccttatgagcttcatttttcgtacaactatgctttttaaatcaattgacttacaaaaattatatttatacagataaaaattttttggatataataagaattgagcccgcaaaataccacataataaaagtttcaattaaccttacttatattacattcttaaaaaaagacacttacatttttattgcacttacgctttcatttgttcattattttcgtgtctttattagtatttattcaaatattgcattatttaaaaattttcatttcaactaatttattattcattctttaatcaaattttacacatttttgtttatgaaattataaaataaatataccttcataaaataattgataagtttattatgcttaatttttttcatgcaattattattatttgttcattttgtttctatacagctctat

SEQ ID NO: 42897 - DNA, 1666 bp, Heterodera glycines
  misc_feature (676)..(677): n is a, c, g, or t
  misc_feature (691)..(691): n is a, c, g, or t
tttttttaaatttggcatccgccttctccgtccgacacacagttgtagcacccgtcaggacaattctttgcgtatttctcctcacaacagtaataacagctgcaccgcgtgttcatattacagtgcttgtcgaacacaaattggcacgccacacagtcgtggttgccagggccgcagttggcatctgaaaattaatttgccaaaatagttttatggcatttcccagtgggtttttgacttggaggaattaattaaatatatgtaataaattatatatcttcgagatgtccgaggttgcttcatgaattccgccagatggctttttaaagttgtcattttttctaagaaccctaaataagtaaccatcgcggtgttaggacgttacttaaaaaccctaaatttttgcttataacttttcaaaaggaaagaatttttaattctcgatgtaattagttaaccctaaatgttttctattgtcctgtcaaatatcaaaaaatgttttctaagaacctttaatgagcaaccattcgcatcattcgaaagcaattatatattgtaattttgttggttaattttgttgaattatcacttctaaaaattctatttcactaacgcattttccgatcgagttgaaatgattttatgataagcaatcattagaataccaggaatttgnntggttgagttcttnttctgcacagctcaattcgtcgaccacggagtttttgcaggttaaaacctgtgaattatgaaaaatgagtgttaaagtgttgatgatttaaattgggttaattaataaatattatatattggaaaataatgattaataattaatattatataattacattgtcgaattttatttgaagaaaaatgattaacaataaaactttaaaaaacattaggaaaagaataagcaagcttaagagggaatgtttcttttagacgaaaagaaacttacttatgttggtgtcactatcctttagtttttctttgactgggaaaagttatgacatttaaagaaacgataatgtattgagataaaatgatcaaaggaatcacagcttatgtatcgcttttatatggaggagaaaaagcaatggacgttgaaaaacaaagaaaaaatggaaaaggaattcattttgaaaggaaaaattaattcagtaaatgtcaaaagaaaaagaatgtaaatgaaaggcattggcattcgttctgatagtaaaaattgattcagcaaatgaaaagtgaaagaaatttaaaatgttgtgaatttattaagtctgtttacactaaaaatgttgtgccatttgttgaataatttcacattacaatttgctcactttcattgccattccttaccgaattaattttccatcttattttttgattttattttctttagcttcccatttctcctctctatataaaggaacagttgtggtcatatttatagtcacaaatgtcattaaattaattttaaataaaaaataaaatttggacaaaaattatccaaaagcgaaactttttttcttttagcaatggctcaatccaacccttttaagcattcttttgttctttttttgttcaacgctctcgtcattgtaatcgccatcactttggcggaaaaaaggccaccgacgcggagaatgccatcgacgcggacaat

SEQ ID NO: 42898 - DNA, 959 bp, Heterodera glycines
gatccattcaaaggggaaatgagtttggaatgtttgttcttagaaagtgaattccataatgctttcccttgggtcaccaattggaccaagctttcataagcacaatcattttcattcccagcccactggcggggaaaattttgtcaaataataaaccctaaataaaagtggaagtcagcattaaattagagcttattaaatgtgatcaaggataaacaaatactcgttaaagctttcttgtcgattaccgtcttcaaagagtaatacaatcaattgtgtgtctagcatttagcgcgttaaaagccaaagttcgtagtggtcgtttctggcattatgcttagcattttatttaaaaaatgagaaaataaacatgtgtggctggtgattacttattcccactgttgtctgcaccttttcactccggctttatcaatttttatatttctcattgagaaatttggcagtctaaaagcattctgcacacattcaaaatgtcccgtgatgtcagttcgacagagaaattgcccctttcacagtcgtccaatcctcgcactaacagtcgcactctcgtcgcgtgaggaggcgcgggccatagtccacaattatccgttctccggtgaagaaggggatgtccacatcaagtacaagttaaataagtcatatttaaaggccggaaatttcaccgtaactacaagttgcgccgcgtgaaatatagagtgcgatcatggtaacttgtaacatggcatccaaatctctcagaatggtcgtcaatcaaacgagcaatatccaccaaactgggtctgcctccgaaacgtctgcgccgaaacgaccccgacccgacccataattcctaattggcttaattatcaaaaatttaattaattatttgttttttaatttaccctttttggtttcgaataatctgcgctttttcttcataccaatttgctttttacatt

SEQ ID NO: 42899 - DNA, 764 bp, Heterodera glycines
  misc_feature (747)..(747): n is a, c, g, or t
tgcaatttttgtatttgaaatcgtagtccttctacatgccatcaaacatgcgctgaatgccattaaattccgtggtgcgaatgcagccaatggactctttcacgtaagtgttcatgtaacggccccatctgtcactcgttcgtcttcacacacaatttcgtaagttttgtaggcaattggccacaaagggcgcattcaaagtgcacttccaaagcgatgtgagtgatgtttgaaggaaaaaacaaatccgttttcaacatgattggcatgggccaaattcgaatccaaaggctgtgcaaatcgattgccaattccgaagcacttagcgccgagtgggaacaaataattggattattttattccacggatgtgtttttttacgtaaaagcttccaattaatttaacgactattgattttgaaatgtaaaacaatgcttcaatgctattttgaaaaaaatgcgcaatcgccaaaatttgaccggttttaacgtatattttggaaaaaatcaacctctggatcggttcgggtgcgggattcggaattgggcaaatccgagttcagattataatcggcaccttcgaaaagcatggaccctgattttgagtcgaaaataaaaacattaacttagggacccccattctttatgattagggcatccaaaaatatggatataaaatcacgaaatatggccataaaatatggacaacaaatcgcaaaatatggacaataaaattgctaaaatctcnaaatatggacataaaat

SEQ ID NO: 42900 - DNA, 1411 bp, Heterodera glycines
  misc_feature (1326)..(1326): n is a, c, g, or t
  misc_feature (1399)..(1399): n is a, c, g, or t
aaaattctcctccgcaacaatttccttgactaatttttcaattacaaattatacccaaaccattttaccagtgtgaatttatcatataaatttcgttgagaattttagaaccgttactaatcatggattaattgttgatatgccacaaacaagcagtccggataccaaatctcaatttgccatcaatgaaaagcgaagattgtgaacaatgcctcattttataaaattaaatattaattatttttattcaaattgtatattttattttcgaatattcttttaaatcttttcacttttgggtaattttaaacatttaattttgttccttttatcatttcagggtatatgtctataaggcttaatgtatacaataaaaacattttgttattttcttattcgattgaattttgaacttatttttgtgttaaataactgtagagctttgtttttgtttaaatgataaatagtttattttgttaactttttatattttaatttttgctttcctttattttaaaatgctgaccttatttttttatttttaaattattttcaacaaattaatttggcatagaattttttcgtgatataataagtgtattttcaaaatttaatatacctaaaacatctttggaattacaataaatttttttcatctttttccatttaaaggttttcttggaaatgtaaataatatttattagtaaaatttatcactccatctgcagaaaagtgctgctttcaaggggtcaaaattggaattttttgttggccccgccgggcattaaaaattttttgcttttaaaaattgactaaaatggcaaaaatcattcatttatggtgaactaatttcactcaaaatttcaaaaaaaaatttcccggcgccgccggcccttttttaaatttatataaattttgtttctgggagaaaaattcaaaaaataaaataaataaaagaaaaatcaccattttttctacaaattctccgctaatattttcatccattaactccactttaaaagttccatttgaaaagagtgataaaattgcttcataatattttaagaaatgattttgttaaaaaatattaaattaattatttaatttaattaaataaacacatgaattattttaaataagttttgactaaaaattttatgctttgaataatcattttcttacttttttcttttttctttttagagcatattatcatgactagaaggtgtttatttgaactgaaatggattggtggaatattaataaattatgatttgattcttacacagattaagtaattggtgttcatcgtaggtttggtcttanaaattgcaataataaatttttttttttttgcaatacaaaaaatgaagtcaaatgctttacattaatgtattanattttttttatt

SEQ ID NO: 42901 - DNA, 829 bp, Heterodera glycines
  misc_feature (25)..(25): n is a, c, g, or t
  misc_feature (744)..(744): n is a, c, g, or t
  misc_feature (797)..(797): n is a, c, g, or t
aattttcctccagatgaaaataccnaggaggaatttaccattgttcacagacgataatggtatattgaggtgtaaaggaagaattgaagaaggagggtttgattataatacggtgaatcctatttatctgtctcaccagataccgattctcgatttgcttatttctgacgcacatttggaaacagaacatggtcgaaaatctcagactctcaattatctgaggaagaaattctggattccaaaatgcagaagaatgattacaatggtcattaagaaaaatacatatacaaaatgtgggatttgtgcaaaattagaagccaaggctttcagttatccaaatcctccccccttaccaattcatcgagttaaagggtcaagtgcatttgaaacaattggcttagactattttggtccaataacaataaaggtcaaggaagaaacacaaaaggtttggggagcaatatttgtgtgtacagtcacacgtgccatacatttagagatagtgacagattgtacggcacaaaaattcttattggctttagagagattcatgaggcgtagaagagtgccaaaaatgataatttctgacaatgctagccaatttgttctttctcataagatattggctaaaattactgaagcacattggagaaaaaataaggtttggggtcaaattcagaccagacaaagggaattagaagaaaaggagaaatggtcaatgatcatgaacgaaagagaggtacnagaacttacagcaaataagggtatcacatggcaatttgcctctccattagcgncttggcgctccggattttttgagcgactaatc

SEQ ID NO: 42902 - DNA, 877 bp, Heterodera glycines
gaatttttttctgaaaaatcgaaaatttccagaaattctggaataactttttttgtttttgtggtataaatttcaaataaatctcataaaattctcccgattttttgctatttataaagctttaatttaccaaaatagacctgatctgaactgagttatgaattttcaaatattaggccaaaatcccgtgggccaaaaaattgccaaaaaataaagaatttttaaaaaattccaaaaattatgaaacttaaaatagacatcatattcgtaatcagcaccttattttaccccagaaaaaatatttttcacccccattttcaacccaaaaaaaattttcgaaaatttctagggggcctagctcgaaaatttttgaaaatttccggccatatggcacaccattcgatagagcttaaaaaactcaacaattttgccctaatgcgttttttcgataaaaccgacccctgacgagttatgggcccgggactcaaatgtcccgctcaggccaaaaaaattttctatttccgggaaaaaatcgaaatttttccgaaaaaaataccagtcgatagagctcgaaaaactatgttttggaagtggtctccgtttttctgggaaaattcgttaaaaaatcctaaaattcaaaaaccaaaaaaccgttttttaggcctagctcgaaaaattttgaaaattttcgaaattttaaaatttggaaaaatcgggcttttaagctctacaataagttctgctggccaccctgcgctcaggtcaaagcctaatgagttattcaacggggactgaactggaaaaagttggtactgaaaagttgccaatttctgccagccctccaagtataggtagaggcctggaattttttttgaaa

SEQ ID NO: 42903 - DNA, 839 bp, Heterodera glycines
ttgttcatttatttttaggttataaaacgtgttcgccatggtgaatatgtaccacctgctgcacaactaaatttagacgctggccacaaaggtgaaaaaatcaaaataataaaatttcacaaaattctatattaaggcttttgatgtttgctcgacttcgcaatggaccggtattatcaaaaatgtgtacgctggtggcactttcattttggcgccgtctttgttcagtcaaatttatgttcttctatcaaagcaaaaccctatttttcacgttttttttgtatttaggcgaattaattagattttccgattacgtacttccttctcaattcagtatgaagcgatgtacacacaaatgcttcgactgattgttcaaagatggccgaatttttcacctggaaccatatcgttggactgcgagcaggctatgctgccgatgcgagaattcttcgactcttacggggttaaaatgctgccaacaacattaatccggctaaccaaaatgatcacaattatcaatgttaatcctgatttgcaggggacggatttatatgtgctaaaaaacgccaaatatgtacatatatatgtgccaaaaaaccctcaaaatatgtgctaaaaacccagaaaaggccaaaatatgtgctaaaatttaaaaaaactgctcaaaaatttctcaaaaaatctcatttttttactaatttcgctagcacaatgctaaccaaaaacattataatgctttttggcgtaaattttttctcgtcctcaaagttttactcatttttcggaattttcttcgctaaaaatcaaattttaccttaaagtgaaaaaattcatgaaaa

SEQ ID NO: 42904 - DNA, 928 bp, Heterodera glycines
  misc_feature (860)..(860): n is a, c, g, or t
ttctgggaaaagcaattaaaagatatttaaagtgaacattattttcggattgaataaaaaaaaccttcgcttttcatgaaaaagcattttggacgggaaaatttggcagtgaccaaaaaagcaattgcattttcagtgccattattgatgaatgattttgacctaaagttgaattgtcttttgaaatggttatcattactctgtattttggttaaataaaatttaattttaattttttaatttttttatatttaatttgctttcccaaatttacatttgagttttctccttctgtctgttcctaaagcagcaacaattcggacttgaatgactttgaacaatttgcacatcaattagctgcctctcattaaaagggtaattaacacaaccggagacaaacaccaaaatatcatctaacagaaaacaaatttaaataaatattttattacccttttttaaattttcatgcctttttcatcaaaaaacattttgcttttgcttaatgtgtataagccattttggccgtaaaattgtgccaatttttcatgccgaacattcgtaaattgactgaggtcacagccaacgcttttaacgaccgtacgccattcttcagtatcgtatacatccaacttaaaagtaggactccgtctgatacggtcgtttgttttgctgataatcggtgatcaatcgtgaggatatttttggacagcaaaaaatggaataaaatgatcagaaaaatggtagcacaactgagcaaaatgtggacaaggcgaaaatgagtcaaattaagcattttaaattcgggaaaacctaaaaaaagtcaaatgaaacaaattgaaaaaggaaaaagagagatttgngagagaaagaaagaaagagagagatggtaagagagaaaggagatagaagtagggaatgaggtataatg

SEQ ID NO: 42905 - DNA, 1215 bp, Heterodera glycines
ctggcaacaaaccaagccctgctggcggtccgatggcctttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgtatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgacccggaagccgagtcagataatgagtcgtgcgagactcagtcaattgcatcatctgatgctgggtcagtcgcaaattcagatgctgaatctgtagcatctgtttcatcgcagcaccggcggattgacaaatccaaacaatttatctccctgcgagattattgcaagtattatctcgcaataagggatgaaaatttggagttgcaataccaccacatcctttcatgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccagtacaacaggcagcaggcacggcaaaaccccaatgcccaacagaaaactgttgatgacattggcagtgttgttcggctttccgaaaacacgtaaattctctccaatattggaagaaaatgtatgaagattgcaacaccgttttgcacggtgcatgacgcgaagaagcgcg

SEQ ID NO: 42906 - DNA, 836 bp, Heterodera glycines
cgtcgttgtgctcctactcttcttccagcatgtcttctgcatcgccttcctccatgtcttcgcccgcttcttccgtcagagaactttcttcctgatcttccaacccaccaccatctgcagtaccgtcccagaatgcattattatggccttgctggtcttctgcatctgcagtctgatgaggtgtctgcgaacgacgcggtgtctgcgaacgacgcggtgtttgcgaacgacgcatcggatcgtcgatcaaccggatgtcttggtggccgatagtcgcgtcaagctgtccctaaatacagtttcatcccgcttagcttgtggtgtgtggatcttaaattcatatggaattatacgtgacaaagtgtacgaaacttattttctatctaacctcagatttgggttagtaaaactatttgcttagtgacacaccttgtcatgatttttgtatatatgtgcatctgaaaatgttttcttgcattcaattcatgatcaaatcaattcaggattaagactttaaccagacaaacatagtaattgcttgagaacatttttttatttcacaaattatttacgggatgcaattgatataaacccaccatgttgagtgactttggattttcaaaaagttacattaattgattttcataggtttgaaaaattacttattttaagattttttcaacaaagaaaattttttccgttatcaatttatagaattgccgaatgctatcaaaaattttgagctcagataacatttgaccggctatttcatatggttggaggataaaattttttaaataagttatttcaacaagcaatatttttttccttttttc

SEQ ID NO: 42907 - DNA, 1097 bp, Heterodera glycines
ccccaaccccaccacaccaccataaatgtgtgtgtgttggggggggggggggggtactggggacagatgggcagaaaaagcgccccgccgaccgatgagaaggcaccaccccaccaccacacccatcccatcaatgggtgggggaagcatttcgccatctcatggacaaaaggctggggggatggatctgtataataaaaatggaggcatcggaattagggtgggggggggggtatggtggtagggtagaggggacagagcaccaacgcagatagcaaggattatggacggaattttcagggaaaatggatgggaagccgaggagtcaaacatcagcagcaaagcaagttcggacacacaatcgaagcacccagagtattgctgaaggggtgtggggggggggggggtgaaagcagtttcacacatatataagtatgcggcatattttcctgctgttgttggcatgcgcctgttttccaacgggcatttttgagcagaagcgccgctgggcagggcacagtgataatggggcaacgggcaacttcattatcagcattcggcatgccgtgccccaccctcgcgccctcccccccccttttttcgcgtctcccactcacactttttttttattcctcacgcaatgtttccagcccagtagcaacagcattcccgtgcctgcttttaatctccttcctacacacagacaaagtgcatcatcagtttttgaatatggttaaaagtgccgggcaaagctaagccaagccaaacatgaaaattgagcattttggagcatagggaaaggggagggcaggaaaagttttgaaggaaaaaaagggcaaatttgatggatgagaaaaggtaattcgataaagaaaaagcacagcgccacgccacgccatacacagaagagacaggcacacacaaaagagaaatgagggaaaaagcagcggcaagctgaacaaagtgtgaaggtcgattgagaattgaacaaatttgaaaggtgacagcagagccaaacgggggggggcggaaagtatagagggagggagaggagtaagtacaccgaccgaccgaccaccgctttattattcgagcga

SEQ ID NO: 42908 - DNA, 956 bp, Heterodera glycines
  misc_feature (911)..(911): n is a, c, g, or t
  misc_feature (931)..(931): n is a, c, g, or t
  misc_feature (935)..(935): n is a, c, g, or t
attgatcaaaaaaggatcatgattaaataaataagaatattcaatttggcataattgatcgattagatgcatcatttggccatctgccaacctcatccttttccataactgttcgttcgtttgggaatttctcaaatattcccaaaaaatgccgaggtgagcggcactttctttaggcattttgctatcagcattttcattcgatttcgcttctccaattaaatgacgaaaataagtcacaagaaagaaatcttccttaaaaattcaaaagtctatctgaattaacgggaatttttttgccttttccggcaatttctgataaaattcatttgtaagccattcgctcatcacattgtgcactttcgctgtcagtacatctccatcttccaaatatttgagcaaacacagattttcagcagaaaaatggcacagagagtcaatgggttccgaaattccacggaagtaaactttttgcgcagcaaaaaactcaccggggccaaaagcgattggcatctggacaagaaatggcttatgggatcgaaatttaaatattattggtatatttgaaattgacttagacttcggcccaaaatgtcggccgggacaaaagctgagaatgtttagagaagccatttttagaagctgacccaaaatgccaattttaaaaattttacccaattttctttgaagggaattagatatagttggaataagatattttcggcatttgtcgcttgtatttttgaatttttcctcatcaaaaatcgccctttcttcgtccgtttgcgcttcgtaaaaatagttaaagcattttttgcgctcccttttgttcaatttcaaaaacgaatcccaaaagaagtatctctctctcggctcaattgaacgaaagtggaaaatgtgttggccatcgncattggtcgttcattctgtnccanatgatcactttgtatcgtccg

SEQ ID NO: 42909 - DNA, 705 bp, Heterodera glycines
aaccaaaaaaatcgatttttcaagtgtccgttggggtactcaaccatttatgggagcaaaatccaacgcagaattaaagtacaggctatagggaagctatcccgaaaggattcggtctccccataaatctgggcgcatcggttcggggggactgacccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattat

SEQ ID NO: 42910 - DNA, 939 bp, Heterodera glycines
cgccgggtggtcccactgcgtctgctcactgctgtgactgtgcgggggaaaagcgcgtttcccctcatttgtcagttggactcactcgatgtaatagggcaatctgttcatggtggaaatggcgcgttgccaaggcggttcgacgagatccacgaggaagtgctcgctgcaagggaagggatgcacttttagccgcgcttgcgttgcccgcaatcacctcgccggtccgaagtcgctgaacgccctctccagcgcggcgccccggcagccgacatttctcttcagccgctcatagcgcgcgttcaccgtctgcacttgcgagtccaagcggtcgctgagctgaatgcccgtggcctgcaagttgctggcccagtcgttgacgtcgtccacactcgtccccgcctcgtgcactctgcgccgcacttctttacattccgtccgcgcaccctcaaaacaaaacgaaagttgaaaagggtttcagagtccattggcactttcagctcctccaggcgaagttgctccacgggtttcagcgcgtccaattgctcttccaccgcactaatggccaacaaagcctcggccatcgctctgtccaactcgcccatttctctgagagcgttcgccacttgttccgaccaatggccaagttgctccttcagaaatgcccattgggtctgcagtctgttggaatccgccataatttgcatgccaatgcgacgctcttcccgctcagcttcatctaaatgaaaaaagcgaagatgggcacaaagccaacagaaaatgaaccccgactttttggagcgaaagggtcggaagagacatcggcgaggagtgcgggggcttggaggacggaccgaaggtcgtgttgcatcagaaaagtgttagccaattggatggtggactgaagcaattccaatccaatcgttggcacttttgctg

SEQ ID NO: 42911 - DNA, 861 bp, Heterodera glycines
  misc_feature (832)..(832): n is a, c, g, or t
cccccacactttttcacgtcgtccatcctccccccccccgtcatcatcagcagaggccctccgccccaccccatcccaattgcactgctgctgttgtttcttcatcgtcctcttcttgtccgtccgtcttcctttccttcatccatccattcatccaaccaccggtcgtcggccctgctctgtgcacatgatgacgacgacgccgccgctgccgaagtgtgccgctgctggtggtgtacagatggggggggggatgtacacgtagcgttttagggtgtcatcgccaacagcagcggcgtttccccctcttattcatatgtacatgttgtacatatgtgtaagtgtgtgtacgtcgttgtgtacatatagcagacagtagtcatcatcctcatcatcaacacatcggtggcagttttcgcaaccaaaaatttgctgctgattcgttgttttttgttgtttttgtctggcgtgctgattctgctgctgatcccccccttgtctttctccccgccgctgatcgatcagccaattccaattccctttggtctgcgctctctcatccatttgcccatatttattaatacgtgtggatttaccctctctccccctaccggctacttcataccaaatgaattgcatatgcatgaatcattctgagaaaattggtggagggggggggggggaggggagacggctctttttggtttgtgccccaccggccgtcgccgccgtttagaacgccgaccacgacgccgccggcgatgggaccaccgaccgacgaaatgagcgcgcgcactgcgcaacgtttcatgtaccaacgttttcttcccanaattaggggggtgtgctctttctcctgct

SEQ ID NO: 42912 - DNA, 975 bp, Heterodera glycines
ttaacactctatctatatcaacctcaagacttggagctgtgtatgtgattatctcttgtcaacttatatcagtcaaaaatgttctaatcttttttattcaattttatttatttaataaatccggtttttctattcgtttttatttaaatacagtgattcattaatttgattttttttatcaaaaaacatcataattaaaaaagaatgccaaaagcgatggaattgcaaattcaaattccaataaagtaaactgacttcaaagtgtaccgactaatcagttttatgttctttttttgaacccaataatcgccaattgaagtgacaatcagaaggaaaaggacggcacaatgtaaaaaaatgatggccatcgcattgttttgggaagtcaatgagacaatggccaaaggttgggagaaaatggggtcagacaaatcactcaaaacaatgccaaaaacggtcaaaagggcgacaatccactgaaaaaggcaaaaaagcaattaaaagagagataatacgaaaattaaaaaatattcaccgaaattacggcacaaatccatccaaagcgaaagccgacattttcatagtgccgcgcaaaaaaagtggctcggcacctttcggccataatgaaaaagtggaaaaacggattggccaccaaatacaaataagggggagcagccaaaaggaaggcgagccaaacaggggtcagcaaaagcacacagtttggaggagagaacgaagaatggaagagcatctgggaaaaggggaatgaagcaacattggttaattaattaattaattgccaacttaacatattaggtaacaaagtgttgtaccaacttgatatcggacaatggacaccccataaaaaattgcagtcaaaaaatagaggaaaacgaggttggcaatgaggatctgtccaacggaaatgcatttaaaaagataaatattattcatttttaccatcaaattgccatg

SEQ ID NO: 42913 - DNA, 1223 bp, Heterodera glycines
  misc_feature (8)..(8): n is a, c, g, or t
  misc_feature (1196)..(1196): n is a, c, g, or t
aaataaancggtgaaaaatgatcaattgtaattataaactttatcaaaatcaacaaataacggtttaaatcataaaactcacccgaattcgttctgacaattcggccgagtttctgttcgcgtacggaagtccgaccatcagcacacaacggcccaactcatcggagaagttgatgccttgaaaggccaatttagtcataattatatatataaaaaatatccaaaacttcataaatttacaaatccccccccaccccccgctgccgtaaaaaaccgaaccctcgctgagttttccgccgaccaccgcgaaaaggacggcaccctcgcgggaacgtgcggactcacaaaatgcgggccaaatctgctgctgtgagggtttcaaaaacaaattaatatggttcgactgtttttccatttttgaatttagttcccttttttgcttctcccatttctgtttccaccatttgcatttgctgccgtttccctgcgccatttttcgccgtctccgccgcctctttcgtctccacgtgaatccgtttgacactttgaagctgttcccattggcccgtggtgcgcaaatggtgcacaaaagaggccaaaaaggcgtaggaggggaaaaaggccaccgcgccgttgggcaccgaacggagcagcgccagcaaagattgggccaccgcggtgagcgcctggggcgaaccgcgcgcggaaaattgcaaattcaacggctgcgcggcgccattcggaccattgcctaaggcggggacggtttaaagcggcgtagggggggggggggaaatcgaatgggaaagagatgaatcataagggaactgatcaaagtgataaagaacacttgatagcagggatggcattccaaggcccaaaaatatttggaaatcgcgtgccatccctgcttgatagcactgttattgatatggggacaaactattggtgaatgagtgagtgatgatggaaaaatgagtaagtgatcgatcacaatattgttcacacagagttagcgaatgagcaactgatcccggcttctcggttttccggatcagtgttgcttcttcttctctatctcagagccaaagattataaattgtttgggaaatttgcctagtgatcaaacattgaagaaagttatcgatggttaattaagtctctgatcagtgaggtaaagcaacctttaaacccgnaaaattgaatggcaattggtaaaatca

SEQ ID NO: 42914 - DNA, 1561 bp, Heterodera glycines
  misc_feature (1462)..(1462): n is a, c, g, or t
  misc_feature (1467)..(1467): n is a, c, g, or t
  misc_feature (1489)..(1489): n is a, c, g, or t
agcagatcctgaaaatattgattttttagtgcaaccgtaccacactctgtggcttcggtatacggtagccacaattcaagcatttgtggtccaaaaatccggcatgggaaaatcatggcagccaaaaattgtatgaaattatggtgacaaacgccgccgggcatttaattattttccccatggcacagtaaaatccatgtgatacagtaatttaactatgacacagtaatattctcacccacgctacagtattatccctgtgatagagtcattttattatggtacaataaaatattctaatgataaaatatcctcagagcatgttcatgtcaccattttcacttatggtacagtaatgtccctgtaatacagtactatacaacaacaatatattctaatggtaaaatagcctcagggcatgtttatgtccccgttttacagtttctacccaccttattacagtaattacaacccattaactcagtctgatctgaccaattcttgccaattgttacagtaggggccgtcccataggtacagtaagatccccgggcccgactggcttttccttgcttacccgctcccgtcgtgtccatttgcgttgtaccgcgtcataggccaaatagggcgcgttgcggaacagctcgtcaacatgccgtagacggaacgcacagatgacggagtgccgtaggaagttgaaatcggacacaaatgtggcatagatcagcgcgtcctcaggggctgtggaaggaaaatgattttaaagagtgagcctagagtgggtggagggagggataaagcaatctcgagaatgaataggtatcagtttcgagaacttagcccgggcgtgaccgaaaaatacgtcagtggaaaatgcgtcagtaaatcgaatttcttgatttataacaatccattatagtaggattttttttttaagattttggtaagtttttaaaatttaataaataacaaaaaactaaaaaaataaaaaacacatgaaaatggaaatttgattttataaggatctcataataataataaactctttaagtttttcttttttaaaaatctttttatgaataaaagtcttaattttgtactctcgcgaaatggccgagaacatgttgcctcgagagtgccaagagaagcgaaaagcttgttactaatgccatcctcaccgacgtcgccggcggcaccgccgccatcgctgctgctgctgatggccaccaactcgtcaaaatagaagggccggctccgctccggcaccgagcagttcagccgtgccttcacaaatgttgaccattccgcggccgccacccgacgcggcacgcccgcgtccgttttgcacacgcgcgccacgcgcgagtaggcgcccggacggaactccgcggccgcctccgccgcctcctcgtggaagaagaaatagacgtactgcaaaaaatggaatttgttttatttttanatatntggcgttttgtcttccctcgcntacaattttttctttctcaccaaatgaaatcattcttggtatgttcaaagcatttgataactctattaacta

SEQ ID NO: 42915 - DNA, 1062 bp, Heterodera glycines
ttgaaaatgtttattaaaaaatttaaggatgaaatttaattaaaataaatccttcagaaaaaaaatcaatttatttttctaaataaataaaaaacattgtcagaggcagtgcctgccgaaaaaaagacaaaaaatttttcgaaaaaaagctaaaaaaattgaaaatttaaataaatttacaagtgaaaaaaggaaaaaaagcttacaacactttcgattcccaggacgtctccgttccaagtactaagaaggcccaacgttgcttaacttgccagacggacgggatggcgtgctttcaacgtggtatggtcgtaagcaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaagaatgaaatataattaaaataaatcaaaaagaaaaaaaacatttatttttctaaataaataaaaaatattgtcagaggcagtgcctgccgaaaaaaaagacaaaaaatatttcgaaaaaagctaaaaaaattgaaaatttaaataaatttaaaagtgaaaaaggaaaaaagcttacaacacctttgattcccaggacgtctccgttccaagtactaagaaggcccaacgttgcttaacttgccagatcggacgggatggcgtgctttcaacgtggtatggtcgtaagcgaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttgaggatgaaatataattaaaataaatcaaaaagaaaaaaaatcaatttattttttctaataataaaaaacattgtcagaggcagtgcctggcgaaaaaaaacaaaaaatttttcgaaaaaagctaaaaaattgaaaatttaataaattttacagtgaaaaaagaaaaa

SEQ ID NO: 42916 - DNA, 1547 bp, Heterodera glycines
accagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctctaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaagtgagagcctgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctggcctcaagaccgagctcacgcagctactccgagcatctcagcgcactccgcctgcaaatgccccattcgccactgaacagaaggacagcaaaccccagtctggaggctagcagtacaacgtacagcaacaaacggggtgaatgcagaccagatacgccagctctgtccgtttccacctcatcggtttcacgtcctctt

SEQ ID NO: 42917 - DNA, 952 bp, Heterodera glycines
tcaaatagattttttcacacggtcattgttttccctgctttgaccgacgaacgacagaaggcggtcatttgcgatgatcattactgcttcaagttaatcaaaaacaatatcaatgttatcgttattcgatgcgaacacgaccgctatgaagaggcggttgcagcagaggactggtttaaccagcagacagttgaagaacatatggaaagcatgataaagttatttatatttaaattttttatgtctttggtaggtttcaaaatagttttaacagtatctttcttctctcataaatatactcacagtacagtaagaacgttgcttaacttacctgaatatatggaatagcaaaaataccaaataaactagaaaagttcaaaattttgtgattctcaacagtctaaataaaattttttctattaagggaatggctgaaaaccaaaaaggatgagccgctcattacactcgcgattcccatgtacccacatttatattatcgtagcatggtcttgctacgaaatagggccattcctcgagccggaaccacaattacattgggtgaaacgaaaattttaatttaattttttaatattttatttttgaaaggtgttacttcgaccagaatcagttctgctagggccgaacggagtttcaataaaatgataatcacagaagatggcatagaagaaattttccatgttcacttgctcgtgtgagttatgcgacaaagcagaaaagtcaaccgactgagcaaatatcttctatcatttacttgttcaccaaaaaattggtcaactaaatccatctatcttccttgctatatttacataaatatgagaaccgaaccaccaattttattttggaaatttaataaaaattcttttgaaagttttaaatttaaaatcaaaaaattgaggttcgggaaaatggaaaaatatctaaaatttatccc

SEQ ID NO: 42918 - DNA, 1051 bp, Heterodera glycines
cgaattccccccccaaacgaaaattaaaacgtttaataggcaaatttcgtaacaagtagcactcaaatttccaaaaattttttccggcggcgcctatcggcaccgccggacctacattttccactattgttacaagttttttgccctaaaacggccaatatttggtcatttttagtgtaaaagtgcagttgttacccagcagcaactattcaataatgaatgaaatattttggaaagaacgaaaaaaacttataaataagacacaaaattttatcaactaataaatataagaaattataatatcaaatacaaaaaaaacataataaatttaaaaaaagacattttcaaggagaaaaaaatgaaaaataatagctatattggcaaaaaaatttgattcattataaaaataaatttataaacaaaatatttaaacaaaaagaccaataaaaatgatttaaaataaaatttcaaaaaatattaaagcaaatatttgcattaaaataaaagaaaataataataaaagaaaaaacatatttattaaatatttattttttatgttattttaactaatgatttttaatattacaaaaatgcaaatataagaaaattgtcagcagtaccagccaaattgaatctagacaagagatttatttaaatggttaaattaataactattgttgttaataattgtttattgtacattaaaatagtaggaaaatcattaaaaaaagactaaatatataaaatttatcaagtgagaaaataaataattaaaacttagaatttaaaaaacaaagataattttaataaaaaaatagatttatcttgattttaactcaatatttctaaaaaattattttttcacttatttttgtaataataatttttttgcaaataaaatttctttttatttattgttctggatagaccttatattttgataataagacaaataataaatctggataaaaacatatcattacagcaaacgcaaataatatagttgaaatagcgagaaataattatttacaattcaaattaaaaaaaataa

SEQ ID NO: 42919 - DNA, 999 bp, Heterodera glycines
  misc_feature (890)..(890): n is a, c, g, or t
ttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcacgagttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcacgagttcttagaaaagagccagaattagcataaaattaacgacacataaagtgttggccccagtgccgtacagaggctgcaaaggcgagcataatacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcantaaattaacgacacataaagtgttggccccagtgccgtacagaggctgcaaaggcgagcataatacttccttgcttttatatttccgcacgagttctagaaaagagcca

SEQ ID NO: 42920 - DNA, 1115 bp, Heterodera glycines
aaatctaaaaaagcgactgacttcactttgtacaatctgaccatctcttttcgtctgatctttcctaaacacaatcgccacgaagtcatcgaaaagagaactctgagaatcagcacagatttagcaaaaatgacagacaatttgtaggataataatgctcattgtcagaggacataaaaaatcaaaatagaaaagcacttttcaatttacgctttttcaatgaatggaggaaataaatgtttttcgcatgcaacaattactaaaagcaacaatattctaacaaaacagtaaacgtttcccgtttttggatctgatcaaaaatcaaatgttacactagcaaaaagatcagattggtggtgctgcactggatcatcatcgaaatcatcttctggggattgccccgataaactccgctcactcaaacactcatcagctgctgtagccgatctttttggcaatctgaaaatcgtgggcattacaattacaaattggcaattttgtataataattaccccctccgtcagttcttcgacggctctcagcctctgttccaacgcattgagcaaattggccaaatccgcgcatttcgaattgatttccgccacttcttgacgaaggtcaatcgaattttggtgactctctgtgaaaacattcaaaaatgtttttttgtattttctcacccaacgatccgtgcgaaggaccgagcgcattttcaacagtttttttggcttggccgatcatttcttgcaatttactgcgtttgctctccccgtttttcgcctgttggacattgttttgtttcagattttcagcagcctttttcccagaattatctaaattccgtaacttgattacctaattacctttacttctttgagaaactcttcctaaatcatttgaattgttttgtcctaccgtccgccgttttcttcccacttttctgtatttgctggtgcttttcagcgtcttttggtcggttcgtgtcgcttcggattaattcgggtttaatggctgaatacaaaggtttgtccttgtaataaagctggtcagctgcttttattactgaatttaatcgttctagaaaaaatcgtcattaattacctgagaattacaaa

SEQ ID NO: 42921 - DNA, 867 bp, Heterodera glycines
taggcttagaatcaccttttagtatttcaaaaatgaatttttgatatatcttttttgaaaaaaaaattcgaattagggatacattttcaaatttttaaaatttttcacaaaaaatttctataaattctcaaaaatcctcaaaacacgttaaatgaaaatatgtacgaaaaattgcgaaatatgtacgaaataagtccgaaatatgtataaaaatattacatatgtaatatgtagaaaaaccccgaaatatgtaaaaatatgtaaataaaagtccctacttttgtttgcaaacacaaaaaagaaagtgttttttctactaattaggctaaggagaatccaggaaaaaatatgtatttacaaaattcccagccctaaacgggcaacgacaactggtcaatgatataacaatcatcatttttaaaataattttcatacaacgaatacaacaaacatttcgggccaggtcgttttcgcgctgtcattttcgcgcaggcgtcgttttcgcgcggggatccttttcgcgccagcgctttttaagcattagaattgcgaatatgcttaaagtaaaataaaaacaaaaaaatttcttataaaaatttataaatttaacaaactaaggttaaatttcatgtttcgggaaataccactgaaaaaattgataatggtttcgagactcaaattgacattggcataattatgatcattttgtgggacgaagttgtcataattttgataaaaattcattttgaaaacttaatataatctacatattaagtttagaaatccacaaaaacccatatttgatcagcggcataaattaccccaaaaaattattcttcgaaaatttttgagtgaaaaaatttctat

SEQ ID NO: 42922 - DNA, 1132 bp, Heterodera glycines
  misc_feature (46)..(46): n is a, c, g, or t
  misc_feature (96)..(96): n is a, c, g, or t
  misc_feature (115)..(115): n is a, c, g, or t
  misc_feature (1116)..(1116): n is a, c, g, or t
taattgattcgaatgttttatcgcggttaattagagcaacgaaaanttggttgaatcgtgaagtttatcatttctactcactttctcaaattgtgnataaattgcaaatatattntccaaaagtctgttgacactttctgaaaataaattctatactcatgtattttccacttattagattttgcaggcttattgctgcatgttatttgacacttcttcaaaataacctaagccctttattcgttcaaaacagcatctttgttgtttcgctttgattaacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgttgacactttctgaaaataaattctatactcatgtattttccacttattagattttgcaggcttattgctgcatgttatttgacacttcttcaaaataacctaagccctttattcgttcaaaacaccatctttgttgtttcgctttggattaacaagcccaatgataaatagctcgagcgcaaaacgcgtgcatgtttggaaagtatcgttcacaccaataattgagggtttatttttaaatgacattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacaccatctttgttgtttcgctttagattgacaagcccaatgataaantagctcgagcgcaaaa

SEQ ID NO: 42923 - DNA, 205 bp, Heterodera glycines
tctggagctggtgctgcgcaccgccgccggtctgaaagccaacccgcagccggaactgttgaaacacaaggtgatcgccagctgcttcttcgaagcctcgacccgtactcgcctgtcgttcgaaacctcgatgcaccgcctcggcgcctcggtggtgggcttcgccgacggcagcaacacctcgctcggcaagaaaggcgaaacc

SEQ ID NO: 42924 - DNA, 994 bp, Heterodera glycines
aaaatggctatctcttttttttgatgaattttatacacatacaaatgctctcgagcatgatagggagggcggtgcgcaatagaccttttattttttgagggaatttttaaatttatactctatcccagaaaaatgtctatctctttttttgagaaattttatacctcacaaaagcgctcgcgtatgagacggagggcggtgcacaatcgccattttatttcacagaggatttttatatttagaggttatcccagaaaaatggctatctctttttttgataaattttatacacatacaaaagctctcgagcatgatagggagggcggtgcacaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaattttt

SEQ ID NO: 42925 - DNA, 1225 bp, Heterodera glycines
ttctctcatcatctttttctgtccttttttcaatttaacatttttcaaatttcttcttttttatatacatatttgctgggttaaattttgaaaactattatgttttttgtaatataaaatataaaaattttaaattttttgaccccgacactttttggcaatttttcggagttactccgacccttacagaaatgccatctctaattattaaatgaaattttgaattctcatgattttagatagcattaaatagcctttaactgtgaacggatcatcgtcgtttttgaaaacactgtcgcatgttcgatcttgagattttccatggcattcgaatttttcaaacttttggcattttgttgtgaatttttttttggctttgcctcttcctttttaaatttatttctgagcccagaaaacattccttgggaataatgggccagaaaagaacagcaaactgcgaacagcagaaaaatactcgcattcatctgaaaatttattttattttttaattcataaatttcgcaagctgattatttgtgcttcaccgtaaaatactttggtattgaaaataatgaaaataaaaaattttacattattttttaatgaaaaaagattttttggaaaagaaagagcaataaagcaatatgcagcttattcatgtataaagttgtattttttttataatttaagcatatgatcccaatttttggcaatcaatttgccaactctgataaagcgattatgcaaaaatttaaaaagaaatgccctcctaaaattggccaagcaaatgcttcatctctgtttaagaatatgatgccaattttggcaatcaatttgccaactctgataaagccgttatgacaagtttgaagaaaatttgagaaattatacattcaaattgaattgccattttattatttattgcatgatttttggccctattttatggcacatatttcgtgatttatatccaaatttgcagcgctctaatcattaaatttataaaatttagtaaaaaaaagtgctcacgctgctcagttttgccaactttcttccaggtggactggttgaagtcgcgctgtgaggcgcatttgttcattgtgtggagataccattgatcgaccgtgtgaatctggtcgagaaatatcagcttacaaattttaaagtgcctttttcatttaaaatttttcatcttttaaaattttttattttaagaattttgttt

SEQ ID NO: 42926 - DNA, 1069 bp, Heterodera glycines
atagaaaactgaagatttaataaatttgagagttcaagaaatattttcaaatatttctccttagcggtcattttatttggtagtccacagtcggaattatttccgataggtcgtctaaaatattccaatagaaactgaaagattcaataaatttgagagttcaagaaatattttcgaatatttctccttagcggtcattttatttggtagtccacagtcgtaattatttccaataggtcgtctaaaatattccaatagaaaactgaagattcaataaatttgagagttcaagaaatattttcgaatatttctccttagcggtcattttatttggtagtccacagtcggaattatttacggtacgtcggctaaaatattccaatagaaaactgaagatttaataaatttgagagttcaagaaatattttcaaatatttctccttagcggtcattttatttggtagtccacagtcggaattatttacaatacgtcgcctaaaatattccaatagaaaactgaagattcaataaatttgagagttcaagaaatattttcaaacatttctccttagcggtcattttatttggtagtccacagtcggaattatttacggtacgtcgcctaaaatattccaatagaaaactgaagattcaataaatttgagagttcaaaaaatattttcgaatatttctccttagcggtcattttatttggtagtccacagtcggaattatttacggtacgtcgtctaaaatattccaatagaaaactgaagattcataaatttgagggttcaagaaatattttcaaatatttctccttagcggtcattttatttggtagtccacagtcggaattatttacggtacgtcgcttaaaatattccaatagaaaactgaagattcataaatttgagggttcaagaaatattttcgaacatttctcattagcggtcattttatttggtagtccacagtcggaattatttacggtacgtcgcttaaaatattccaatagaaaactgaagatttcataaatttgaggagtcaagaaatattttcaaatatt

SEQ ID NO: 42927 - DNA, 1160 bp, Heterodera glycines
gctcgagctgctctttccaatggtcttatcccggtctcgatccgtgacgactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttaaaatagtagtttggttcagaattttcccctctacaaaaaaaaattataatagaattttttattattaattcgaaatcgttaatttatttgacaaatccaagacttaaaattgggagaagcatggggctgtggctgaggacccaaaatggggccccattggggaattaaacatgatttctgaaaaagtccctgaaatgtcgattttttctttccatatcttcttgtaaagctcgagctgttctttccaatggtcttatcccggtctcgatccctgccgaactcaaaaagttatgaagtgaaatgtttgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgtaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaattttttccctagttttgattgggttttaaaatagtagtttggttctagaatttttccctactacaaa

SEQ ID NO: 42928 - DNA, 1147 bp, Heterodera glycines
atagccggctcatgttgacgccgacgatggcgaaaagcgaacgcaaaagggcggcgattattcgccgcggcggaaagattcgcttgggcggcgaaagaagctgaaaataaagaaaaaatgaaggttaattgggatgaaaaagcgtttttattaaatataattaccagttttggctttgacggtgattccgatggccaaataaatggcagtggtcacgagatttgtgagcaaattggaaagagcgaaaaatgcaacggatggaccctaaaatttaatgaattccattttaaaattcaatttaaataaataatttttatttttttggacttggacaatgtcgacgatacatccgctgatcatcagtcctttgagctgtttagcagtcaaaaagagtgtgcaaagtaacgcagcggagaacagagaacagacaaaagtaatcgcgcccaaataaaagcgcaaattaattttggagtgccttttttaattggataattaagtcaattaatttgggatgtttttttatgccttacttttccgggaaaagaacacaaatgagtcggtcaagcccagtgaaaaacattgaaatggcaatgccacctaaaattggcacgatttttgattttcacttttaaatttgtcccacccattccaaagacggaaagtgccgcgaaaagtgcggccgtttgatattcgatgaaatttaagcccgaaaaagcgacgaacacaaacagaaaatggccatgctgatggagcagttcgaagaaagagcaaagtgccagcagaaaattggcagtgccattcaaagccccaaaaaaaggattagaataattgaaacggaatttaaaatataaatgcggactttgagcgaattgtcgcaaaaataacgcaaaaattgaaaagtatttcgcaggcggcgacacttctcaaagggagggcacaaccgatgagaaggcgactcggacgagcatctttgaactcggcatacagctgaatatactcgtttggtttttaacccaattattataaaatgactttctcctactgaattattaatgtttgtgtcgaccacagccattggaaattttttctgaatttatccccaaatgaattcaacccatttttttctttattttttaagcgccgcttt

SEQ ID NO: 42929 - DNA, 989 bp, Heterodera glycines
  misc_feature (910)..(911): n is a, c, g, or t
  misc_feature (922)..(922): n is a, c, g, or t
  misc_feature (950)..(950): n is a, c, g, or t
aagtaaatttttaaaaggtaataatggggatccaagggcaattatagaaaactaacgaaaattattattcataatttactttttaaaacctatggaaattttgatattaataatataactattaataatataatatcataagaatgattaattatgaacaattcttatgaattttattctgttgatatttaaattaatcaattttattttatttacgtcatagctctcctccccctataattaatctttatatatatataaatcataattacttttttaattgttttacgtcatctcaccctatgtaatatttgtgcaaaattaaaacaacagtttttaataaatacaagtcgagaaaccccaagtgtcacttaaaattattaaataacgtagttatatcataaaaggggagttgaaaagcaatttaattaataaaataattataaatgtttttatctaaaagaacattaacaaaaaagaaaaaccctaatctctaattataattatccagctaaactaatacaaaaaatgaaatttattttttttatcgctatatttctagatatacttaataggtggctaaatgtagtttaaaaatgctgtttaatgaataatgatttgttaaatcttgtaagattttgccaatcaattgcagtgatgtttcgaatattattatttttaatataaatattaagattttatttttatgtatacttttgttaatatatttttaaataaatattattatgtagctttaaattatttatatgaaagaaattaagttttctataagattttagaattaaatttgttataccagcaaagatcattttggttcgaatatactaagtgaaaaatataatagtaatattagaaaatttattatattcttgattaataatttttttannattattagctngttgatataaaataaatattttatcgangtatttgaaaatttatttgtattttttaattttttcctt

SEQ ID NO: 42930 - DNA, 1021 bp, Heterodera glycines
agagcatttggcgtaaatttttgcccgctatttcaaaatttacactgaaaaatgcctttttgtattttctattttgatatgccataactcgtttcattcccaacgaaactgaacaaatttggtatctaaaaaaagtttttgaaaatgggaatctttttctaagcgaatgttaagtaatttgtcatctcagaaaaaagttgtgggaatttcaaacttttatcatgttataactcaagtcctaggcagctctttctaaccaaaatgctaaatttattcttttttctattgattctaaatgttcaaagtgattttgtacccttataaccaaaattattagaattttcgaatttatgttttttcatgtgttagagacatgaaaatagtacgccaaaaagagaaaaaagaaattcacataattttcaccaaataacttttgagtgagccttatttttgtataaaattcatgcaaaatttaaagaaaatctgtaaggcgaaaaaaaagttgtatagagcgaagtaaatgttattttttgcataaataaaatgaagagatagtacgccaaagagagagagaaattacaaagaaaaagaaaaacgacgagatagtactaggcttttctctgctcagtggggcgtacccatagtgtaacaggttcctgcgtgcgacagagaagcgaaataaaaagcaggtaaatgacacagaaaactgtcatcattatgccaaaaatcccgctaattcaaaaatttccccttccaattcggtactgcccgcgttgacagacagtgcactatttcttcttttcctccttccctcctcttgcactatttcatccccagcggcagacagtgaactatttcactgcccttccacccggccgctgccccgcgtagttagcattaaaagttcttcattgatatgtaattggagacaaattatttctactataaatatccaaactattgtaattaaaataccttaaacgacaaatcttggtacaaaaaaaaatggcaaaatcaaaat

SEQ ID NO: 42931 - DNA, 644 bp, Heterodera glycines
  misc_feature (23)..(23): n is a, c, g, or t
ctcaaagtgaatggaataataanttattggaaaaatatttctcccataaaatttgagaatgcattttaaagaaaacagtttgaaattcggaacagaaactcctcaccatccaccattccaaaaaaaacaaaacaaaagccatttccaaaaccaataaagccccaaataaattagaaccagatgcttttaataattcaaacaacaaaatctaatcgacacggttatcccttccgtcggggtccctttgccctcctccgctgacccccgcttttcacattcggcccagtgggacaactgctggcggatccattcattgctcggcgggggagggtggcggcgtaacttttgacggcaacataaacagcccccgggggagggcgagggggagaagggggtgggggggagcgcttgaagtggtgacgctgcgttcatcgaccgctaaacaatgacgggggaggcagcataagcttcgcaacgatacgtacggcaaaagcgatgggttggcggtggattataaggttttgaggcagcgggggcaggggagggggaggggaagggttggaagggtcgggtaattgtgagcgtggtaaccggggaatatgcctgctgctgcttaccccccgcccattcggtggctttactca

SEQ ID NO: 42932 - DNA, 1088 bp, Heterodera glycines
  misc_feature (51)..(51): n is a, c, g, or t
actctccacaggtaatttgtgtgaagtgcgtaccatcctctcgccctcctntaagccaaaatgcttaaaatttggatgcataagaaaccggcttcctattgctgtttaaacgattcattcgtacttttaaaaaattggagagggaattcggggtctcttgcttttaatcatagccacagagtactcaagaaaaataattaataactttcttttcgttaagccaattaggcatttgctttcgacaaaccccaaacattggaaattgttttgccattccattaatgtttttcttcttcaaatttcattctgatttaacatttcagtctcgaaagcactgtctcattggatgagaaaaaacgagaagcggtgcgcatggctcagcgggtggcacaatttgcacgagaagtccgtttgaagaaggtagtcacttaatagctatgctcttaaatcttttcaaaaatctcgtactgtaagggaaggggaagggcggtgggggtgatgagtggtgatgagacggacacctggggagtgacagagagcaacatttccctcatttctctctccctcccacccatgcgctgtcttcgccacttgtctttctcttcctctttatccactttgtggttgagatcaattcataggactatttggctgtttctgcttttctccttactcccctaccccatccctcccccgctcttacaatgtccccgaataaattccaaaaacaattgccccccgaacttttgtatgaaattgtctttttcatcaacccccgaaatgacttgtcccatctctgtacctcctcttatacaatacgaaaatttatgtatccgcggataattaaatggaacgaattttgtcgctcggtataatttaggaggaaatttatcaccatcaaaagagtggtccgcattcataatcctatcattttttaggcactcgcgacgctggaggagacatttggacgcgcgaagaacagcccgacttggcgtgctattttggccatggcttcagctggtgctcagaacaacgacccatcttctcatcagcttcttacgaccctgtcttccgccatttgtattatt

SEQ ID NO: 42933 - DNA, 995 bp, Heterodera glycines
aaaagagatagccattttttcaaaaattttcacgatcaaatgcgctgagaaaaaaatccagaacaattagtatcggcgtcattatgctgagagtgcggtggaattcccttgactgtagaccagaaaaagagatagccatttttccaaaatttttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtaga

SEQ ID NO: 42934 - DNA, 1186 bp, Heterodera glycines
ttcgacaaacatcctgtacaccataaatcgatttcatatttagtcgaactatataaattttcaaacaatgattcatctttcttatggatagcgcatatgtctctagctttatagaaacggtcgccgaatctgcgaggagctacttttttgagaatttctatagattattattctgcatgaatccttcgcttaaattcccatttatcttataaagtcagattaaattaattactccgatttgttttagaattggtccaaatacgcttgctaatagcttttcttttcgaaaagagaggcgaggaaaaataaaggttgcatccaaatgtaatttttttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattctgcatgaatccttcgcttaaattcccatttatctcataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactcaatatttgcaggaatagcaatggcaggtctatcttaaaggcctgacgagttatgtttcgacaaacatcctctacaccataaatcgattttcaaatttagtcgaactatataaatttttcaaaaaatgattcatcttttttatggttagcgcatatgtctctagctttatagaaacggtccccgaatctgcgag

SEQ ID NO: 42935 - DNA, 1267 bp, Heterodera glycines
cgtcgcgtcgcgccaacagatcaaagtgcggcaccccgcccagcggcagcaacaaaagccttctcccatttccttcgcccgtactttttgcttttgctcggctttcaccttttgccgccgcccccggggggacggcggcgatggaaatgcctccgaaattcggcggcgattaaaattgatttccttcacccaatttcagagggcgaaaagaagcgaaagttctaatgggagatggatatggataaataaataaatgtaaaattaaatcctgttggaagaacttatgttagtcaaaaaaaaacttacattaaaaaagggaaaagcattcgtgccaaagaagaaagaaatttttggtaaaaaaaaatgatgccaattttagtgataaatctatgttggccgagactctcggcctcggttcataaaaggatttagaaaaaaagaccaggacaagttgagatttcgaattcttgaatctaaatcctcatggactatgtatgcctcaagaatgataataaggatgaaaaattgcatgactgagagattaggttgtaatcggacagatcgagtgaagaattaggtgtccgatcattcgcacaattattactagggctggtaattatatgcacatgcatatttttttcctgaactgcgggaggcctgaaacgcatgaaaaacgtgtttctagcttgattagaagcttctagagtggatttccatttgcatatttgtgcacatttcgcgattttatgtgcatataattacctgccctactcataatggctgtattcctggatgcgttctaaaagttaatttgggagaaaggcaaaagttaatatttttttgaaaattttttgggattttaaacattggcgccgaaaaagccactttatatagggcgccgaagtggccgcgccggaaaaccccgcgccgaagtgatcccgacccattttttcacataataaccaaatcctttggtttctatcgaaattttatgtaaatgtttataaaaaagcggacataaaaatacatagggatgttgtatatgtgggtgatcgaaatcacatggaaaggactgggcactcattcgtcgcgtcgtgtgccgttttggtcagctacgggccaagtccgggttgaactgtgagttgtaacgccgctgtcggtcctcctcggcttggctttcacagttacaactttctcatcctttggctccggcttgacgaaaagctgcttcgtcttgacctgctcctgtcgctcgcgcaccattcgc

SEQ ID NO: 42936 - DNA, 1139 bp, Heterodera glycines
  misc_feature (39)..(39): n is a, c, g, or t
  misc_feature (50)..(50): n is a, c, g, or t
  misc_feature (101)..(101): n is a, c, g, or t
  misc_feature (189)..(189): n is a, c, g, or t
  misc_feature (308)..(308): n is a, c, g, or t
caaagtacaaaaatattaatatatcaaggtaacagaganaatgagttcanagctatgaatagaagcgggtgaataaaattcagaattttctgcaatgatgnaatgagttcaaaacttgcatagaaatagttttgtaaatctgataaaattcaagttattaaaaaccaattaaatttaaaataaaaaatntaatagcatgaaaattaaatatcttatcaaaaatattaaatcataattgactattatttattaaaaaattgtttactacaaatcagttttaagatgcatattctattattattgttatntaagaaatcaaaattcaaagcaataaataagctttgggaacattactcaatgatcgactaaatctgatctcgttttctgaaataaaaaatatataataaataataaatgacttaaaagattaaattaatttagcataggtgaaattgactaagaataaaaataatttatttttgtaataaataattaattaaaagaaatcaagtgcttatttgttgaatttgttgagataagcttttaatttttttcacttataccatttactttaatttttagatatatttattgtaatcattttatacattatattctttgtttataaacaatttaaagaattaaaaactgttatttttgaggtaatttttaaatcatattttatgcaaatttgaaaaacatcctttaaaatttttttgaaggatataaacaaaaatgatattacttactaaaatgttaaagtttttagtaaaagctaacattccgcaggctcaacaattctttgttgtggactttaatgaatgtattttaataaaaaatcaaaccaaaatttactaatagaaaaattaataatttttataagtctttttatgtataacataaaacaaatgtatcagttaaaaaacaaggcatcattataaattaatatatagattaaaaacccaaatgaaaataaaattcgaagaactgacaacctaatatattattatttaattaaatgccattaaacgaatcttatttaggccctctccatgttctgagaatttttttatacttgcagcacttgggttgcacaaaaataaaactatataactatattcgacgcccttatgctacat

SEQ ID NO: 42937 - DNA, 946 bp, Heterodera glycines
agaatgcggtggaattcctattactgtgagcagaaaatgagatatccaattttccaaattttcccaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaatgagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttccaaaacaaacgcgccgagaaacaaattccagaacaattagtatcggcgtaattattctgagaatgcggttggaattcctattactgttgagcagaaaatgagatatccaattttccaaatttttcccaaacaa

SEQ ID NO: 42938 - DNA, 883 bp, Heterodera glycines
acctatcatgccttgaaatattttaaaataaattccttaaaaaattaaaaattttattataattgcaaaatgtgatcccagcaaccaacatttatgcaaaactaatttataataaattatttatttctttttcttttagctcatattaaatttgccaataaatcagaaaatttgtttgtttgcttttcattggcacatggacacgagcagccaagagctgaacgcgtgtgccgagtgcggcttcaccacccgggactgggcactgttcacgcgtcatgtggaacggcacgaaagcgccgatggcatcattaacagttggaaaagttcaaagactgtgccgacaacgcccgaggcgatggacgaaagcgtagaagcggaagatggtggtggcacagattttcaggtggaattaaatcttgtaattattatttttttttttttttgatattactgattattcttgaaaattatggattttaaaacttattcatttacctaagtatttcttggattttttacatttatactaatgactcgcaggcgcatttaagccctataaattggtccgcaaaatttttgaaacttaaaatttattccggaattctgctatccgtctgtaatacttcaattcgatcatttacaatttcctttaaaatccgctttttcaaaaattgaaaattttttctcgactccttcaccatgaatttgcaaattttcattagataatttacattcctgtcaagtctatcattttcatccctcaaccaatttttttttctcaattttcccccttccgttttttggggtcatggcagttcgtacaatgggcagttcgtacaatgggcagttcgtacaatgggcagttcgtacaatgggcagttcg

SEQ ID NO: 42939 - DNA, 938 bp, Heterodera glycines
gaatttcaagtgataatgaaatgtaaatagagaatctcacattttcagctacttaatctctaaaaataaactgcatcagtgttgtagaaggatcgggttaataatattctcagttttattattttcacgatcacccttgtgaaattctcaaaatttcagatcattatcctctaaatataaaccgtaacagtgttgcagaaatatcgacttggtaacgccaattatctccgatttattgttgtcactatcatctttgtgaaattttcaaaatttcagctcattttcctctaaatatatctgtattaagttgcgaatgaaaattgtaaatcggagattattagcgtttatcaactcaatccttccgtaacactgacacagtttattttaagtgaataaggagctgaaattatgagaaattcacaaaattggacgcaaaaatagtaaatggaagattgtttggcgctaccaattcgatatttccgcagcactgttacagtttatatttagaggatacggagctgcaattgcacgaatttcaagtgataatgaaatgtaaatagagaatctcacattttcagctacttaatctctaaaaataaactgcatcagtgttgtagaaggatcgggttaataatattctcagttttattattttcacgatcacccttgtgaaattctcaaaatttcagatcattatcctctaaatataaaccgtaacagtgttgcagaaatatcgacttggtaacgccaattatctccgatttattgttgtcactatcatctttgtgaaattttcaaaatttcagctcattttcctctaaatatatctgtattaagttgcgaatgaaaattgtaaatcggagattattagcgtttatcaactcaatccttccgtaacactgacacagtttattttaagtgaataaggagctgaaatt

SEQ ID NO: 42940 - DNA, 967 bp, Heterodera glycines
tagatcacatgcgattttcggcactctgatattttagcgctcataatgggatgtataaaggcgattgtagaaggaattggatgcgctaaaattgtttgagaagctttttgagcgtagttacgatttttacttagaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttaaatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgcatcataatg

SEQ ID NO: 42941 - DNA, 815 bp, Heterodera glycines
gggtcaatgccacctccggccgccaacttcgtctccttctcctgatcagtgccacctccgaccgtcatctcccctttcccagcctctgtgcctcctccggccgtcatcttcttcgccttctccgggtcaatgccacctccgaccgtcatcttcttcgccttctccgggtcaatgccacttccggccgccaacttcgtctcctccgggtcaatgccacctccggccgccaacttcgtctccttctcctgatcggtgccacctccgaccgtcatcttcttcgccttctccgggtcaatgccacttccggccgccaacttcgtctccttctcctgatcggtgccacctccggccgtcatcttcttcgccttctccgggtcaatgccacttccggccgccaacttcgtctccttctcctgatcagtgccacctccgaccgtcatctcccctttcccagcatctgtgcctcctccgaccgtcatcttcttcgccttctccgggtcaatgccacctccgaccgtcatcttcttcgccttctccgggtcaatgccacttccggccgccaacttcgtctcctccgggtcaatgccacctccggccgccaacttcttctccttctcctgatcggtgccacctccgaccgtcatcttcttcgccttctccgggtcaatgccacttccggccgccaacttcgtctccttctcctgatcggtgccacctccgaccgtcatcttcttctccttctccgggtcgatgccacttccggccgtcaacttcgtctccttctcctgatcggtgccacctcccgaccgtcatct

SEQ ID NO: 42942 - DNA, 1323 bp, Heterodera glycines
  misc_feature (1231)..(1231): n is a, c, g, or t
  misc_feature (1250)..(1251): n is a, c, g, or t
  misc_feature (1260)..(1260): n is a, c, g, or t
  misc_feature (1267)..(1267): n is a, c, g, or t
  misc_feature (1278)..(1278): n is a, c, g, or t
gaagaagacgaagttgacggtaggaagtgccatccaacaggagaagacgaagaagatggcgggcggtggcggctctgatcaggagaagtagaagaagttggcgggcggaagtgtcattgaggaggagaaggagaagaagacgccggtctgaggtgccactgatcaggagaaggagatgatgttggcgggcggaggtgtcattgagcaggaggagaagatgttggcgggcggaggcggcattgcgccggagaagacgaagatgatggtggtcggaggtggcattgccgaggagaaggagaagaagatgacggccggaggagccacagaggctgggaaaggggagatgacggtcggaggtggcactgatcaggagaaggagacgaagttggcggccggaagtggcattgacccggaggagacgaagttggcggccggaagtggcattgacccggagaaggcgaagaagatgacggtcggatgaggcacagaggctgggaaaggggagatgacggtcggaggtggcactgatcaggagaaggagacgaagttggcggccggaggtggcattgacccggaggagacgaagttggcggccggaagtggcaccgatcaggagaaggcgaagaagatgacggtcggaggaggcacagaggctgggaaaggggagatgacggtcggaggtggcactgatcaggagaaggagacgaagttggcggccggaagtggcattgacccggatagtgtaaaatgcactattttcttaagaaatacagtactttttataggcaccgaaataaaagtcgacgtatgtcagcgggcctaaatcgtagacccactattccaaaggcaatacggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccccctatattttgatcaaattgtgaatatggtaaaataaatcaaataaatgtttatgtcacaaatgcaaatatggtatcattggaaagcccataaaaatgctatccnatggtatgctacttatctnngtgaattgnaaatgancatttatacgncattatttttttcaagcatgatgggacacacttatgaccatgact

SEQ ID NO: 42943 - DNA, 1078 bp, Heterodera glycines
  misc_feature (1007)..(1007): n is a, c, g, or t
  misc_feature (1061)..(1061): n is a, c, g, or t
tatgtattctccaacttataattcgggtggtttttttgttggtcttaaattcgaaaaaaaaattagaaaagaattttccgaaaaatgggtgaccaaaaaatagtcccgacccattaggctttcgaatgacaccacgtatggcaagaaaagtctgaaaatttaaaagacaatatttatgaaacgacctaacgctttggttttttgaaaatttgccaaaattcctctctttttttttgattttccatcgaatttttccaaaatctctccccattgttttttcagtgccaatttgtccgaccaatactttgtcaaccgtcgtgatcgctatttgctgatcgaagactgtccattgttggccgacttcttcgtcgacctgttccacctcgtcggagacaattccttccgtcttttggcggacggacgcgtcgaattcaccgccggcggaacgctttcgccgatacacccggagacaggtacaaaaataggggcgaggattttataaaattcgggaaaaatttctatatttttgaggaaaaatgcatttttgggggttcggtattctttagaaatcttgaaaaaaatcctgatttttcgaaaattttctattttttatggtccttcccgcgcattcaacgccacattagcgacgaggtggacaaactgttcgccaggttcaaaacgaaagtggcgatgcaaaaagcagccgacgcgacgtcagccaaaaaaagtaaggaaaaagaagggggaaaatggaccagcaccgggtgggtgccgaacccggaacgatgggaggaatgagaaaaagggagaagggctggtacaattcattacccaaaaattaaaattttttaacaaaccctaaggatttttagaaaaaaagacctataaattttttaaaattttcaacattttttgacgatgagaaattctttgaatttttaaaaccaaaaataaatctgcaaaatttatcatttttcgggttttcaaaaagtgtgctatggtatcanattttacgtcaaaaaagcgctttttttgaatttctgagtgacagaattagaggnctgctttgccgtcatat

SEQ ID NO: 42944 - DNA, 1354 bp, Heterodera glycines
  misc_feature (1036)..(1036): n is a, c, g, or t
taatcctactcgatgatcaatcatcattttaaatatctgcgtcattatttaatataatatgcaaattatatgaagtgaaaaatagatttggataatcctactgatgatcatcaattatcattttaaataattgcatcataatttaataataatattcaaattaaatgaggtaagaaatagatttggataatcctactgatgatcaatcatcattttaaatatctgcgtcattatttaaaataatatgcaaattatatgaagtgaaaaatatatttggataatcctactgatgatcaattacaattttaaataattgcatcatatttaaaataatatgcaaattatgtgaagtaaaaaatagatttggataatcctactgatgatcaatcatcattttaaatatctgcatcattatttaatataatatgcaaattatatgaagtgaaaaatagatttggataatcctactgatgatcaatcatcattttaaatatctgcgtcattatttaatataatatgcaaattatatgaagtgaaaaatagatttggataatcctactgatgatcaattacaattttaaataattgcatcatatttaaaataatatgcaaattatgtgaagtaaaaaatagatttggataatcctactgatgatcaattacaattttaaataattgcatcatatttaaaataatatgcaaattatgtgaagtaaaaaatagatttggataatcctactgatgatcaatcatcattttaaatatctgcatcattatttaatataatatgcaaattatatgaagtaaaaaatagatttggataatcctactgatgatcaattacaattttaaataactgcgagttatttttcattttcataattactttacttcattgtggaaggtttttaattactctttatgtaaataaatcgaaataataattaagatagctgagctcgtgaactaaaaagttgaccggccagaaaaatttgtgattacccaaaattttttgctaggcgcaattttctgagtntagtcaaaaatttttcgaggtttttcgatttttgcacatgtttaagttgtcgggcggggattggtgaagagcaataaaagatgcgactatgtgttgtgcacattttaaaaaaaaaattggcgcgccagcactaagttgaaggggcggaccccctttagcccctggggtgggtcggggtctcagaaagttagcgccgggggaagcatgtggttaatgaatcgggaggcccggcgctattggctattattgtagagctcaccgaggcgaacattttaaaaaaaaatttggccctctagccccaggttgagtaggtcattt

SEQ ID NO: 42945 - DNA, 895 bp, Heterodera glycines
accaataataaactaacgatttttagcataagtaaatcgttaaattatgaaaatattttaaaaaattggtatatgtttcctccgtatagacaaaggccaagaaggaccataccgctgttatgaaatttatagtgattgtgccaacaattaaatgtaagacaagaaaaaaaatggcccgaaatacccacaaaaagaaaacacgttttttctaacattttttggatgtgtactggcgtcgtacaggttcgggactgcgtccgaaattgatcccggaaactccggcttttccgggtccggacggttttttcatacaatcccaaccattccgaaaacatgaactccccgcgcattaccatccccgtcggatggcgaggccggcccacagcgcgtcgttgcgcacttggcgctcgatgtgcttgcgccacagcaatccgttgacaatgacacgactccaccggcggctgacaaactccgaggcgcacaacgacttggcgtccaacaaatgaagcacattctccgccaaaccggctgaaattgggagggggggggggacaaatagggaaaatttgacgaaaatgcacaaaattacaaaaaaaacactcacattttaccaaagtttaggaaaatgtcttttttcttcggtgtttcgagggttttattgcactttatgagtccaatcgcatttgatgagtcaaatgaattacgcataattggatttttactataacttttttttcatattcgaacaatccctatataattctacacgacaaaagttacggcccaaaaaattcattggttgattaattggacttataaattgcaataaaacctccgggttttccaattctgtcgttttactaattaattgtatgtgtacgttttgacagcggcg

SEQ ID NO: 42946 - DNA, 1013 bp, Heterodera glycines
cattgttcaactttgcgcgctctgccgggaagagtccacctgggtaataattctcaatcggtggcagggtgtccaacacagtgccataattttccgcctaagattgtattaatttttatttaatttttttataaattcctcttaccttattgaatttgtgtggaaaatatttcttgttttccacgccctcaatttctaggccaaacgtattgacaaaattggcaagttttattgggatcaacttgtaactaaaatgatcaaaaattttaaaaatatttaatattcaaaatatttacctgtcccggaaaacggtggttgtgtagactcctgttttgcgggccttcatttccaggagatggttcccctggtggatgagttcagggctgacacccatgcgcagcatttcaccataaatcagcacatgatcgtagcgggaacctttaaattttatttcttccaagtttttttttaaataattccaaaattaccggcgtgggcgtacgcgtatgttgtcaccgactccggcttctccccggcttcttcgtaccccagcatccagttgttctcggcgtcctcatctacggcatcctcttcttcttcgcattccatagactcgccgtcggtgttttcggcattcttcctttttctgcgcttcttcgcaccgggctccatgccgaggacttccgtttcgaagttcagcaaccacttggtgaaggctgccagtgggtcttcgacgaccttgcggcattccacgtccgtgtgccagaattcgaacggggaccaggcataagttcggaatcggccacaaagcgcgcaggccttctccaattcctggtcccatatgcccttttcaatgcacctggtgcaagtcacgtgggcgaagcagaagttgacctttgaatttttcaaatttaattacccactcaaaaaaattacctgatgcttgaatcgcatcagttgcgggtccggcttaaagttcgttgtacacttaaagtcaaaaaacacaaaacgct

SEQ ID NO: 42947 - DNA, 1325 bp, Heterodera glycines
  misc_feature (1149)..(1149): n is a, c, g, or t
  misc_feature (1228)..(1228): n is a, c, g, or t
  misc_feature (1291)..(1291): n is a, c, g, or t
  misc_feature (1300)..(1300): n is a, c, g, or t
tggcaatagaatgagtttattaccagggaacggattctttcctgctaaaaaatgccaaatatgtacatatatatgtgccaataaactcctaaaatatgtgctaaaaaccccaaaaaagccaaaatatgtgctaaaaattaaaaaaaaactgctccaaaaaaagtaaatttctcaaaaaaatctcattttttattcatttcgctagcacaattgcaaatcagactcatttcaatgcttttttacgtaaatctttttctcgctctctaagatttatttttcgaaattttcttcgctaaaattcaaactttaccttaaaagtagagctggtcgggaccgggatttttgacaaaaaccgggaccgggaattttcggattgaaaaaccgggactttttggctgggaaaaccgggaaaaacccgggactagtcccggtcccggtcaaaactggtcaaaaccgggactgggtactcagttgtacccgtttttttcagtaccagtcccggtcccgaccagctctacttaaaagtaaaaaaagtcatgtcaaaaaatgcaaaaaaaaaggaaagaaaaaattgaacatttttgcaattcaaaaaataaacaaattctttaatcatcaaactcgtcttcgtcataatagttggaagtttccgctccaatttcgagcaaatcgtctactggaacctcacctttttttctaaaatgctctccaaatttaaaatcataataataaatatgattaagccgaataatggtactaatatataggcccctaaaatcgaacaattttggaaaaaatatcaaaaattgtgcaaaaaaaaatcattaacaccattcacttaaaaagattttttacaaaaaaattactaattgcgatttttttctaacttcaatgattttcagttaataataaataggagttctcaattttgggattctataattcatgaaaaaagtgggtttttcctacttgataaaaaatttatgggtttataaatttttttaaaaattcaaaccaatttttagtattttttttgtccatatttcagtgtttttgtccatatttcgtccatattttgcgattttttcgtccatttaaatccgggccttatcaaaaattaaaaaatgtatagagggggcatggatgtgngtggccattcttataagctcataagggctttcatcctacaaaagttcaaaatgatgaacatataaaattttttttttanattcgcctcttttcaagacatatgcttaagtcgcgcatatgatgaatgattcaccaccccatnctgagatgngatgaattatatgctttaattgatc

SEQ ID NO: 42948 - DNA, 882 bp, Heterodera glycines
aaaattagtcagcttttctatatcaaaatttttttacattttccactttttatatccaccggttaagaaattgtttttttttttgtttgcgcgaattgaacaaaatattacaaccgaattgggtaaaaaatcgaaatgtacaaaaaagaatgagcaaaaataaatgggccaaatggaaatgagccaaaaggaaatggtccaaaaagaaattgaaatgggccaaaacgaaatgggcaaaagaaatgggccaaaaggaaatgggcaaaaaagaattggcaaaaataaaaatcctttttcaacgaataagccccggggtgatcatttcatacgttgcttcttctccgtcctcctccatcccgcttgcgtttgagttgctcatttggtcccactccatcgcgttcgcagcattcgccctcgcttccgccgcaaactgcttgctcgcttcagggtgtcccatcaatctaaaagctccattttttacacttttaatttttttatttttaaaattttatttatttatttgtgaacagttccccgtataccagggacggtccgaggattttggcttgggggggggggggggtaccaccgctctgggcgacaaacttttttttttttttgatttttacaccacttttttgcggcgcttttttggggaacaaagaggccggcggtgtggcgccacttgggaaattttttcaaaaatttccccttcgtcgacaaaatctctcactttttaccgcatgcgatttaataaaaatttgtgatggattattaagttttttttctccgtaaaatttccttgtttctagattttttgaaatttctaggtttgaatttccttttcttttttatgagaacgacccaggggtgggggaaatg

SEQ ID NO: 42949 - DNA, 933 bp, Heterodera glycines
  misc_feature (913)..(913): n is a, c, g, or t
aacaatcttacgatatttagaaacgcaaacaaaaaatctttctagaccaaaaatggttatctcttttttctcatttttttacggcaaaattggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatgtctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatgtctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaaancgcaacaaaaaaattcttga

SEQ ID NO: 42950 - DNA, 118 bp, Heterodera glycines
ctgaggagttgtgtgagttgtgcgctgctgtgcggacgcgggcgagcggacggaacgacgacgattttgcgattttgaggggggggggggcggggggcatgggagaagaaagttcccc

SEQ ID NO: 42951 - DNA, 1161 bp, Heterodera glycines
cttgtttgtttaaattcatttttcatttttatgaattcttgtacaatttcaatcttttctttatctgattttgacttgtagcttttttgtattttttgattaagcccaaattctttgatccatttttgaatataatttcgatttgtccccaattttttcgctattttcgtattaattttattccattcttttgttgaatattttcttcctttttgctttattttttctttaattttataatattttccaattatttctcgttttttgagttcatttcgtttttcttcttctttttcttgccatttttccccaaatatttcatcaaatgatttctgctgaagttttttcttttctgattcaattggaataattagggcaatcaaaaataaaaataataaaatacagaatttcattttcaagattttattttatttttcttcaattaaatggcaattcattttttgaggcatttaaatgattttttttctgattaaaatctgacgtaattcataattctactgatttaacgaataaaataaggaaatcctgtttaatttcaaagaaataataataataattttatcttaatgacaaaataattgccaattggtaaattaatgattaaataaaattttattactttctactggagctcattcgaaaataataaacatattttcaataaaaataaaataaattcacaatgtaaagagattttagaaaaattaaagagattttatgaaatttcattatttcagaaaattggtgtaaaatggccaaaaatgaaattttagcgcagaaaaatgttgaaaaagaatggaaacaaaattatgtagaaatttgtaagaaaattggagtcatccgagacataattaacaaatggaagaaacaatttggaattcgctgtaaaagaataacggaggaacaaaaaatagaaaaaatgaaaatttattggcaaataaaaagtgaaaatccaaaaatgagtgataataaaattgcaaaaatattgaaaattcatctaaagagcattttcaattggaagaaacaatttggagaacaaataaacgaggaatgaaaaagggataattaaattaaaaaattgcggcattttgttgtcttccttatttaattttattttcaccccatcagtttttgtgttca

SEQ ID NO: 42952 - DNA, 1169 bp, Heterodera glycines
  misc_feature (54)..(54): n is a, c, g, or t
cagttgatccgtgatcgattcgaggccgaagcctgcttccgtgcttcttgcagntcacttaagtggacgccaagctctttgacgtccccggtgaccatcattttcttgagattcggtgccccacatgccaaactcactacggtggtgaaacttgcctgcgttgcttcgtccaaaagaagatgggttgctcgacttatcgttcctttgatgcgaccagccatgtgagtcgtgaggaaaataactttccttttgtcgtatttcagataactttcagccacttttgcttctcggacccgcagaggtgtgttaaacacgtgctttttgtagtcctcaaattgctttaccttcttgtctttgacttttttcaagaatgtctgcgtgagtcttggccgtagcagacttctttccaacggttgaatttgctcgccgtagcgcactctggccgttccactgaagagtgccaagtgttcctccgaaactccaactgcccgagtttcttccaccattttggtgacaggaaggttagacgtagctgtcgccacaatgaccgtttcctcatttttctccgacaaaagaaggtcgatggccgtagccaatgttagtgtcttacctgtgccaggcggggcttgctgcaacacaaccaaaggaaggtcacatgcaatgagtgccaaagtttgctgttgttcctcgttgagtctcgctactgatggcattgccgtcttttggccaagaccataatcaatcagtttttgagtggtcactttcagtccacttcttccaggcctggcaaggagtgctttcatgatctctcctcgcggtgaatcctcttcggccagtcgagacggttcattcgtgccgaagcaatcagcatggtctgagaaaccaacagaagcaccaaccgattgaatgatggtttcttcaccattcaccatctttctgaagttgcttatttgaccatcactttcatggtgtccaaggcgaactttaacactaacaaaaaatgtgtcactgccttcttcagtcttttccgacgacttcttaatcagaacaacttgcccgtatgcaaatgccttagcatcaaattccagggttgccgtgacgggggagtccgttgtccatgccagcgggagaagtttgacaagctttctgtccttcgtctggaacttcag

SEQ ID NO: 42953 - DNA, 1046 bp, Heterodera glycines
tagtttttagtagggttggccgggtccgggtacccgaccgggtcccagtcccggatacccggttttttcaatacccggacccggcttttctggacccggcaatacccggaaccgatttttgtccaaatacccggatccggcggacaaccctaatttttagacaaatcaatgtaaattaacaaaaaaaaaacaaatatatttacaatgtttatttataaatgggaaaataatacaaaaaaatatacattaaaatattgtagaaaaaagagacaaattgttacccaatccaattaataaaatgtgcatattttgaagttacagaataatcagtacatttatattaggtaaatattacagaaggaaatgcttaaggaatttttggaattgcgaaaaaaaaaaattttttttttttggaaaaaagtgaataaaattaatttttaaaaatggaaattttggttttggatttttaaacacacaaaaaaaaaaattatttatctacaaaatgacgcaacatcgacaaattccgcgacgcgcgggcggaggcggtggcggtggtgtggctggcgcaaaatatgcatgaacttccacatcaggtcgggtttgctaaaaaaaatggaaataatttaattttattataattttaatttttaaaaaaaattaataaagttgtttagataaaatattcattttcaaaaaaatttaaatttaaagatagcttcgtttgatgttagaacgtttcagcgccatggcatacatagagaatggaaattttgtatatttcaaaaaattctcaaatttttgtcttagaatttgtgcaaggatttcatttctccttccccgaccgaaaagtaaaaaaaaaaacttaaaaattcaataaaaaaaaaattaagaaatgttgaaacaaaaagtatgttaaatataatataggtgaatttggaaaaaaatattttaaaaagcaggccacctgtttttttctggatttttgtctaggaaaactaggtcaaatatgaaaaaaaaaatttcaaaatccaagttatgcatgaaaa

SEQ ID NO: 42954 - DNA, 1257 bp, Heterodera glycines
  misc_feature (1226)..(1227): n is a, c, g, or t
gggaacacttagcgaatttaatgacggaaagtaacggagggaaggtaaaactgatgaagcaaattataaacaaagtgactaatgaacagacagaaccgtcagaagaaaaaaagacggaggtgaaaaattggttaattaattgagaaagacaattaattggcaaattagttaatttattgagaaagaaaactaatggtcaatttgttaattaattgagaaagacaattaattgaccaattagttaattaattgaaaaaggcaattaattggcaaattagttaattaattgagaaatataattaattggtcatttagtgtattaattgagaaaggcaattatttggcaatagccaattaattaatttaatttgtggactaattaaatatattttgcataaacgtaaaaatgaattttgaatttgctgccaaaggaagtgatgcttttgtgggagaacggacccgaggacacttccttttaccacgcgctcagaatttgctccgaagaagcgatggaacagaacaaaaaagcgccggaacaaaagaaagtgaaagacgcggaggatttaaacatggaaatattcgccaaaatgatcatttgcatgggcaaaaggctgaaaatgccacgccgaagggacgcaattttgaacggaatgcattttgacaaattggcaaaattggtggacgaatgggaccaattcggcaaaatattggggcaaaaaagtgagtggactcggggaaatgccaaaagaaatttcaggctaaaggcagcagataattaacccttaaatccgaccatttactctatcagattggttaaatttcccgaaggaccattcaaagaaaacttttcgcatcctgctgacaaatgagctcgaaatttataatttttccaaggaatttaaaatatttcttcaatttatttctataagtttaattataaaaagaaaaaaatccattgcatttcgttataattgtattttaaaaattttaaatttattttcctatcaatgttcgtgaaaatttccgagtttgtattaaaaaattccaaatttaattatttttgtttcaaaatttttcgctcaagatgggcattgcttataaatataggcaattgctcctattttcataacttcaagctcttaataatgaacaaattttaattatttttttttcaagaaaattttttattataatttagaaaatttgtggctcaatctgatggacannagaaagcacaaaaatctggaaaagcttatt

SEQ ID NO: 42955 - DNA, 1559 bp, Heterodera glycines
ctctctctgtctctctcactctccttctctctctgtctttctcactctaactctttctctctgtctctctctctctaaacatttcatttttccctcgtcgtcgtcggcgcttcattcactgaccaaagacgacttttttatccgttggttgggccattttttacgccggcgtgctccttaccacttcccctttctcaaatttcagccgttctttacgattagtgcccaaaatagctgcttctcctccctcgtcgtcgttttgtgcgtttttttcccgtccatttcaaaaactgctgactttttcgtttgctttttcggctcgacaacctttcccccccccccccccgcttattttatgcttttgctgtcgtcattcatccgcttccttctcagcatcttcgtgtctccctcctattcgctgtccccaatgaccaactggcacaagaagggacggatggacggaggggaaaagggggaaattgaaggagaggcattaggagaggcggaagcgaccgcggcggatgaccatcaccatcaatcccaattcgaggaaggacggaggaaggggacagatggaagacggaggaaccgacggcggggtaaaagcggtggccaaagaaagggtcaaattaatggccaaaagaggggcgtagacataaaatataaagacagacagacagacaaagtgatggatggccaggccaaactgtggtctgtcggaataaaagtaaaagtgtaaagtgaaaagcactgaccgctacggcgcgcctaaaatgagaagagagagaaaaaagggataggcggagatttatactttatatacaaagaaaattgaagatcagtgcgtactttgagctctcagactttcgtctcccccggcacattttgccgtctttcccccccccccttttccgctctcttccgccgattgctctttggccggcattgccattccagcggcgaaatatggaagcgtaagaagccactgataaaaaatgcacaattttctgcataagcaagcgatgaatccgccgtccgtcgggacacaacggcaaaaatgccattggtaagcggtgccaacccaacctttaccctgccccgtcctccgcattttgccattctctttttgcctgctataattcaatcataaatttgcatacgccgcgagggaatccgtccaatcagtgggacaaatcaccaaacaagctgatcggagatacttgtgaaagtaagactgatctttgagcaaagtttgagtgatcagaacaatcggtgcttactcaaaaatcatcaaatggaaaatattaactttgttcaagagtttttcgcgcatttttggtcataacttttttgaaactaacaataagcgaaattttgcaattttatagagaatagaaaaggctacccgacttttggggatttgcaacttggggacccgacatttggggacccgacatttgggggaccgaacgaacatttgagcaaaagacacttaagaaaaccacggacatttggtaacccgacattttaggaaccccgacatttggggttttccataa

SEQ ID NO: 42956 - DNA, 800 bp, Heterodera glycines
cgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtcgatatttacactgagcacccgttgaagcgggtgatgcgaagccatagcaaactgtatttttaaattctggcagcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagcccatag

SEQ ID NO: 42957 - DNA, 1150 bp, Heterodera glycines
cccccccctaccaaaaaggaacactttcccgcggcgggcgcgtgcacaaacagcacattctgccgaattcatccgcacagccgattccgctggtgatgaacaacgtggaacggttccgcggtaacacggccaacggaagcggcgaaatgcttttgatgcagcaggcacactaattgattaactaagccaattaactatgccaattaatatttaattatgacggagggactaggatcaatagctttaatcactttccacctaatcccagaaaatgccttcgtctatgtcttcgtcgtcttcgcatgagcgacggcgtcgcccgaggggccgaggcggcggagtgcttttgctgggcaaatgctgccaacagcagcgaaacatgcaacactactccaggggtaattaggcaatcaattagccatgctaatgaccatcattgttggtgggcagtcgatgggaatggtggcggtgttccggtgcgttatttgcgcagtagccgcgacggctccgaagatgaccgatcggcactgatcgaactgaaaccgtcgacatcgctgcaactgggcgattttgtcgcctcaccgaacgactcgctgaagctgaaagagtgcagaaggaaaaaactgaggcgagcaaatggaaagtcgagaatcaatctcgacgacacggccgaaaaagcgggccaatttggcagccgctgattaattgggcaatggaacttaggcataacttgaccccaattccggcatgaatttgcgggtgtctttgtgccgtccctcgggtcccgtcaatgatggatgccttttcggttcttttgtccattggcatgtcccgcataaatttcagtgctccaccctcctctgcccatctgcgcactgttagcagtgccaaaactttggaaaaagggctgccaccttcgccgcgttcggtgttatactgcaacgtggaaaacaacaacacaatgccaccgcacatcgcactgacggagacgacatcggcacgcattcgcacggaactgccgcgtatccgcgtcaacgcgagcgccgatgagagtcggtcggtaagcggagcggaactggcgatggaggagcggcgcgcaagtggcgagtcggcaaagcgacgggggagtgccggggtgagaaaactgagt

SEQ ID NO: 42958 - DNA, 1380 bp, Heterodera glycines
ctttaattaaaaaaatatttgtatttttcggcgttcaataaaataaatttaaaaaactattttaagatatttgacattattttttaaatttatatctttttgtttaatttttgccttgctctctctatccagtgataccaaatttataccgactttttgactaacagttcgcgaggttcccttattagctatgtttctaaatttatgttccaaaaataatttttacgttaattttaagtcattgaaaaaaataaataattccattcttgatttcttggagtgcttttttaagtatgttgatttaggcaaatattttttcaaatgagtttatttaatattcttttttcaattagagtatactataaaattagttaaatcagtaattcctcttcttcatattaatattttaaacaattattaatttatttatatattagcattagttaattaaaattaatgttaaaaatagcaaaatatattttactttatattataaacttgttccacaaatgatccaattccctgtcaagcaaagttctcatgaattcattaattgttttttttaaacttttatctgaaagctaatataattacaaatgaaaataatcaaattatcaaaataaaatgttaacaaaaagtatttttaaaaattaaataaaaataatgataaatttagctgatcagaataagtaaatttatttgaattaaactctatttattttttatttttttcttttctttatccggtctaaattagattgaacaaatatctgaaataaaaagatgaataatagaaataaataattcaaaaataaatatcataaaaataaaaaactttttttgacataaacaaattaatacagaaaatttaaataaaatattaaaattatcaaactaatattgaaaaataattaaaaaaattaggaccttggagaattaattgtaaatgtatttgaatgaaaataaatttgacctttgaaaaagataaaagaaaattaaaaaattaaattcttatgtttgattttattttcattttttaaagaatttaattgcgcatcaaggtccgacaatgcgaaaaagagactaaagctgcgttccgacgagttaattggataaaaatatttttttgaaaattgtaaagaatatttactcatataattatttaattttcataaaaaattaataatatcgatgataaaaattgcattaccatttttatagttgccaaatgaatacaaatttttacataaatcaatcgagactaacaatcatcttaaggatgacattatatttagcaattattcattcagtataaatgaatccgcatttaattatattaatctaaacaaaatttttatttaattaattttttcttttatt

SEQ ID NO: 42959 - DNA, 951 bp, Heterodera glycines
  misc_feature (907)..(907): n is a, c, g, or t
  misc_feature (914)..(915): n is a, c, g, or t
aaattttaagttttcttggcaaatcaatccggctttccttatcagtccgtttaaaacattcttataggggtttttccctttcggcattgtacaaatgcttggcaattcctttggtacgcgcactaatcgttcaagaggggctgtcattggattaccgtatggattatcggacgcgattacggtcgccgtagatttattcaattccgtaatacgaaatgggccaaaatggttccacaaaatctttttatgtggtgatcgaatgtgggacccgggaaaaatgaccataaccctgtctccgatttggaatttgttctccgtgacttttgcttgtgcgtcgtagtgttctttcatttttgcacgacttatttgggaatttttctgcgcttggtccactaattgcattagtgactcacgaaaaagttgaatatacgaattttggtctattgtgtaaagcggatttacgctgaatttcaattcatgttccaatgggaagtttatcggtttgccaaacattaaatggtggggggaaattccggtgacttctgatggtgtcgaattataggcaaacactacaaaaggcagtctttcgtcccattcccaagctgaataagtcgaccttcgtagcattcctagtatggtctgattaacgcgctctgttacaccgtttgcctgaggatcgtatcctgaggtggtcgttctcttaattttgagtgtttttgaaatttcctccaatgtttcgttaacaaactcctttcctttgtcgctatgaagctttttcggcgttcccaagacacaaatgaagttttttacaacatttttcgcaatcatttcgggatttttgtttgggatcgcgcaggccacgaggtattttgagaaatggtctactgccaccaaatgtaccgatttngagaggnntgcagtccatcgataaatatcgatacaaacaattcc

SEQ ID NO: 42960 - DNA, 988 bp, Heterodera glycines
ccattcttcactccgctgatcgccgcttggacctttctctgctgaccaattgatcacacttggaccgttcttcgttgaccaactgatcaccacttggacctctcttcgcctctgtccgagcatcaccaggtccggtgttcaccaatcgctgtcgccaactgatcgctgcacacacaagtcgaggaccaattgacgccgttggatcaggtcaagcacagccaactggccaattagccggttatttaaccggctatccctcgcgtgtcaattagtcgattgtttaatcggctaacaatctggtctcaaactcctactcccaacggcctattcattcacagttgcgcaggcaaccgccgcttaagtccaattctaagcggtttgcgttagtggcgacctgaacccacagggacgaccgcagctatcagttactaaccctaaaggccaaaacctattgtacggtccgatacgtccaatcatagaattttaattctttctttttgtttgcacatatttatttttataataaccttttcggtcagttttgaacctattttttttgtgaaccagttttgacgtcacacatttattctgattaattttgatcagtcttgatcaaggagttgtctattcatattaaattttgattacgcatttaatatttatttttgttaagttgcttagtcagttttgacttactaattttatttttttttggggagagcgttgcttagtcagttttgactaaacaatttcaatttttgaagttcaagtagtgcatttacaatttgttattcaacgttttattgtttaactcatattattaaccaagggctgccgaattaccaagttgatacatttttacgaatcaaatcgtgactatttagtcaaatcaaataaaatctgaattaaacttaaaaagggatcataatgtcagacatttatgtcgaacgcatagaaacagctaaatatgccattgagttatatctgg

SEQ ID NO: 42961 - DNA, 1006 bp, Heterodera glycines
  misc_feature (72)..(72): n is a, c, g, or t
  misc_feature (916)..(916): n is a, c, g, or t
  misc_feature (951)..(951): n is a, c, g, or t
cataaatctgggcgcatcggttcggggggactgccccgtaaacaaaaataaatcgattttttcaagtgtccngttaggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaagttaagcctaaactttttgacctgtttaaaaaggaattaaaaatttttaaaaattttattcatctccctttttgatagaaaaagcatcagagtgcgtaaactaacatgtaaataaaatttggttgcgtttcagaaccctttctgaaaaaatatttaagaaataattntgcaaaaaataaataaaaacgaaagactcagattntcgaaaatttttttgagcagctagctcggcgctcatttcagtgtaaagtagtcct

SEQ ID NO: 42962 - DNA, 1286 bp, Heterodera glycines
aaaaaaattgtccataaaaaaaaaacccgtttttttgaatattaccaacaaaaatttttaggcagtttataaaggaggaaggaaaaaaatttttcatttgcctaatatttatttatcttgtgaactgtggaaatgcagctgatgccgtcggaaaagctccgattttttgggaagtttttttctttcagtttcaccactgattgttgaggcaattttttcgccaatttcttttgtctacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgctattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcctatccttctcttgaaaaaaattgtcactaaaaaaaacacgttttctgaatattaaaaacaaaaatttttagacactttctaaagaggaaggaaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagagg

SEQ ID NO: 42963 - DNA, 995 bp, Heterodera glycines
  misc_feature (901)..(901): n is a, c, g, or t
  misc_feature (906)..(906): n is a, c, g, or t
ctgcaggtcctaagaaataataatggtcgtagctgggaaaggggacagaaggcattttgacaatttcacaccaaattttcatttactttttttcgcggcgactttttttgagacaatttgattcaatttttaagaaaaatcccaatttatgaaactgtgcaaattactaaatgcccaagttttccggcactgtccttttgccatgccaaatcattcctttggcactcccagtgctaatcagaggcaaaaatggcatttttaagaatgttgaaaagagaggacggcactccctttgaggacgatgatgaaaagggtcaaggagaaagtgacggcgcggaaggagggaaaagtccatgaccatttgttgatttggctaattaattaaatgcctttaaatttcaaaatccatcggctcttctgcagaactgtaattctttgattcgccagttaagtttcaacctcacaatttgtcctgtttttcgtgcatttgcccctctcccccgcaaattgttcatttttgtattttattttctaatccatttcatcagtattgtattatttgcacattaaaagtgactttttgactcccgtttaagacgttatttatccgttcagcagaaaataaaatgccaaaaagtggtcaaaaacaaacaaaaaacgaagtgatgattcataaagcataattgagagaaaatcgcaaaaatggcaaagtattagtcagatcagcagaagaaacaatcaaaaattaatcaaaagaagagaaaagtgaaaaagaaacaatttagaggctaaactcagaaaaaacaattaacttttttaaaataacaaaagaaagggcaaatgaagcaaaatggaaaaaggggagaagaggaaaagctaaaccagtaattagcattagtanatgancataataacccatccacccgacaaattcgacgctttttctcagccgattcttcgacttttcctccattcaaaacgcataattcattgaa

SEQ ID NO: 42964 - DNA, 931 bp, Heterodera glycines
  misc_feature (893)..(893): n is a, c, g, or t
accagttatcatacaaaaaggcaatagttaagctttgagatataaaaaatcgtctagaataattatctcaacaatttgtcgggaaagttgaataaatttcagttgcaataggcatattggcacaatacataaatgtagagcaggctcaaaatagaagaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgtgaaagctgtataaattctgggaaaaaacttttcaagaaaagctgaaaaattttcaatcgcatcagaagcagcctcaaattctcaacaacataatgtaaaaaatattacgcaagaaattatttttagatcctttttcgaaatgctgcantaatttttattgtaaatagtcacaaaaaaacttttttt

SEQ ID NO: 42965 - DNA, 884 bp, Heterodera glycines
ttttctgattttgtgcctttacacgaaagacctgcttttccgagtcgtacagcgactggtcgacccttttcaacacgctttccccccgtttaggagcagtacgggtggacggtccgtcacaacgacgacccaaacagcaaaggcagtggcggagggcatttcgctgctgccgtcgctggcgccgttggccccgccgatccgttgatgaaccagggcagcaacaacaacaatggcggtggtgctactgcaatgcctatgccaccaaatggtagcggtgcgtttgccatgtccccctccacgtttgtgccgtcgcatccgtctcccctcgccacttcgtcgtctcctccgcccgaatacgcgccgccgcctccgctgccggcccatggcgctggtgcttaccgacagcaaacgacgggcggagtgcgtttttggattgcataaatttttcgaaatccgaattttttaaataaaaaattcggggaaagacgggcaatctcaaaatttttattggataatttaatacaaacagcaaatggatgacaaaagttgcgttatttcagcacagtttccctaccggcgacctcgccaacaaaagtggggtcggcgccgtttatccatcggcgcatccgccgcccgcgggcactccgacgcagcccttcccaaacgcaacaccaccaccacaacaacactaccaacagcatttggtaaggcatggtgggagggaaccaacagcacggtgtacaaattgttcaattggatgaaatccacctttcctagtggactatcacgtgagcctcctgcagttgagtccatgcccaaaattggcgtttatagccgtggaaaatttagggcggaaaattaagtccttccatacatgtgcaaat

SEQ ID NO: 42966 - DNA, 724 bp, Heterodera glycines
cccccctccccgtcgcctttctctttctccgccctcgtcgcaccaccggcggtgcccaccctccgttaccccctaattagacttccttcccattccctcatcaaattggttattcttggaccctttcccacttccccgccctccatttcgtctcttccattcactttttccctcatccctttgtcgtggtgtccttcgcccttccctccaatattttggcctttccgctcggcgaaaccccaaatgagcggcgatccctcccccgccccccccccattcgacgaacccatctccctgcgctccccccccccacctcacctccttttcaaaatattttcactgccaaattcgtccccatcatttttcatttcatctcgtttctttttggccaatcaaaaatgaagccttaaggagctaaattccatctaatcgcataaattcacttttcgcttttgaatttcttcgcgcttaaatcttcttctctttttcttctacattatccctccatcagctgcatttttcctcatttaaagaaagggcgggtgaaaaaaataaaagcgtttgccgctcggctggaggaaagggtaattattaggttgaagttttaggagtgactttttgaggtcgattgatttgaaagtgaattgggaaagggatgagagagtgggcatggacaacagaccaggagggacaatggcagaaaaatatttggggggggggcgaa

SEQ ID NO: 42967 - DNA, 1142 bp, Heterodera glycines
ccgacaaaaccggcattcaatccctataacatatccctgcgattccggtctcgaatcctgaatctcggccccatactttttcaaaattccgggcttcaagagttataacgatttcaaacttcaatttttatttgtttatttataagtttgttggaattatgaaatgctttggcattttgtgtcttcatgaaaattctcattttgtgccctcctcaaaggtgcgaatgggctacttttttttcgcactgcgacggatggtggcaataattgtgcggcacataggtgccgtgccgaaacagtcgtttgcgatcagtccaatcgtatgggccgtgccgatttttcacttaaaacaatcatttttaaaacaaaggctttcatatattcatattagctaataaataatacaaacattttatttgtaaaatattaccaagccaaaagtgatcctcaattgtctcctgaattaaaatttttttttattgttgaattaattaaattttaatatttcattttttcctaaaattaatttagttgatttaattatatttaaatatttttatttatacatttgcagcaattgtctgctcaaaatacagatgtgtgctgttgaaaatgtgcattcgactgaagccataattgcttgaacgaaatgcgctcctaaacaattaaaataaaatatttaaatgtttattaaattattattttataattaagatagaaaatttcaataaactattttaatttaaattacttcaattgtaaaatcactgcgatttttttcgaactactgtagttagcatagaagacaacagtatccttatcatccttgtttaccagattttacacaaactatggtgaacaaagttcaaaaaattttgaatttaccaaaattggaaaataatgaatataaatagagagaacattagcaaaatattaaatttagcttggttttgagcaaaattataagaaattttggttgaaaaaatgcccgcccatttggcaatttaataaaaataaaaaaaatttccggcacataatttactcgttaccatggtccaggatgagcaacaaatgtgtccgtattttcttggcatcccgcagaaccgctgataatatgaacaggagccggtggggccacgtaa

SEQ ID NO: 42968 - DNA, 766 bp, Heterodera glycines
ttttctgtctgtcaaatgcttttcttcgcccgacttttcttttgttaattttcttttcgccaccacaaatggcacaacagaagcagcaaaggcacaatcggcgcggaaaaagaaaaagctgaaaattctcgtctattcggtagtgcccgcgcacagtcacatgcaatttatgggcgcaattgccgactcattggccgaggcagggcacgaagtggtgaggaacggaaaatggacagaattttgaaatttaaattggcaattaagcatttcatcaaaacgattagcgacgagttgcgatggacaaccaaagccgagatcaacgagactaaactgtcctcgaaagtttatcgggttgtgctcaaatcgcgcggagcgcccgtcgcgacttcggatgtgctttatccattcagtggggccaatgcgtggccaatgctcaacgcatgggacaacagattcgtcaggatttttgatttgtggccatattttttcaaaggcaataattactaattaattgctttacattttccaatggaattcactgacttttgcagaaattgccttccgtcgcgaattgctggacgaattggccaaggagcgttatgatgccgccatttatgaactgttcgatctgtgcggtgctgccatttttgagcgcatcggtgttcgcaccaaattggcaacacttacaatgccaatgcaacaaattagtgccgctcatttgggcattcccgacgttgccagttttgtcccaagtaaaaaaagaaat

SEQ ID NO: 42969 - DNA, 705 bp, Heterodera glycines
attttaactgtgacgcaatatgtttgttgcctttcgtgtccatatgaccgtagtttatgcatttttttaaaatgatgctcgttgggccttgagcaagccattggaaataaaaacatttatttgtgttaattggataataggggaaataattatgtacagttggtttattgttttttttttgaatttcgattctaaaaaattggataatgaataggttacacgaagccgcgaatgtccgattttggcttgggccgcaaaattcagcaaaaaaatttttgaaaacatttttttttgcagtttggtgctgatcaacgcgctttacttcaagggaacatgggtgaaccaattcgacccaaaattcaccataaagtcggcattttatgtggacgcgacaacaccaaaaaggtggcgaaaaatgggaggcagctcggttccctcttttcataagaaaattctaagaaaaaagtcgagaaattttcagtaattttttggaaatttttttaaaacttatttttcaaaatttttttcttagaattttcttttgaaataactaagatttttttattgaaaaatttctaacaaagggaggtggccaagtgtccgtgggatttcggaatgagattttttgggtagatagagcacacctgggatcttaagaaaaatgttttcaatttctgccaaatggacccctgtgccgagataaaa

SEQ ID NO: 42970 - DNA, 984 bp, Heterodera glycines
taccaacatttgcctctctagtctggctctaccaaccactcacacgatattgaaatgctaacgaaaaaaattcttgccgaaaaaatggctctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctactaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctctcttttttctcctggggatttgaccgcaaacttggtaccaacattttccttctctagtctggctctaccaaacactcacacgatatttgaaatgctaacgaaaaaaattcttgcccaaaaaatggctatctcttttttctcttggggatttgaccgcaaacttggtaccaacatttgccttctctagtctggctctaccaaacactcacacgatatttgaaatgcaaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaacaaacactcacacgaaagtgaaatgctaacgaaaaaaattcttgccg

SEQ ID NO: 42971 - DNA, 976 bp, Heterodera glycines
atgccaaattccctcactttctctttttaccgaaaatgccttcgattaccctttttccctgtgctttccttttctgtttaattcatttatcgattgtctttgctcgccttcgttcgtttgtttgtccatctgtcctctttcactgatttcttcttttgaccaacttttgcatacctttcttttcgtttaaatatgttggcataagaaatatgggtatttttgtcattccaaaatgttcttttttgtttaaattgataaattttagggaatttctttgttggtttaaattcaagttaatttttcattgtaccttttcggatttttaattattcgactaattgtaattggagtaaggttaaacgttcccattgcctttccattaaaaatgtcggcgaaagttaaaacggaggcgtcgtcgccaaaacaaatgaacgaaaaggcggaagagaatgaattgacagagcgtttggagttagactttgtcgaagtgcgccttttttctcgatagtatttggcaccataaatccaaattgatggctaaaacttggcgaaaatggctaaatttcctgggttttcccaccgtgtagaaaaatttaagggaagttacatttgtcaaaaacttgggccagaagagtaaaaacttgtagagcctcttccgaaattttctttcttctatacgcacctgtttagaatgtccagtttcacccatctttatgaactgtttaggagtcagtcggcgacgattggtacggaaatgccatcatggaatgcgacgacactttagccaccgcagatgaagcggaggaggagggccactcaaaacgtcgcccgactcgccacgttcgttgtctgccccgcgttcccccgaagacgaagtggagacaattggtgccaaggaattaattttcaaaactaaaatttttttttggggggggggggggatcatcggcaccaattatgccactaatttgtttcg

SEQ ID NO: 42972 - DNA, 1135 bp, Heterodera glycines
catagccagcgtgttaaagcaaacccgaaacttgataggaaattaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactactggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggccaaaaatttt

SEQ ID NO: 42973 - DNA, 942 bp, Heterodera glycines
  misc_feature (77)..(77): n is a, c, g, or t
ctagagtgactaaaactgaaaaataggcataaaatacataacaaagcggcccaagcccttacccagaaaatatttgngaggcgagaatctgaaaaccttttttttttgtttgctcttccggtcaaaattttgctttttggggccaaaatttcaaaataaggcaaaataggggtctgccgataggtgtcgccggctaaatatattttttgaaattttgatgcattttgttaataatttgattaaaattgtagatcatgatgcagaaaattatggaattttaataaaaattatttttatggctctaaaattgccaaaaaggaacgctttaggctcttaaaactccaaaataggcactaaaaatagaaaatagggctctaaaagttttcggagtgtaaaatgacaaaagcaattcaaacacttaaaaaattaggccgaatcagtattgagataaatcattttaaaagcaaaaattcttatgaagacaatcaataaataaattttagagatgaattttagagaaatttttcttttttagggggtgcatttttgaaaattttcgggtcgattcttagggatgtatttttcatcatctgcaactaattttctttttattttgtgaatgttttttaaatttttgctcagatttataacaaaataaaaaatcaaaaaaggcagaagttttttaatatattttttcaaaaattgccacgattcaatcgttaattatttataaaggcaaaattacaaccgcataattttgtctattgcttaattcatgcaaattttctggattttcagtaaaatttaaaaaaatgctaaaaacataagactcgacctagaaaaaccagaaaatgcttctcccctcaaataattaaaaaggttcgtaaaatttatcctctaaaatttatttgtgccaattttgatgcctatttatgacttatt

SEQ ID NO: 42974 - DNA, 992 bp, Heterodera glycines
  misc_feature (918)..(918): n is a, c, g, or t
  misc_feature (925)..(926): n is a, c, g, or t
  misc_feature (953)..(953): n is a, c, g, or t
cggttactgatttactcattaaaattccaaaagccgattggacggatagaatttctaaaaattcaacaaaaggactaactattatttcttcccgtgtatccaacaagagaagcagagaatttcatttacggttactgatttactcattaaaattccaaaagccgatttgacggataaaatttctaaaaattcaacaaaaggactaactattatttcttcccgtgtatccaacaagagaagcagagaatttcatttacggttactgatttactcattaaaattccaaaagccgatatgacggatagaatttctaaaaattcaacaaaaggactaacaattatttcttcccgtgtatccaacaagagaagcatagaatttcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatttgacggataaaatttctaaaaattcaacaaaaggactaactattatttcttcccgtgtatccaacaagagaagcagagaatttcatttacggttactgatttactcattaaaattccaaaagccgattggacggatagaatttctaaaaattcaacaaaaggactaactattatttcttcccgtgtatccaacaagagaagcagagaatgtcatttacggttactgatttactcattanaattccnnaaagcgatttgacggatagatttctanaaatttcacaaaggactaactattatttctttccgtgta

SEQ ID NO: 42975 - DNA, 632 bp, Heterodera glycines
cccccgagaatcagaattttttgaaaaaaaatttatttttttttaaaatattatattaatttttttgtaaaaatagcaaacgagtttatgaaatgaaaaaaaacagatcatttacaattgaacgcgtttaatgcaatcaattaattttaaaaaacacgaaaatacacccctaagaaccgactttttgagttgccccccccccccgaaacgaaggtcctggctacgcccttgcctggaccattggccggtttaatcttggcattccccatggacaactgggttaatttgggttgctgttaccacccactttctcatgaaagcgatcaaaatcggcatgagaaggatgcggaatgttcaatatcaacatttcatgatcatttatttgttcctactttttttgtcttgatttattggtttgatcatgtttgcttgttatacatacattttaaaaaactaaatccacaaaaagaaagagtttctaatttaatgttttaatctgcaaaaaattgacaagtgagaattttttcatacgtagtttacatgctttactcctcttttaaattataccagcagaatagcattctgacacaaaatgtcgcacgtaataaattattaaatttggtttcgttgaa

SEQ ID NO: 42976 - DNA, 1056 bp, Heterodera glycines
attgtaaaaattggattggtcggaaccggggatttcgtcaaaaccgagacgggacctgggaagaccgggagacttcctggctcggtcaggtcccatcaactttaatattaaaaaaaaataataatttcaatgctttttgctaatttttatataaaattatttttgaaaatttaatagatgaagctcaactccattaaaccgtccttcaattgttccgtttgcagtcgaccgtgccaacatagcaagtatggcgtcaaatcttgtgaaagtaaacaatttttaaagaatggaatgaaaaaataataaattaaaaaacgctgaaaggaataaaattgtttgatgattaataataaatcggaaattaacataattattgaaaaataaatttacttaatacatttattagttttgacattataaaattatcaaaggtaatttgcttttttgtcgtattttttgaaaaaaaaaaaaaattttcaaacaaccaattattgatcctaatgaacaaaaagaccgtgttttcttaattttaatgctgattaggctatcagagtttgaaaaaattcaactttgagtccgattttggacataggcgcaaatgtcggggctccctacagatgaccttttttgcttttgaaaccactttttggagtgccttcttttcaaaaaaaacttttggggaagagcatgggtccggtgaagcatttgatggaagctgagcagaaaatgtgccgaattcgcaaccacggactccgatcactgaatcattttacgaccaatgcaattcgttcgaatcaatttttgcacgtaaattcaatttggttgactgttcctacaaagattcggtcagcgaattcacaaaaaaaaaaaaaatttgaatttaagaccgatccgccaaatgctcctcgggcagcgaattttgaaataaatcacttgggacccctcattagcaagtcaccaccatacgtcgccatggatttgatatttgttttcgaaattgtcaaacctttccatccttcgaacagctcatcatcaatgataaggtaccattctact

SEQ ID NO: 42977 - DNA, 1164 bp, Heterodera glycines
ttatcaaattgttaaccataaatatttttgaataaacacttatttcatttaaaataaatacaatatttcatttaaatttttttttgtaattgagtaatttgattaaaaagttatcaataacaaattaatgaatgcaaaaatgaaaatatataaaaattgacggcattaaatcgccggacggcgaaacggcaccaaaagttcaaggaaaaggaattgaaatgccaattccgtcatggaaattcccaaattttaatgaattgttgggcaaggacaaggacaataatggtggaacaatgaagagagaaaaacgtaaatgaaaataaataattaattaactgaggattaaattaaaattttgctgattttgatggacaagtcccatttatgccactgatgatgccagaatttaatccaatgatgccagaatttaatccaatgactccaggaatgccaccgatgatgcctggttttaatccgatggtgccagggtttaatccaatgatgccgggttttaacccgatgatgtcagggtttaatcctatgacgccaggaatgccatcgatggtgccgggttttaatccgatgatgccagggtttaatccgatgatgccgggtaggaggaattgccgaaacttcaatataatttattgatgaatttcaacattctaatggccaaccctatttgatgaaacaaattttgagaagaaatttagttcttttaactgcttaaaatggattacaataaaaagcattagtttttttaaatttacgaataaatacttaatgcccattaataattattgtacaattagtaacgcagtttatgatttatcgctcttacagcaataacaattaggttaaataacttcgaaaattgtataaatttgagttgaaagtcattttttcaatttcacatcaactttatcttcaaaaatgccaagatgttcttgagctgtgcgagtcttctcatgctctaaaaataaatgttaatcaaaataaatttttttgtttcagtttttatttaaaatcttttttttaatttttaaatatttaataatgtaaggctaaccaaaataaaaataatatgaaaaaattcgaaaaatatatttaaaagcgattagtattgtgttttatcttattttgaattaaaaaaattataattta

SEQ ID NO: 42978 - DNA, 975 bp, Heterodera glycines
  misc_feature (31)..(31): n is a, c, g, or t
atttatgtcattattttttttatttaatttncaatttttcttttcggtggttccgttgcactgaactcctcccatttgaatctgaccaaactgtccgccgttattgaggacgaaattttcataaagctttttcgcgcgcccgcctttggatggttggagagaattgacgaagcattggcaattgaaagcggcggaggaacgaattttggcggattagcaaacggagagaatgcgggagaagaagaggaggaggaagaggagaagcaaaatggggacaaagtgagaaaaggagttggtggagaggaaaaggaaaaggaaattcaaaatgaaaacggaaaattaaaaaaaatggaaaattaaaatcaaatgggaaaaatttaaaaatggaaaacggaaagagttcaaattgccctaggccatctttccccagtggcgttcgcccctttcggccgaacaatttgcctctggccactttttggtgttccaccaaaacggaacgacaacaaatgtagcagcagcagcagaaaaagcgggaaatgaagacgcatttacactggttgtgtacagcggaagggagccaaaccaaagactgaaattggggatgaaagtgcgaataacggacgaaggcactgatcagttgaaggtaaaatagaaaaggcactgatcagttgaaggtaaaatagaaaaggcactgatcagttgaaggtaaaatagaaaaggcactgatcagttgaaggtaaaatagaaaaggcactgatcagttgaaggtaaaatagaaaaggcactgatcagttgaaggtaaaatagaaaaggcactgatcagttgaaggtaaaatagaaaaggcactgatcagttgaaggtaaaatagaaaaggcactgatctattgaatgtataatagaaaaggcactgatcagtcaagaataactgcaaaaagttctgattattatgaggctatacgataaaaagcactgat

SEQ ID NO: 42979 - DNA, 882 bp, Heterodera glycines
aaaaaataattcattacacgagttttttacaaccacttattgccaatctaattcttgcagattaaagccatccattgcctgccggttctcggcacagcaaagcactaatacggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgacacacttcaaaaaataattccttacacaagttttttacaaccacttattgccaatctaatttcttgcagatttaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatcaattgcctgccggttctcggcacagcaaagcactaatacggtgtttgactcacttcaaaaaataattccatacccaaaagttttttacaaccacatattgccaatctaatttcttgcagattgaaagccatccattgcctgccggttctcgg

SEQ ID NO: 42980 - DNA, 1334 bp, Heterodera glycines
  misc_feature (45)..(45): n is a, c, g, or t
  misc_feature (74)..(74): n is a, c, g, or t
  misc_feature (79)..(79): n is a, c, g, or t
  misc_feature (106)..(106): n is a, c, g, or t
  misc_feature (150)..(150): n is a, c, g, or t
ataaaggcggggaaaaagtaccacgggcgctcaagaacggccttnttgaagaaatatttaagggtgaaggtgcncatgnacagataatccaaaaaacggtgtattngctcaggctctcggcccgtacggactgttataaagtgcctttgnctctcgaatttgtgcctcctaaaaatggaaaattattaggcaacaaaatgctgaccgcattaacctgaagaaatgcgaattcgtcaaaaaggttctttcgtctcccggttttcaattgccaatattggtatttgtcgccaaggatataactgataacaaaaacgggccaaacgaagacgctgaaccactttcgaactttaaatgctgttgaatgctgaacacgaccaaccatacaataatatgaactgttttaatataaattaaataaaaatttaaaaaagttccaaaacaactagtgattgtgggtgatactaatacaagaatacaggacagaccgggattcggggattataccgttgccggaaaaagtggaaaaacggccattttaattaggtttttggcgaattgtttttttaaccaaggacaaggcaaatcgactatcccttacccttactataaaagaagtgttttcgattcatcagtccgcatttttcattttttcctcttcatttgaattttttaaaatttctattccttatttatttgttcactttttggcctcgtttcaggctcattccatcttctgtacatataccctatttcctcacattaatgtcggcctacccacaagaacttctccaaaaaaatgtgagatttactttttaggcatgaatcttcaaatcaataagttgttgtgtattttcgtatttacagatcgcttgcaaatgcagagacggcgaccttatcaacgtgcctttctatctgttgctgcagtccaagacattcactgacttttggaaggtgtcatttgactgttcatatttcattcaccaaattaattgccagattcatcccttttctcccaatgaaattccggctgattatgtgttttctatggaaatcgttcccggagaggttttcatcaaagtggtcgactggatgggacatcgcaacggtcaattgcagtttcattgaatttagatgagaaaacccactaatttttaaggaaaggacgatccggttgttcgcacggtgacttcaatgctcctctacgtaattaaaatagaaattttgtttcaggatccgagaacgaatgagcgaattccgcttatttacaacgatttcgagagaaatttcttcgacgaaggttgcagttgcaatttccgtgaatgtccgggattaat

SEQ ID NO: 42981 - DNA, 999 bp, Heterodera glycines
cacaacggactcgaaccaccaccctttgttcctttactatcttacaaaaaccacttcgccacacatgcaaatttttttggaactgggaggccaaaattgaaacgatgtgtttagttattacatgatcatttagttaattaaataattaaaaatttaggaataaaaatgtcatcaaataaaaagtcattcaaactgaataagacaaagtcccagcaaaaaagcgttcaccaaaacagcatcattacccaagttggattgtcaaaaagtcaaaacagcaggcaacctttctaaattttatctaaacttgtcgaagccaactttaaattttcaaggttggatgtgtctgcttcggtggatagttcagtggccttttcaatccacaaaacttggcccgacttgcaattgaaccaaagtcacttgttcttcgaatgcactctgttcctttactctgttcttgcgttgtttctacagtatctgaacctgtacaggactttgtggtggcttcccaagtctcactggcccaattctcttgtcggtttttcccttttcacttttttattgcttacctttagaaataccacctgataaacccttacattttgtcctgtattgggcttctacttggtcttcgagttaccaaatgcttttgggatacggtaacattttggaacccatcaaataaataatttatttagataactgaccgtataagcttcttttctgctgggcaagatggctggaagttcatttgttggaaagtgtttgaaaatgcaattgttaagactcctctcaccaccgttgtgttgtccagcttcctgttcagcttcacacgaatttactttgaattcggcatcaaatccttcctttgtttcacttgcccgtgggttttatgaaattgaagaaaaaagctcaaaatttttgcttaagatttgttaattttgtagaaaaatgaccatatttgatttttttatagatttttactaaaactatgtaattttc

SEQ ID NO: 42982 - DNA, 937 bp, Heterodera glycines
  misc_feature (35)..(35): n is a, c, g, or t
  misc_feature (859)..(859): n is a, c, g, or t
tcaagaagcatacttagcaaaaattgtacattacnagagtattgaaatttgatttttcagtgattatttttgccatttatcaatcaatttttgcattcattgagctttggtttcactcgttaatttacatatttatttttaataagattttttcaaaaaaataaaaaatgcgtcattatctccttaaaattgtatgccaaaaacactgcgttataaaacggaatttgatctgatcaattaagcatgcttatcacgaaaagcaccacataagcttggaagaggcaatcgaagcaaacacaaatggggcttacggagaagcattgttggcattggtgaagggcaatctgtgaacaatttggacaattaatgaaaaaagagaaaaaaagactcattaaataaaaaaaaataaaaaaacttatgataaaactgataattttttcacaaatttattaaatatgttgaaattattcttatttattatatcaatttttatcgtaaaattttgacgatttgtgaattttgtcaaactattaagggcaattagctaataaaaaacaattaagctgattaattgtttaaatttcttcatgttattttaaattcacccactttagttacagctaaacaaacctgtcaacgaatttattaaatatttttaattaggttacaaaattctcaaaatcagatattttgatgcaaaaatcattgggattcgtcaacggcaaaacgattatccgtttgctattgtacatcgccttgggaaattttctcgcaatttgcgtggcatttataaataatcatgttaaacaaaaacagaaattttgcaccaatcacgtcagatggcagacattgtagaatntgtctttaaaattgaaaataaattaaatacaaaaccagggctcccaagtttttttttcaaaattacaaacaatttacc

SEQ ID NO: 42983 - DNA, 864 bp, Heterodera glycines
tgctcacgttttcgctgttgaacttaaatttaagaaaaagccgacagaaaagagtccatcttcggactaagaatcaaatgaccatcacattcatttctacaaacaatcggagaaaattgagttgttgagttactttgtcttcggtgtaacggaccatcagcgattgttttgccgacggcgccttcgcccaacaaaacgactttaaatgctctgattgtctcttccattccattcggttgggatcagcaggaagttctcagtctttgttgttactttcaattcgtgataaatttgaaaaaataaaataaacgaacggaactaaaaagggcaaaaaaatgaaataaataaaaaaaagatatttaacattttggaaagtgttcataagtagagaccggcgcgggattttgcggggtcccagtccgcaatcccgcattttttggaaaatgcgagattaatcccgcgggatcccgtcgcgcaaagaattttgaattccaatcccgcaacgggatccgcaaattcgccgccgcccacgaattcccctaagatttcaattggaatctgaaattacccttttttcagtgaagtccgaagaaaaatattcaaaaattccatttttttttctaacgcggcgcctatcgcggtaagggatgaactccgtctagccattccgtatcagcaaacttcaaaaatctatcttttgttgataaaaccagcaaaacagtatcattcaacttttttttctaaaaaatggcctttttgtctaaaatctattacatatgaaatcgcacaaaaaatctaattttttaccgctggtgcctgtggcgccgccggtgaatttctaaaaaactgacttaaaacaaaaat

SEQ ID NO: 42984 - DNA, 1055 bp, Heterodera glycines
  misc_feature (106)..(106): n is a, c, g, or t
  misc_feature (130)..(131): n is a, c, g, or t
  misc_feature (176)..(176): n is a, c, g, or t
ttttaaatttatctatatccaagaaaaatgactatctctcttttgagaaatttatacgtacaaaagcgctcgagcgtgagagggagggcggtgcgcaatcgccatntaatttctcagagaattttaaatnntatcttatatccaagaaaaatgactatctcttcttctgagaaatnttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgaggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttgcaaatgctctcgagcatgataggaagtgcggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatatatcttatatccaagaaaaatgactatctcttattttgagaa

SEQ ID NO: 42985 - DNA, 869 bp, Heterodera glycines
tagaatatacaatttagcactccggtggtttagcttaatagagcatttattttccctatttttttatctcccaaaatgattaggtcaacaatgtgtcctcctcatcggccacttcatcagcagcaggtggcagcggcggcggcatcgctttgccatctgctaatcacccatttgtttcaccaacctcattagtgccacaactggaggcagcaaactcattttgggtagaaaaaacactcatttcaaatgggaaaaaataatttaattaaatagttaaatgtaaatggacaaatcccattcccgagtgggtgttggctggaaaaccgggccaaaaataataacattaaccttttttttgaaattacatacttttcagggtgcactgtttcccctcccctatataaaaatttttacaaaatttataaattttttttgtaatttttctagcgatttaaaaaaaaataattaatgctgaataaagtttctttttaatgtttccaaaaaaaaaaaaaattgttgaaatatttttcaaaattgtatgagaaacgaacttctcattaaggccgtagccagacccttggcttcgggagggggctgaagtcaaaaattcgatttttaggggtgtatttttgctttttttgaaatcccgaattaggagcttattttggaaaatttttcgccaaaaaattactattttttgccattttggccgcaattttacaaaattatgataaaatgggggtccggcggtgccgataggcgccgccgggaaattttttgagtattttaatgcacttttgttaagaaaattgtttaaaatttaaaaaaaattactgaaatttttttacttttttgggtttcgggggggg

SEQ ID NO: 42986 - DNA, 737 bp, Heterodera glycines
  misc_feature (695)..(695): n is a, c, g, or t
aacagagacaagacgtcagtgtggactttggagtgaagtgagtgccccgggggggggggggggtaatgcaaattagcaaattggggacgaaaagcaaagcgaaagaatgaagcacggatggaaggtgatggtggtggtgaccttctctgaattgtttatgggaatgcgcccaaagatggagcgaaaatgcaataataatattttatttattcatcaaagtgccgagagtgcttaagggcctgggaaggtcaatgccacttaaaggggggggggggggacaaatgggagataaaagagggacaaatgggagacaaaagggacaaataggagacaaaatagggacaaatgggagacaaaatagggacaaatgggagacaaaagagggacaaatgggagacaaaatagggacaaatgggagacaaaataaggacaaatgggagacaaaatagggacaaataggagacaaaatagggacaaatgggagacaaaatagggacaaatgggagacaaaatagggacaaatgggagacaaaaagagagacaaatgagagaaaaaatgaagaaaactaaggtccaaataataaaaatggccctttcttcccgtatttctcaaatgaccacggtttttagcgaattggttacccaacaagttatgtccgatgccatcatcccgaactgctcttactccgtccacnagtgacgaatgaatgaatcacccatttttttctgtttgccat

SEQ ID NO: 42987 - DNA, 1111 bp, Heterodera glycines
aaaatgaccaaaataggcttagaatcacatttgaatattttacaaattaatttttatatatcattttttgaaaaaaattttagggatacattttcaaaaaaaaatttttaaattttttacaaaaaatttctataaattctcaaaaatcctcaaaatatgtaaaaaaatgaaaaatatgtacgaaaaattgcgaaatatgtacgaaaaagtccaaaatatgtataaaaatatgtacatatttaatatgtagaaaaatcccaaaatatgtaaaaatatgtaaataaaagtcccaacttttgttcgcaaacacaaaaaagaaagtgtttttcctactaattaggctatggagaattcagcagtaaaaaaatatgtatttacataaaattagcagccctaaaaatgattgttaaataccaaaaagagtttaacgaaataacaaatgagaaggggaacggattttgcaaaatttcgcatttgttttatttcatattgcacaattttatcatgttttgtattttgttcttcggtttaaaaacctaaaaatgtgtgttcaagtatttagcttaattaatgataattaattgggctaatatttatagttttttcacaatttttttcctgagcccccgtagcctgaaatgcacgaaaaacatgttttttcggctgttgttaagctagttttcgagttattagcaactatttttgtagttttttatttttagcaactaaaaaactataaattttttgaaaaaaactattttcaactattttggcgttttgcccaaaatttgcaataaaaacgaaaaatcacccctattaatcgaacataaattttttaaaaaaaatacaccactaagaatcgacccgaaaattttcaaaaatgcacccctaaaaatgaaaaattttctcaaaaattcacatccaaaaattatttgtttattttcgtgattataatttttatttttgaaaattatttatattcttaatgatttggcaaaatattttcgctttttgaagaaattttcgattttacaccccctaaattcggaactttttagcaactatttgtccagttttagcaactattttggggggttttttagaacactaa

SEQ ID NO: 42988 - DNA, 81 bp, Heterodera glycines
caagctgcagccatcgggcttcgcctcgctgcgcgaagtggcgtcggcgctgcaggacctgcgcgcgtccggcaagcagct

SEQ ID NO: 42989 - DNA, 891 bp, Heterodera glycines
attttccaatttttcccaaacaaacgcgacgagaaacaactaccagaacaattagtatcgcagtaattattctgagaatgcggtaggacttcctattactgtcgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccgaacaaacgcgtcgagaaacaaattccagaacaattagtatcggcgtaattattctgagaatgcggttggaattcctattactgttgagcagaaaaagagatagccaattttccaaattttccc

SEQ ID NO: 42990 - DNA, 615 bp, Heterodera glycines
ccgacgtcgccgtgtcctaccggtacagagaggcgctcctcctaggcaattgcgcttttgcgtcagaagttgcggttgctgtagaaccgtctgctgcacgaagacgcggattgcattggcactgaactgcggcggatcagcgcaacgccgccacctttgcgtagtgagcagcagcgacgacggcacgaggcgctgtgcgtacggagcggcgaaattgcacggatgacaccactgattgggatgctgcagcacaagctgagcacgctggacgacgcgtgcacgaggcgagaggagcaggcggagcaggagcagcaccagcagcagctgaaccaccgaggggaacggggaacaggtaaaacatacacaaaaatcaagcgggagaaattttttgtagaaatatttttatagagaactcggcgaacctgaccacgggaaggatggagggatttattttccattaattgaccgtttttctatccgccccttttccgttaaaaagatgggacttttgggcatctaaataaatttttgcaattttttagaaatcttactaaaaatttaacgagaacgactgtcggcactatcgaatcacaaattttctttagtttccataaa

SEQ ID NO: 42991 - DNA, 931 bp, Heterodera glycines
atgtttttttccttgttgttaaactactttttgactttttattagtgcctattttctaggtttttattttagagcctaaaaaaattttgaaaaaaaactatttttgcctaattaggaatttttcaaaaattctgattatttaaaaaagttaattcatttttttaacccgggaaatttaggccaattggaaattcataactcacttcaggattggacaatgttagtggaataaagcttaaaaaataaagaaaaatcgggagaatttatattttatttgtttttttaacttaaagatgaaaaatgtttttccagaaattctggaaattttagacttagctcatcaagagctttcgaatgataccaaatttgtcaggtttcgatcgttttaaaaatcccccggataagtcaggagtgccaaaaagacataggttcaaataggtaaaattctcatttcaaggccacaccatcaatcacaagtgcacagacaaatgttaaaacattgtcaagtgatcaaagaaaggatttgtttgtccggcttcttatctgtgattttttgaacgggttatattccttatttgtgattttgcaagttctcatctcatcatttttgtaccagtgtttcttgtattgaaaagtgaacaacgatttgaatgcaacaaaaaatgttatcatataactgatgaaacaaaggcaatttctttcactttccgtcgctgcttctttttctttgaagccttttcgttattttctgctcgcggagcgacaaacatttttgcattttgtcggctttccaatcgcatttgaagaaattttaacgcagctatattgaggccaacgcaattctgaaaaaggcaagcacaaagtttaatgaccctttgatcactctaaaacatcgcaacaccaaccaaagtgtcagcgatatgtttggcaa

SEQ ID NO: 42992 - DNA, 1286 bp, Heterodera glycines
ataaaaagttgataaattctcaattcgctgttttcgccttccagacgctctaatctggtaggaatcacattcattccccataaggaaatagacgcaattatcgcatcacattttggtctcttttttcatattttaggctaccaaacatttgtagacggcacaaaatttagcacacaatgaatgctttagcttagcagtgttttgatattgaaaaaagcaaatatatatataataaatgtatttttaaattaaaatatgtagttttcaaataataaattattcactgacaaatcaaattaaataatttaatttgacaattcaacggcaagaaaaatgttattcgaaggctcagcagggcaaaattattgtcattgtttagctcctaaaaacggtatcgttttcatcattgccttcgcgaaggattcacaaaaacgcaaagcgttaccaactgagccacgcaaaggcacgaagacaaaaagcataaaatgcagaataaatgttttattttttatggtcaagtccccggaatccctgcttttttttgtgctagaataacatgaaacacattttcttggctttttagggtcgctgatcacgaatatggcattcattttgacaattgcgaagcttggactcgatttcaaacaaaaatgaaacctaatttattttcaaaatttatattagataaagtacttgatgaaaaatcatagacaaaatcaatgattttgcaaaagctgaagtattctgatttgggggtagtaaccaaattttgttctgattacttttaattcattttaaataaacgaaattttatggcaaaaagtcattttttggacaaaatctgttaacaatttatttcttttccgaaattgttaaatcgattcgggcggcgaaaaatattatatttgatccatttttaatcgaataaatagttaaaaataacatttgaagcaattttgcaaaattttctgattttgaaaaattttagataaaactcttatgaatctgtgaattgttttattttcttcattttgataaaattttgtaaatatttcttttccttttacaatttacaagtttttcttttctttgtaaaatttatgaatttattccaattttacctttttacaaactgtgaacaaaggaaaatcgcattattatgcaaaataataattaaaaatagtttttaatcgaatgctcaaactaaccaagacggcatgtcgttgtcactgttcagcttaaactagatacgctcaataaaaaattcaaaattgtataaatttttg

SEQ ID NO: 42993 - DNA, 734 bp, Heterodera glycines
gaaataccaaataaatgccgaggagggacaagtgatcgccgcatatattgtgggcaattaaataattattaatttatttaaaaaatgattttacataatttatcagtcggttaattaattgataactaactaattgattggttaattaagaacaaagctcgcgcgcgaattgccttaggcgaagcgccagaccttccgattgcctccggcatgaaccaaattgtaattaattaataaagcaattattaaattcacgcaaaacaattacagtaaatttaacttttagaaaaataattttttaaaatttttctgtacagaaatggagggcgtcgttagcagccgaagctgtgaaagtgttgggaacaagtcaaaacaaagcagtcaatgttttggatttggaggtttcactttaaaattgaatattttttggcacaatgccaacaaaaattgattaattaatcgcaacgaattgcattttcaaggcgattcatctgatcgccggtggatatagtcagcagcagggcgaaaacggcacgggttacggtatgaacaacagcgaattgggcggcgcaggatacggtaacgagcgggactacggtagacaattctccaaattttccatttgaaaacattaaaattgcaaactttcaagatttaggattcttctcgggactgaataaaaattacatcgaatagagtgagttatttaaaatagtttcttaatcacaaatgaa

SEQ ID NO: 42994 - DNA, 955 bp, Heterodera glycines
  misc_feature (873)..(873): n is a, c, g, or t
  misc_feature (933)..(933): n is a, c, g, or t
attttgaacaaatttatggccaaaaaggttgggtcttttaattcttttggccataacttttttgaaccttaatgaaatttttcaaaaatttgcaggctaatagaggacacttagagcttccgaatgataccaacaatgttggatttgattgacaatgaaaaaagttatagccaaaaaaatgccggcgcccaactgagcggttccgtcaacaagatataaaattatataaaaaaatcacaaaattttcaaacccacacagaaaaaaccatattattatatgcatatatatttatttatacttatatataaatttaaaaattattttaaattttaactccatataatttcagtttaatacataaaaaaataattgttaaaaaaaattttaaaatacataaataaaaaatcgaactatttataaaagtccttgctgagaaacttcaacatttgattgctcctcaacacgagttttaaaaaagaattattaatcattaaaaattcagagaatgtaaacatttctaattttaatgaaaaaaagaaaaaagaaaatggaaaataaacatttattataatttaattaaatttttttactataagataaagattaaaaataataaatagtacaatatttatgtaaaaattaaagatgaattattcaaaataataaagcgaattcaaagtttatttaaattaaaaaatttgtacttcacaaattaagtgaattgcatttgataaaagactaaataaaacattaataaaatttatttcttaattattaatacctaattaaacggaaggttataaatgaaatagcaaattgtactcaatttaaattaagagaaatagaaaataaatttaataattcaatactanaaaatttaatattttttgacggacaccccatgaggataaataaacataaacaatcacaanagtaaaaaataatttacctaat

SEQ ID NO: 42995 - DNA, 1211 bp, Heterodera glycines
  misc_feature (43)..(43): n is a, c, g, or t
  misc_feature (1183)..(1183): n is a, c, g, or t
aattaattatttattttctgtctgtcaaatgttttcttcgccngacttttctttttgctaattttctttctctccaccacaaatggcacaacagaaacaacaaaaaacgcacaatcggcgccggaaaagaaaaagctcaaaattctcgtctattcggtaatccccgcgcacagtcacatgcaatttatgggagcaattgccgactcattggccgaggcggggcacgaagtggtgaggaaggacggacagaattttagaagaatttaaaaagcaattaagcatttcatcaaaacaattgacgacgatttgcaatggacaagcaaagccgagagcaacgagaccaaactgtcctccaaagtttaccgggttgtgctcaagtcgcgcgaagcgcccgttgcgacttcggatgtgctttatccgttcagtggggacaatgcgtggcaaatgcgcaacgcatgggacaacagattcgccaggcttttcgatttgtggccatatttttgcaaaggcaattaattattcctaattaattgcattacattttcaaaatggaattcactgacttttcagaaattgccttccgtcacgaattgctggacgaattggccaaggagcgctatgatgccgccatttatgaactgttcgatctgtgcggtgctgccattttcgagcgcatcggtgtgcgcaccaaattggcaacacttaccgtgccaatgtatcaaacgactgccgcccattttggcattccaacatttgccagttttgtcccaagtaaaaaacgaaattaatcattatgaggagaatcacaatttcctgttcaaataaatttgccttaatccgctattcacagattgggctcatccgccgctcaatgcgccggcgatggacttttgggagcgtctgatcaatttcctcaacactttttacgattggtacaaattgaatgatcgcgtcaccgatttgcaggtgcgttcggtgcatttgttgtccattgtatttttagcatttatttttatttttattatttcagatttttttccatattttacattcatatttcggtactttcacaaaaataaaaaccgaaaaatacacctctaaacatggaaaattttttggaaattttgtaaattgcaaaatttactaatttttgctttttttctaggttcaatatttttcaganaaataataaatatgtgctctcaattatg

SEQ ID NO: 42996 - DNA, 926 bp, Heterodera glycines
  misc_feature (901)..(901): n is a, c, g, or t
atttgaaacgcaaacaaaaaaaattcttagaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgncaacaaaaaaaattcttgacaaaaa

SEQ ID NO: 42997 - DNA, 1373 bp, Heterodera glycines
atcaaatttcagagatgaatttgagtttttaattatcttttatggcctcctgctggggcatataactgtaaatttgtgattttcacagttaaattttgccaaaattgcgcgaaaaatgtgaaatttatttttatttaaatgattttaaacaaattaaattaaattattttaggtttttgttttttttattttccattcaaaatatttaattttttttctcattttaaacttccaaagccacttttcgccattttgttcacagttcattttaatttttctcctcattaacacccctaactgtaagtcttttttattttctttctaataaaaaataattgtttcatttccaagtaaaaaaaaaactcgccgaaaaattaaccaattacaaattaaaattcctttgatttttttttgcatttaaacccaaggcaacttttctcaaaatacataaaaaatgttttaattttttccaaaaaatcgccgcaactttttttttctcaaattaaaatacttttcacttttttccacgtaaaaccccccaggcgcaattttcgtcttctcccctttctttcgacacccaaactaactaatctttgttctttcttctcggcccaatttgcacatgttctctgttggcagtgtgttaagagcccatcagattggtcccgccgggggccacaaacttcgaacaaatccatccaatggcaaaaagggggtaggggggggggaacacgaagaagaagggaagaagaagattacgattaatccccacgggggggggggggataatccgccgctgcacaaaaaacgccgctttttttgtcccggacaaaaaatataccgaaaaaaactgggggggggggggtcaaataatgcaaagatagccccctcagacgacacttgttcttatttattattgtctgcatctccccaccctcccccagatattcaatctttttatggaacaaaagaataggcacggtttcagatgcattcttttaaaatattactaatttttcaaataaaatgcacaatttggcagaatttatttaatattggaaaatttaaaaaaatagattaatgtatgatgatcagggatgatatttatagttgctaaaaacttccgaatttaggggtgtaaaataacaaaattttattcaaaaataaacaatatgaatccaaatcattattgagattcacgtagcaaataagaaacatgtcgagttgatcgggagatagacgtgagcgattatcagttacaatagatttgtaaattgaaaagatcgttcgacatcacatttttatagctttttagttgctaaaaataaaaaactaaaaaaatagtttcctaataactccaaaaagtagcttaa

SEQ ID NO: 42998 - DNA, 1248 bp, Heterodera glycines
  misc_feature (1043)..(1043): n is a, c, g, or t
  misc_feature (1147)..(1147): n is a, c, g, or t
aagaggtacaaaagtgattagaagaggtaccaaagtgattagaagaggtacaaaagtgattagaagaggtacaatggtgattagaagaagtacaaaagcgattagaaaaggtacaacagtgattaaaagagtgattagaagaggttcaacagtgattagaaaaggtacaacagcgattagaagaggtacaaaagtgattagaagaggtacaaaagtgattagaagaggtacaacatggtttaaaattaaataaataatgaaaagtttttataaaaatcgaatgcattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaattttaaaaaatttttcacaaaaaaataatttaatttaaattaaaaaattaattaaaaaaaacaaacactcttttaaatgaattaaaaacattaaaaataaccaaaaatgcatagcaaaaagaatgtacaccgtccggatccgaacctgccccccccccctcaaaatgatgcctcagaatccccaatcacacagggattctgaggtcttaacgatgtctaaactaaaatctgatcacgtattcgtgatcagcggcccaaataacccctaaagacatatttttggaagaattttgtgaaaaaaaaattttccattcaaaaatcatgtgcacccccctttggtcccgaatcccaaaatcacttttatttttgtaacatctctcaaaaaagtgataaaaatgccaaataaaatttatataatagagcataaaattgcggatttttgtagtattttacttttacagaatgacttttcagaagcgagttctgaatttttttctgaaaaatctaaaatttccagaatttctggaataacttttttcatattgatgttagaaaacccaaataaatccgataaaattctcctgatttttctctatttttanagttttatttgctcaaaattggtcaacccttaggctagatatgaatttttcaatattcgcccaaaatcccgagggccaaaaaatgccaaaaataaagattttanaaaattcaaaaatctgaaactaaaataacatcatattctactcagcaccttatttaccccagaaaaatattttcacccccattttcgtccaaaaaaaattt

SEQ ID NO: 42999 - DNA, 731 bp, Heterodera glycines
tccgtttgggggtactcaaacaattatgggggagcaaaactccaacgcagaattaaagtacaggctatagtgaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtggggccttc

SEQ ID NO: 43000 - DNA, 1053 bp, Heterodera glycines
  misc_feature (12)..(12): n is a, c, g, or t
agttttctgtgnggcattggggttttgccgtgcttgctgcctgtgtatttgttgaccaaatactgcagcagattttttggagtgctgatccgcagatccatgtcaggtctacgcaaaaatgttgctatttgccaatcaatttttgcagcctggtcaaggatccagcgctgaccaagtcctccaccacatgaaagaatgtggtggtattgcaactccacattttcatcccttattgcgagataatacttgcaataatctcgcagggagataaattgtttggatttgtcaatccgccggtgctgcgatgaaacagatgctacagattcagcatctgaatctgcgactgaccccgcatcaaatgatgcaattgactgagtctcgcacgactcattatctgactcggcttccgagtcaaataggccagatgcattctgagcaccttttcgcttacgcgatggtggtttagcatatttaatgccagttgtgtatccatcatcgcccattggcttgattaatggatacgtaagactatcagtccacggactgaaaggagcaatttcatttaattgcccttgtttgttctctacccaaattcctttgggcggaggagcaccagtggggtccgcatgaatagagaacatcccttcacccgtagaaggggtgattatttggtgtgcgtgcaattttgggtctttaagaccagctggagccctgcggctatccaacaaagtcatgcggaagaaacgaagctcttccggagattgttgttggagaagctcagtgagctgctcacgcgcctgcttatatgcctgcgcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaata

SEQ ID NO: 43001 - DNA, 1542 bp, Heterodera glycines
  misc_feature (1161)..(1161): n is a, c, g, or t
  misc_feature (1199)..(1199): n is a, c, g, or t
ccttgcggttgtacatttggtcgttgtacttgttccctattctatggcattactcggctggccatagaccaggatgctcacaaagagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcgaccgattggtggtctctttgttaggttatatttccttttgttccatttgtcctttgcccatataaaatgctcagggactttttcaaaaagcatgtccttgagcttcggatcatgcttccattcattttgccattgtttccaataggcagaacattgcgtctctggcagttcgccttgctggatttgttgagctttgctcaccagctgaaaagccctgtacacaatcggttgttgattaggcatatggatgctaagtttgacaacctgatgtgaaagtttggcaaatggcagtgaatgaacaatggcatatgcttccgttgcaccacggaagttcatcttggcatattgagccggctcatcaattccgattttattgccggactcttgtttgcactcgacataacaatgtcctggccctttaaaagggtacttgagtgcgtatttaatatttgctttgttaccatatgcaaacagtacattatggtgtactcggtaacgcagcagaatataaggattatacggcacgacatgtgagttgtcgtatatcaggccgtttacctctaattgggcaccaccatcagttggtgaaggacggaaatacattgcgggcctgtccgggcgcaaatcgtacatttcgagtaaggagatgggaacccaatattgcaccgcccgtaaattgggtcgctaggaccacaacatctgtccctgcatctgtgcagttgcatatgcattgtttcgcggatttcgtcgatgcatttttgcaatgggtgtgtcggcatcattgtgcggtaacgatggaatatgcgcccatatatattggtgaataacataaggaattgcatccagggctgncggcgagcacaatgtgagcatgagggcccgcccccccncgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccattcttcgacctgca

SEQ ID NO: 43002 - DNA, 1604 bp, Heterodera glycines
tgaaaagggcgtttcttctcgagagccctcatttgtcatttgacaaaagtcttgagtttcactaagcgggagagagaggagagatcagctgttttagaccaagcaaaacatcccccagacaaaagccgggaaaagcacgggcggttgcgagttcgcccacgcggacgccatcgaagatttatgcggtgctgctttggtgggcaacgcggcgcagtcgcgcagcagcacagccgagggcgatgtgcgcgagctgtacgaattgggacgacgccgtcgcgcctgtccgtactttgccagccgcgcggcgcttggcctttgccaattggtgttggtcccgtacaacattttgctgcacaaatcgacgcgagacgcgtggcggtaaggaaaaagcgcatctggcgaaaaaatcaattctctcgaatttaatccctttttgggatattgtttttgaaattttaaaagcatcgctaattatggcacttcgtaaaggcataaattttcgaatcaggctgaatttgcgcgacaatgtgctgatcgttgacgaggcgcacaatctgttgcagacattggcctccatccacgctgtaattttcatttggcaaagtgatcggcggaattggaatgaatttactttgtagataccgaccaatgccgggattagggggtcgagatcaatttgatagcactttgggcaaagtgaacggaattggaatggattttactggagagatttcggcagtgccgggattaggggtcgggatcaattttaaagcattcagattcgttggtctttcttgatcagcagttttactgttgactctttctttgcctttgtgtcaaccaatgattctcccaccgatccaaggtggagctgagcacgggccaactcagtctctgctccgcgcttatcacgactatttggagcgcttccgaaagcgggctttcaccgcgaaaccttcgccacattcgccaattgcattcgcttacggtcgctgtgtacaatttggccacttcgacggcaaaggaggaggacggcggtgccgaggagagagtgctcactctgacccaatttatggccaaagtgcgctagggggagggccaaattggggggggggggtcgatcaccgatacttaaatccgaattggattgattcccttttgaatagccttccatcgctcccattaggtccattccttcccccattagtcgcgtaattatcgacgattgtcccaaattcgcctttctttgtttaagtctccgctgtttcagttgggctccgcctcggacattgacctgttccgtctgctcgactacctggatcagtcgaaactttgcagaaagttgcgcgactttcgtcttcggcactccgcccgagggcattcccagccgaccgtcgcttcttccgagcaaagaaatggtgccgtgggactcaaatctcacaggggccgaagtgggcaaaagctaaagcagcgccaaacagcgaaaaaggaaatgccgaggggaaattctgcctcggaaaacattccgccatctgcgaatgagcacggtgaagctgcgacgccggcggacaccaattcaacaccgctttaccaattgcgggagt

SEQ ID NO: 43003 - DNA, 1062 bp, Heterodera glycines
  misc_feature (39)..(40): n is a, c, g, or t
gagatataaaaaaatcgtctagaataattatctcaacannttgtcgggaaagtgaataaaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttagatcctttttagaaatgctgcataaatttttattgtaaatagtcacaaacaaactttttttcactcccaatatctgccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggaatattggcacattacataaatgcagagcaggcacaaa

SEQ ID NO: 43004 - DNA, 819 bp, Heterodera glycines
tgcacgtctcactgttcatcctgatcagggctttgctcgtcttttcccaggtccgatcaacgataaaattgtgtttttattagggactgatcaattcaatttatgatgatcaaaaaactaattaatttatcatgagtgatcagaaaactgtttaatcatatataatttaactatgagtcacaaaatgaaaagaatttgtgatctgtataaaattaacaaccaagccattttacagggtgttatgttcccggccatgcattgtctctggtcaaactgggcacctccgcttgaaagaggttgcaaaatatttaaaaatttgtttcaatttttcctaaaaaattaaaattgatcgcccgaagtgcagaaaagtgccctgaggcgaatttcagcaaattttaaccttctatttttttataaaattaaattcaatttcattatatcatcctgggctgcgaaacctggcctcactaggccgatcttttgaaaatttttgataaatttcttccactttcctcaaaaattaaattcaaattcgaaatatttccgccggagtgaaaaaaaagtgccgccaatgggtcgaactttaaaattttgacgaaataattattgaccaattaagagtgcttcccattaattaaggtcttctcacgggtgtcagctatgcaggtgcacaaattggcaatgtgctggtgatgccattgtccggtgtgctttgtcggcacggctttgacggcggatggccctccattttttatttgcttggcattgccggactgtgctggtgcctgttgtgggcactgaccgtggcaaatacacccc

SEQ ID NO: 43005 - DNA, 1186 bp, Heterodera glycines
ttggcattttcatcatctcttcttgtttattggcattttttatggcacaacatttcttatcttttcctcgtcttttcgtttcttgtggcatttccctatggcacaacatgacacacattagtgtctcacacgaaagtcacagaacaaaccactaatgttttatcaaaagcatgacacacattagtgtctcacactaaagtcacagaacaaaccaaagatatgcatttctatttcattaaaagttcaaataacattaagcataagcataattatttcacgtaaagaacacaaaaacaaaataaacaaacaaacaaacaacaaccactaaatcaaactcaaacaatatacttataaattttttcgtttacaaaaaacaaatttatataacaaataacttaataaactatgaacatagataaaaaaagcaaataaataggaacaattttaagaatgtttattgcaaaacaaattgaaaaatcaaaaccaaacatattcatttttcaaataatattttaacgcaaaaaccaaacattcttttttttgaattcatttttaacgcaaaacaaatacaaaacgccacgccacattcaaaaactggaactgacaaacactcaactttattatataggatttttaaaaaattaatttttagtttggtgcctttttaagatttttgttattaaatttgattaatttttaaaaaattaaatgaaatacttttaataatttatgcttcagatattgtggctttgacaaaacaaatttgaaaatatttttatgggttttgggcctcgcaattttcgccttaaaagttgaaaaaagtcataaaacccaaagaataaaatataaaataaaaatgcatgaagaagcctctaacagtgtgaaatacttttgtcattttaaggtcatttcgagtgagcagaaaaaagctatttgacttaaattccgagccctatgaaacaagagaatcacaaaactcattagagcatcaaattctttatttagtaaaagataaaagaaagttcgacagcgaattgttgaggggactatcacttcctcctttttgtttgtccatctcggctaatttctgtagtttctccacttttttgaagcgtcggcgaccaaaagacaaaacattttggaccccatagaggtactaaaagataaatttggaaggcatccataa

SEQ ID NO: 43006 - DNA, 797 bp, Heterodera glycines
  misc_feature (772)..(772): n is a, c, g, or t
  misc_feature (774)..(775): n is a, c, g, or t
cgtcagtagaaaatgcgtcagtgaaaattttattgtcacaaagcgaggtcacgaccacgaatccagtaccctttttggcctattccgaatcccggacctgaattcgaacaaaaagtcgaaagcccaaactttcgaatttagcatttttggttcaaaaacgccataaatgatctcttattgaaggattgatgggtttcagtttgtttccgtgtatttaaactgattttgaagaaaaaccctaatctcgaaaattttggctttcgactttttgttcgaatttgggttcggggtttgaaattcagaacaaggtcttatagaagtgtatttttatattacaatactaatgctacagaactttatactaaaatatttgtatcactgacgcattttctactgatgcattttccactgacgcattttccggtcacgctgaagaaaataagaaaagaaaattatttttcaccaaaatgagcgatataaacccaattactgccaactaaataaaatgaacaaagtgaggaaaatgaaaatagggatttgatcaaataggtcgagaatgaaaacagactcaaattatcaccagaaaattaaagaaaacattaagcaacaaggaaaacatcaatggaaaaacagagtcaaaattgagaagcaaattggaaaaattttaggctaaagtcgccataaaatatacaaatggaaattatttaataagatgaaaaagaattttgtgaggtcaaaaaagaatgaattcattttgatatttgatgaattnannatttatatgaccaaggcaaaca

SEQ ID NO: 43007 - DNA, 1055 bp, Heterodera glycines
  misc_feature (1021)..(1021): n is a, c, g, or t
acccgcactgcgcgtggcatcacgcgcggtgccgaccatggcaacagtgagttgatgtgatcactcaaaaaatgccatcagtttaaacaattcttggccccccaacaaattggcagttgatcataagaaagtcgactaatgtccttgaaaaaggactttgaatcagttatccttgaaaaaatgatttccaaccgaaatagactggagttcttgattagtttttgatcttgaaaatcgaaatagaaatttatattgatcaattttgatcgaaattttatgaattaagagcagaaaaaaatattttgaccattttttgtatcggaaaaccaaaaatgacgacttttggtcgaatttatgtcggaagaacggcattttcgatcgacttttttgttttacggattttttgagataaaaattcacattgacagacaacaggtttctcgagcaatcccgatttcgagaccaattattgacctgatttatgccttcattgggattctcgatcagtttttgatggccaatgtttaaggatcaaatccatggacggggagcagccggtgcaagacgtactgggacgaaaaacggtggaggaactgtgtcggggcaaagagacaacaacggcacaaaacgcagcagtgccacaaacgttcaaagcagtgggcacaacgaaagaaacaaatgaaaagggtaaaaaatgccaaatttggcggaacattttggcaaaagcggaaaatgacaataacttttgaattgtatttgtatcaagtttattttttatttttaactggcagtcgaatttaaagggctttatgttacgaaaatttaaaatggtagaagcggcaattgaaaaattggaaaaatgccaaaaaaaaatgcaaaaattaatgaaaattctcgcaaaaatagcagaatggcatatggttggaaattctctgaggcagaaaaatgaattaaaaaatggaaaaaaatgccataaaaatatgaaaatgctaaaaatttgaaaaatgccaaaaatgcctanaaaaatttgtaatttttttcagctggcgccaaca

SEQ ID NO: 43008 - DNA, 481 bp, Heterodera glycines
gcggtcatcgatttggccaataggtgttggttgaaccatctgatgaagtcctgcattgttgccggcacttcctcaggtggcatcggctcgaagtctccgacggtcatttcgatggtgcgcaagcagccggcccgggtgtcgcgtcagcccattacttccaagtacagttcgaagaaggtctgcaaaaagtgttgcatttccactgcacggcatgtgaagccaactgattcactttgagcgtgaactgcttgacttggaaggcgggcttctgcagggcttgtaacagcttggcgtcatcggcgagtaatggatgtcgtcgtcttcctcctcctcctccgcttcagcttccacgtcgattgcttctgcttcggcttcttcgacatttgaacggcgaagatgccgcgccgctctcggacttgcttctgtcctgctgctccattttcggcatttttgctgcttgaattcgtcattttaatgtgct

SEQ ID NO: 43009 - DNA, 1107 bp, Heterodera glycines
tgtcttcaaaaatggtccgaaattacaaataatgatttctttattttttaatttgatcgaaaattttgcgaatttaattttatgttaatcaatataaatttaaatttttttagaaaaaatttccaaaaccttcctttccccaagaaatgttgaaaaataataatgaaaatttcgaaatggaaagctaacaaaaaaattaaactataaaatcaaaatctttgttcccatccgaatttatttttgcgtcttcttccatactaagaagcttcacaaaattcttatcagttatactaaattgattattgttttttaatgaaaaaatcactgtttaatatgaacatttgaaaatgaagaatttccgtggctctgatgataagatttttcaaaaattgagttccgcccgaaagacggaattcaaaattaatttaattttacttttgaattttttaataaataaattttattatcgaaaatgccatttccttctctttcgtttggtgtcccgggattcccattggccaaaacattccccctcactttgtaaatgtttgttgggatggacccataaaacattgctgcccccgaggggccaatgctttagcaaattgttgccaatttttggtgtccccgaggggcggacggggggggggctaattgcgatcaatcttatggcccgggggatgttctgtggtgtttgtttatggatattagatggatatgttatttaaaatgtgttcaaccctttttttatacaattattggggaacaatttttgaatttttttgggggggaaaaatccttaaacttttcaggaaattaattttattaaaaaattaaaaaggaaaaaaggaaaaaaataaaaattggaaaattttaaatttattaattttttagagtgtatttttgtaatgtcgaaacaaaattcgaaaatcgatttggagaatagttttttatttttttactccaaataataaaaaaaaattggcaagttgcgacacaacgccaaaaacttcctggattggtcgtcccgttgagaagtgactgacactcaattccccccccccccccccgagggacggacggagagggcgggggggggggggggga

SEQ ID NO: 43010 - DNA, 1330 bp, Heterodera glycines
  misc_feature (1316)..(1317): n is a, c, g, or t
aaaaagatgatgtaaagtgccctgctgttttgtaataaataagtgcgagttattataaattagtgcgatttaaaattttttacaaaacataagattttccttcacattcatttaaaatttcattgaagaaaataacgataaaatattcacatttatataataaataatcagtggtttgataaaaggtgcttaaaaaatcacaactaataaacttaaaaaatgaaggtagatgacaagatgtaaattaaaaatatttttaattatttttatcaaaatttaatttaatttaaatagaatttcattttttccgagaaaatcaactaatttgcttataatgataaaaactattgtcgagatatttattaaaaaatttatactaacaaaagaaaggactaaaataaaaatatagcctgcaaaattaaaaaaaaatttcattaggcttcaaaaaagttatggccaaaaatgtttgaaaaccaggtccctgggtacttttggcgataactttgctcaaacttggtcaaattttttgaaatttaggtgagctaatagagaaatgttagggctatcgaatataccaaaattgttaaatttggtttacttagagaaaagttatggacaattggaaattttcatttgatgattttttatataacgccctttttgatggcttttatataacgacatagcaccccaaaaaaacagataaaggaaatgcaaaaagagaaaggaaagagaaacatagcaagggagagagaaaaagataaagggaagggaaacagagtaaggagaaagaaaaaaagataaaggaaggagaaggaaaacagagaaaaggaaagagaaaaaagagaagcagagtaaagagaaagaaaaagagataaaggaaggagaaggaaaacagagaaaaaaacagagaaaggaaagagaaaaaagtaaagggaagagaagcagaataaagagaaagagataaaggaaggggaaggaaaacagagaaaaggaaagagaaaaaagtaaagggaagaaaaagagcaaggggaagagaaacagagaaaaggaaagagaaacagagaaaggaaagagaaaaaagtaaagggaagaaaaagagcaaggggaagagaaacagagaaaaggaaagagaaaaaagtaaagggaagacatttttcttccgtagggtatgttagcggaccgccattagcggatcaatggaaatagcaatttaacttatcaattatttttcaaaaaaattaggggcataaaattttaaaaactatgtaaaacataaaatattcaattgtaaaaatttatttattccaaaaaannattaatcaacaaa

SEQ ID NO: 43011 - DNA, 1111 bp, Heterodera glycines
aaaaagagatagccatttttctgagaattaattcacaatttccgcaactcttgcggtatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattatttcacatttccgcaactcttgcggtaatggaaaaaattttgaagaggctctgcggaacggattag

SEQ ID NO: 43012 - DNA, 1551 bp, Heterodera glycines
  misc_feature (538)..(538): n is a, c, g, or t
  misc_feature (1455)..(1455): n is a, c, g, or t
  misc_feature (1517)..(1517): n is a, c, g, or t
cactcaattataaataatctgccaaatcttggtgattgtaaaacaggggccgaggttaacatttgttttagcttttctagcgcctcgttctgttcttttccccaattttcttcaattttaccctcaaatttatcctgagttaatgtttgaagtggccgagcaatgtgcgcaaaattttttataaagcgccgaaaataggtaagtgccccaagtaacgattttaattccgttagcgttttcggtggcctaaaattctgcactgcttttacttgttttgggtccattcgaactcctttttcgcttaataggaacccaagatatttgatttctgccattccccaaaaacatttctcgattttaagttttagtccgacatctctcagaagtttcagaaaattttcgatatcgaccaagtgcatttcttcagtttcgctcccaattataatatcatccaaatatattagcatggcagcggtcaatctcctacgtaatgaattcattactcgttgaaaagtgtcaggtgctgctgttaatccanatggcatggttataaattcgtatattcccaaatgtgaaatgaacgctgttttctcatatcttcctttgccattggaatctgcataaagccctgttgcatatccatgcatgtataaaactttttggctcccattaggtctagtaattcttgaatgtttggcagatggaaaacacgtttttttgtcattttattaagtgcccgatagtcaactgcaaatctccacgatttcttatcagcttttgggaccatgactatcggagatgaatactctgattcagattcccttatgatgttttggtccaacatcattttgatttgtctctcaatttctttttgtgtttcaggtgggtaacgataaggtctgaagtgaaatggtagggaccctggtacaaggtcaattcggtgaacaatagggccgttgtaaagtccaattttaccgtcatcaccgacgaatgcctcagaatatttatcaacgatattttttagcgaaatttgtcccgaattactcagtttcgtcccctcaagacatattcttttagacggagggcgattcaatcccggttttgggagagtaggaagtttggtactccatctcacctctggcggaatataatctttaggagagatttcatcacctggtaacgcatttatttgaattggttctaagtcagccaaatgtgaattcccataaattttaactggtgctttccccgcattcattagctgtaaaattacgtttttgctttctcccggtgcaaccaaagttcgacccactataattccagggtattggtgttgcactccttttaccaagaaattttgttcactcgggaaaacttcgtttacccgagccatgacaatattttcagtccagggttcaaaaatttcggtcttttccattgttattcgtaacgggntttgggatggttctgcacccacaactgataattaatgttggtccaaaacttcctcctaaccngaactttctttttctgcccacgaaatttatgcct

SEQ ID NO: 43013 - DNA, 722 bp, Heterodera glycines
  misc_feature (11)..(12): n is a, c, g, or t
gtccgcgaagnnggaaacaccggccaaagcgaattcaaagattgttgttgttgttttacatttgttcgtaggtagcagaaaaagagcaaatcaaccgcgaaaggtcatgccaattcgggattagagaggaatgaaagggaaagtgtcggacagcgaatggaaaacagccgaaattcataaacaatttatgctgtcttaattgattttaactgttcactctcattatctgttattaactttaggcgattccgaccgcgaccgtttttgggaccacgaattgttcggcccggtggtcgcttcagtggcggcaattgagcgcggaaaatgtgcggaactctgtgacgatttcacgacgcccgtcactgacggaaaacgctttaggagagcggaaaaagcgaaatcggagagaaaggtgaaaaaagtcaaatgaagatgcacttttgaactgtttatgttcagaaagggcccgccgtcatttacagttggcgttctcacaatccttcggccgttgaaacgcctttgggcgaatgccaatgcgatctcagtgctgcagcacgatccgagtcagcttcggatcgttcgccggcttcttgatctgaccaaattattgccgatttcgacccggcgaatatttattcaaaaaccgaaagccaagaaccgaatgaatataaaaaaaaacgatatcaattattatcccctgttatttgttatatactaattaa

SEQ ID NO: 43014 - DNA, 975 bp, Heterodera glycines
cattgcttaattgctcaccttcctgtttcgggattcggttcggatctgagcattaagtaaataaacattattaattgataaattcattataattaatagacaatagaatttatcaaatgaacgggatggggcttcacgatcaatttaggaaaagaaatcatcgttttagtttgcattaaaatttatcattttaaaatagtcatcgggctcagccttttttcgaatggcttaaaataaaattataaaaattatttttatttttgggtttacctttgctctttccttttttgccggggtcgttcatacagtcgcagaaaatctccatgattgagaggagcagcacacacttcagtagaatggccatgtctggtgttgattcctttgcttcaaatgttgattgaattatgatattcttgcctttcctttctgattaaataagggaactttgccacgttgccaaacgtggcattttgcctaattctttcggctgtgtgcgtcttccttttgtgttatttcatttttttctatacccctttcatttatttctgtttccattatatgcaaaatgctattactttttttctctgccatataaatttcatagaatacaataaaaactataatttttttttgtcttcaccccacattatgcctattttcattgttggcttttagcaattgccggccttctccccccccccacaatgccattgcctgccttctcccttctcccatgtttataatgacagcagagggacgacgaaaatatgacaaaacgtcatacaatattaacgcatgtattgatttacgaattttttaatattttacatgtaattaaataataaaataaattgtaaagtatagaaaaaaagttttacgacttttccctgaaatggcccaaatttggcgtaacaaaaacctaggttcaaactttgaagacttttatcttttttctgcgctagatacaattttgaa

SEQ ID NO: 43015 - DNA, 1053 bp, Heterodera glycines
  misc_feature (872)..(872): n is a, c, g, or t
  misc_feature (999)..(999): n is a, c, g, or t
  misc_feature (1048)..(1049): n is a, c, g, or t
tgccgtccgccctctacccatccaaagttctccttcttgtcatcatcggcactttaaaacccaaccgtgccactagtaccagcagcactcatctttcccagcggagaaatgtgccaacttagtccgggacggttcacttttggctggcctttttcttaaaaaaagcacgcaaaaattttgtaaaatttgaagccaaccaattaaaatttttttatttctttaaaaattaattgttgttaattttcaatgaacttcttccattcaactttcctataaactcaaattttcgattccccctcagccgcccatcggtcggtcccttttgtacaatttgtttccccgaggggatgcaaaaatttcattttttcgttcaaatgcttgtggcttttcttggcctcattgtttttacgaatttagctaaaaaaatgattggtcccccgagggcacaaatactaaatggtgaacaaacatgccatggaatcctgttgaaactttcaagtttttctcgtcttcattatgccaacaatattaggtcagggtagaaaattttattagataacagggatgtaagccgatgtcttcaaatttttttccacaacaaattttgtctcataaaaatctgtttcgttttgcatttgcttttttactccccgtcattttcacccccatccatcacccccgcccaaaaatgaagtcattcccgcctccccggagggagcttttgaaattttattccaggggaaggggtggcgcaaaaagcatacaactgcggattcatcacggcccatttgtctctgtgccgctttttggttggtttttgttagccatccttcgcagtcagcgtttttgcaatttgtcctctgctcctccgntcccccccccgcccccaacgcacactaaaatgaacacacaaaaaaaaatgtcccaaatgagtgccgcgcatcgcccgtttggtgaatgatgtcgtgtcgcggcacttccgctgctaatttgcccganaaaaagttggcatcacggacactactcatcccatccatcactcatctannagtg

SEQ ID NO: 43016 - DNA, 1000 bp, Heterodera glycines
  misc_feature (870)..(870): n is a, c, g, or t
  misc_feature (960)..(960): n is a, c, g, or t
aaacaatgacagtggctgtcatcagttgttatgctctatttatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattntccggccgtttgagtatatgtgagggtatggacggtccaaaaaatggctatctctttttttggcaatctggtaatagaaatctctttggnaaacatgacagtggctgtcatcagttggtatgctctaaaa

SEQ ID NO: 43017 - DNA, 991 bp, Heterodera glycines
  misc_feature (24)..(24): n is a, c, g, or t
atggccaattccacgcgcgcggcnccacccaacgccaaagttttggaggcaaaggccgcctgaacagtgctcacgtgttcgctgttgaacttaaatttaagaaaaagccgacaggaaagagtccatcttcggactaagaatcaaatgaccatcacattcatttctacaaacaatcggagaaaattgagttgttgagttactttgtcttcggtgtaacggaccatcagcgatgttttgccgacggcgccttcgcccaacaaaacgactttaaatgctctgattgtctcttccattccattcggttgggatcagcaggaagttctcagtctttgttgttactttcaattcgtgataaatttgaaaaaataaaataaacgaacggaactaaaaagggcaaaaaaatgaaataaataaaaaaaagatatttaacattttggaaagtgttcataagtagagaccggcgcgggattttgcggggtcccagtccgcaatcccgcattttttggaaaatgcgagattaatcccgcgggatcccgtcccgcaaagaattttgaattccaatcccgcaacgggatccgcaaatttgactttttgtgcgggattctgcgggattttcattgatttttttttgaaacttttaaagaacagaatgccaaaattttgaatgaatttattagagaccggtaaaaaaaaatttccgggagcgggatcgggagttcaaaattttacgggacgggagtcccgaacgggaatcccgttaaaatcccgctcccgttaaaatcccgtccatttttaacgggagtcccatttttaacgggagtcccgggcgggagcgagagtaattcgaaaatttaattaaaaacacaaaaatatttttaatacacaaatttgaaggacaatccttttattcgattcagaaaaattataatatgcaaaaagttgaaataaaaaaacagattttagggtcgaaaatcagaaaaattttttcaaa

SEQ ID NO: 43018 - DNA, 1803 bp, Heterodera glycines
  misc_feature (27)..(27): n is a, c, g, or t
gtagtaattaatgaatgataaatacantttttcccaccctttggattattcaatttcaatttcgaaagaaatagtttccgattaaaaattcccccgcccttttattacgttttattgcgtttgggtccctcttctgctgttgtcctccttttccgtgccattgtcgtgtctccaaatgggccactttggcctcgtaaatgcgtcgattgcccgcattcactggcccccaatgcaattgcggtggcgcaaccgttcgcgcagttcgtccagccgaagcatggcgaattggtgccgaagtgcgtccagcaaagcctcgtcagagtggcgttgcacagcatcaccctcatcatcatcaccatcgcttggctcaccatctctacaaactcggaaaattcttaaattattggagccgcgtttccgtaagcaaaagggtctcccctacagttgccataaaacaaaagtgccaatttttccactttctttaaaattccccctcccctccaccatttccgctctttgatcgtcttcatccttctcgtcaccgttgttgttgttgctgtcctcctctcgtgctgttcgccatgtctccagcctggccacgttcagttcgtcgtccgtcgttgtggtccccgtggtgttgtcatccgtcagaaatgcctcccttaacagacttgacgtggtttcggtcggagtaggacaaaacgtcgtcggacgaatttttggaccataacttttttctttctcaaccaaattaaacattcttgatattattcgaaagcatttaaaaaacgctattaaactgcaaatttccccgatttcgatcgtttaaaatgccaggaaccccattttcccctcattttttcgagttttgaaccgttttaaatgcttttccgcgcccaattttccgcttttctatcgttcccagcacctaagaaaacctataaaagtgtggcaatcatgcttttgggtaatgtattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgtgtcaaacaccgtattagtgctttgctgtgccgagaaccggcaggcaatggctttaaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaacaacttttgggtatggaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattggtgctttgctgtgccgagaaccggtatgcaatggatggctctcaatctgcaagaaattagattggcaatatgtggttgtaaaaaacttttgggtaatgaattattttttgaagtgagtcaaacaccgtattagtgctttgct

SEQ ID NO: 43019 - DNA, 1513 bp, Heterodera glycines
  misc_feature (1327)..(1327): n is a, c, g, or t
ggaccaaggccaagaagttctgccgcaatgagttcaacttgaccggactgtgcaatcgtgcttcatgtccgctggccaacagccaatacgcaacagtccgagaagagaacggtgggccatcaaaagcgaattgacgaaatgagagaaagtgatttgttggttgattaaggcgtgtgtttcctttttatgaaagtggccgaacggagtcatttcccgggcaaactttgggagaaggtgaagctgcacagaaatttggccaaggccgttgaacagatcagcacgcatttgctgcattggagtgaatacgtccgcaaaaagtgcaaagcgcggcttatgcgccaccaccaatgtctgaacagaatgcggaagatggagctgaggggacgcactgcgaaagtcatcccattgcaggtgacaaaataaaaggaaagggaagcgaaaaacggcggaaaaattggaaattcagaggaaaatcgaacggagggaacgccgcagggaggaaaaagcattggccgcggcaaaattggacaatgccatcgaaagggaactgctgcagaggctgaagaagggcacctacgggagcatgtacaaattcagtgacaagacaattgacaaagcgatggaaagggtggacgagtcggagcaaagtgaggaggaagaagtggaatatgagacggagacaacgcgggagaagcagcgacagttcgtggaagactttgacgagtcggaggagggggaagacatcgaagactattagagagcgaaaagagaaaaaaaagaagagacactttttgttgttattttgcgataaagaattactttctcacagcaaaacgaacgccaaagttttagagaaccaatgacagacaatataaaaaagttgtacaaaaaaatttagaaaattgagataacaaaaaatatggtgtatttttaaaatcggtttgttttttggtcaagttaactaaaatggtccagcagagattgactaatgaattaaccattcattttgaacggaaatatcctattggtgattcaaagcaaaaatgcggttgaaaatagaattttatcaaatctaaatcacaaaatcatttggcttttgttgcgtgcatttttgtccgttttgcccccatccaccgcccccaggcgtttccaattccaaaatatcctaaatattcaattcgatcagtggatattccacccctaattcgcttgccccggcttccactttcggcgctgtttttggctcccaaattcacccgcgtcccgtccttccggcaaagtgtgttctttccccgcttcgccgcttctcccccattcagtccatagnggggggaagacgcgtctttcagtgagcagcgacagatggaggactctacggaattggaggtgtcgcgaaatgccatcgccgccacggaatcgtccgtcgccgcccgacccggcacgaaggggtaatcggcgcacaatgaccgggtaacggcgttcccagacttccacatcggtgatccgcgtgttg

SEQ ID NO: 43020 - DNA, 1048 bp, Heterodera glycines
tttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttaataattttcctgcaccgaaggtactcactcggcctcttcgcggcctcgtggtgggccttcgccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaa

SEQ ID NO: 43021 - DNA, 1047 bp, Heterodera glycines
tagataatatttaaaataggttatttctcttccctttagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaacttt

SEQ ID NO: 43022 - DNA, 1152 bp, Heterodera glycines
  misc_feature (879)..(879): n is a, c, g, or t
  misc_feature (1105)..(1105): n is a, c, g, or t
aaaattttcaaaaaatgcaatgcaggatcctgccggatcctgcataaaaatcaaatttgcggatcctgttgcaggattggaattcaaaattatttgcaggacaggaaccggcaggattaatcctgcaaatcctgtattttccaaaatatgcaggattgcggactgggatcctgcaaaatcatgcgcaggatcctgtcctgcgccggtctctaactaaaactcctagaccaataatgttaacttgagccgaaagatgcaattactagaaagaccgaaattaattgttaatttattttaatccaagtttctaagaaatttttattttttacaattggtatcggtaccattttaatccattaagtatattttttaattattttatttgcagtaataattgttgcttaaaatttggaaaaattataaaaagaaaaaattattaacataatgtttttaaagttcctatgtttcagtttcattatttttcaaaatcaatattattttgtttttaatttaaaccaaaggctttatgattttgttacataagaaatttcattttcttctttcttatgatggtaataagattaattttgttatctttagcctaaaattataatttatatttttttaaattaaagatcactattaaaaaaatgtacaaagtaattctgtttttttgaaaaaatcgtttttcaaaattttataaattttctattaactatttggaatttatttccttcttacatttttattaattaatgtatttcaaaaaaatttcgttgtagctttaaatttacttagaaattgagaataaaacaaattttattttagcaacatactactttaatttaaaacaataccaaataaattttattttatttnttttgttgtaaattaaaaacgaaaattttcgaagtggaccgtttttttggcataatttctttttttagagaaaattttacttttattttagagttatattatttgttaattaaatatttatttatttgaaactttaaatatttaagtcttttatttaatttattgatagtgattaaatttcatatatattaaaaggtttcaagtataaagcatttgcagtaactanataattttatcatttacattcttgcaaatgtgaaaacaaatttgggt

SEQ ID NO: 43023 - DNA, 779 bp, Heterodera glycines
  misc_feature (16)..(16): n is a, c, g, or t
  misc_feature (52)..(52): n is a, c, g, or t
  misc_feature (54)..(54): n is a, c, g, or t
  misc_feature (84)..(84): n is a, c, g, or t
  misc_feature (135)..(135): n is a, c, g, or t
  misc_feature (148)..(148): n is a, c, g, or t
  misc_feature (188)..(188): n is a, c, g, or t
aattttaaaaaatcgnaattattcaaaattaattttttgtcgcctgtctggngnaagcagttaaaagaagggactgaaacttcncaaattacctgtcacaggagtcgaatctgaattaaatgaaagtttttcatntaaatagaatttnaaaaaaacaggtacagtattttatgtaatgattatcaatntaaggtgcgatattcgaatcaatgcaaaacaaatttaaaaaaaaagcataaaatatttaatgtttttaaaatattattttttctttcttttgtttaaatttgcttatttgttagttacaatattgtaaaatattatacagaaatgaaacaaaagaaaactttaagaaagttggtggaattcattaaattttgaaattttgtgtgggtctctgcttttgaaagtgccattttaatagggatataatataaatgccataattacctgggccagcagaagtcgattgatcaatttctgaataaaacaaagtggttttttttaattgtggtccaaatgctaaaagaagcaactaagatttttgaagaaaataactaaaaggctggcttaactatagtttatgcgcccactcaatttttatgcacccaatcaaatttttcatccgggggccatgtttcggccagctctattgcggtgacctgcgctttaactcaacatgtgggatggcacggcttaatcattgacaaaatcggatattgaagatcgaacggttggcatttttacggaatttaccctaaaacagcaaaaactacgac

SEQ ID NO: 43024 - DNA, 1119 bp, Heterodera glycines
gcttgctaatagctttcttttcgaaaagagaggcgaggaaaaataaaggttgcatccaaatgtaattttgttttacattgaagcatttggatggcttgctgtttacagttggcttagtcttctttgcaagaagcagcacaacttttgtttgggccaacgacccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcaacacaacttttgtttgggccaacgaccccaaaccattcgaatagaaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattctgcatgaatccttcgcttaaattcccatttatcttataaagtcagattaaattaattactccgatttgttttagaattggtccaaatacgcttgctaatagcttttcttttcgaaaagagaggcgaggaaaaaataaggttgcatccaaatgtaattttttt

SEQ ID NO: 43025 - DNA, 1462 bp, Heterodera glycines
aaaattgtaaaaataactgatttgaagcacttttgcaaaatgtcctgattttcgaccccagaatctgattttttggacccgatgttctgattttgaaaatttttcgatccgagccctggttttgacggttttttaccatccatgggtaatatgtaggatgtaagagctggaattactatgtgctaaaaatctgaaatatgtaataaaaaatatgctaaaatatgtgctaaaaatcaaaaaaaggcttaaaaatttatttaatgaaatagaaattaaccatgtattttattccacaataaaaacatacaatcaagtataaaaatcgatctgttacgaatgttttaatgtgtattttttggctaattaaataatgaataacaagattgccgctaataaattgctagcaagttggaaaataagtattctataattaatagtaggtacaagcgcttggcttcgagaaccggaggggtggaggaaggggataaattcaacaactcgatttttacgggtgtttttatttttcaaaatcaaaaactaggaaggatattttgcaggaaattgagccgttttggccaaaaatgactattttctataatctggtaaaataggtgtccggctgtgcctttatgcgtcggtgaaatattttggaaattttagtgtgctttgataagagaattatttattttcaaaaaatttgtctttttctaaaatttttactttttgggttttggggagagcctttagcccctcagcccgccgccccgatcaaggtcaaaatagttgtgggatatataagtttccctattgcataaaaaccgtcgtgcacataaaaagcaataacgcattattgcttaatatgcacgacattttttatgtaataggtaaactcctctatcccacacctatttagagccctgataaatttgccaaccccatctattccccaacttgctccgtggctgttttggataagccaaaaatctttgtccccttctgtgccaaaccccaagatagttaatgtgtgcattgttttgtcttgtttttttccgcctcttcgcattccttgatgcttgggatgtaaacaaaagtaccattgtactcgtgaaagctgggcggagcaaaaattcctaaaacataggtaattagaaaaaaaatttgtttacaatattatatttcgacatacgtgttacgagtggcaacctttttgctgtcaagaaatccatggcagctttgtacccttgcagggtcccatgctctgacgccttgtacaaaagcccatttttctttgtttgagtgagtgccttctcactcgccactccacacgattgtggttttccagtaattccacttttatattcataaaaagaatatagtggaagtccatcactggtaatgagcctgaaaacatttgtccaaatgaaattgcattataaaataaaaaattttctaatacaaagtc

SEQ ID NO: 43026 - DNA, 850 bp, Heterodera glycines
ttgagtcccggtgattgaaatgctggtgtgttgagtcacagtgattgaaatgcaagagaattgagtcccagtgattgacatgctggagggttgagtcccagtgattggaatgccgaagaaccaggtgatgttaggtcccagtgattggaatgcaagagagattaagtcccagtgattgaaatgctggagggttgagtcccagtgattgaaatgcaagagaattgagtcccagtgattgaaatgctggagggttgagtcccagtgattgaaatgcaggagaatgagtcccggtgattggaatgcataaaaactgagtccgggtgattgaaacgcaggagaatagagtcccagtgattgaagtcctggagaattgagtcccggtgattgaaatgctggtgtgttgagtcccagtgactggaatgctggagagttgagtcccagtgattgaaatgctggagggttgagtcccagtgattgaaatgctggagggttgagtcccagtgattgaaacgcaggagaataaagtcccagtgattgaactcctggagaattgagtcccggtgattgaaatgctggtgagttgagtccgactgattggaaaaagcaaaaaaattgatgccaggcagtgaagtgctggagccagtcgattttaccagtcataatcatacacgacaatcgtactacccagcggggaatgccgaaggaccaggtgaggttaggtcccagtgattggaatgcaagagaattgagtcccagtgattgaaatgctggagggttgagtcccagtgattgaaatgcaagagaattgaatcgcagtgattgaaatgctggagggttgagtccccagtga

SEQ ID NO: 43027 - DNA, 751 bp, Heterodera glycines
cccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaattggtgcgtttcagagcattttctgtaaaaatatttatgaattaattttgtaaaaaaataaataaataatgaaagactcagattttcgaaaatttttttgagccagctagctcggcgctcatttcagtgtaagttagtcctttaccgggtgagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggagggtctaggagacgtctcggctattctgtacgagttttgaacatgactcaaaactcattagcattcattagcctctgatcagtgatcaaatgaatgatttccgtccgtctattcgccctctctccc

SEQ ID NO: 43028 - DNA, 1062 bp, Heterodera glycines
  misc_feature (1003)..(1003): n is a, c, g, or t
tttttaggaaattttctatctcgtaaccccgatgccattcgttcctgagagcctcttcaaaattttttccattaccgtaagaaaaaactgcggaaattgtgaattaattctcagaaaaatggctatctctttttaagacaattttctatctcgtaaccccgatgctaaatggttatctctttttaggacaattttctatctcgtaaccccgatgctaatccgttccggagagcctcttcaaaattttttccattaccctaagagctgcggaaattgtgaattaattctcagaaaaatggctatctctttttaagacaattttctatctcgtaaccccgatgctaaatggttatctctttttaggacaattttctatctcgtaaccccgatgctaatccgttccggagagcctcttcaaaattttttccattaccctaagagctgcggaaattgtgaattaattctcagaaaaatggctatctctttttaagacaattttctatctcgtaaccccgatgctaaatggttatctctttttaggacaattttctatctcgtaaccccgatgctaatccgttccggagagcctcttcaaaattttttccattaccctaagagctgctgaaattgtgaattaattctcagaaaaatggctatctctttttaggacaattttctatctcgtaaccccaatgctaatccgttcctgagagcctcttcaaaattttttccattaccgtaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttcctgagagcctcttcaaaattaattccattaccgtaagaaaaanctgcggaaattgtgaataaagatcagaaaaatggctatctctttttaagacaattttct

SEQ ID NO: 43029 - DNA, 905 bp, Heterodera glycines
tgcccatttacctcctcctcccattcctctcattatacttttaccaccaaattcaatcaattcgcatgttccttaccaaattatcatgcctccttttttttatctgtcatccaatgagaaaatgcaatatgtatgtgcacacaaaaacggaaaagcactgtttgctcattcatttccaggccatgagaatgaagaaaatgaaattaggtaaatttcccaccaccaaatgataaaatggttttcgaataatcaaactcaaacacgaaactcacttttattcccgaaatttacgcgtttgatgagaatgagtggaataatttgcgagttaattaatggattagtaattggtttttttgttgttgggaatgtcagccaattgacgacttgttgatggcaccctggagaagaagctcaatttgggacattgtcgtaatgcagttggtcgatttgttgttgttgattggatgacaatggcatttgcataataattcagagaaattagtgtcaaaattctattttaaattttagagaacattaaattagaaaataagcaatgcattcttttgtctgccatttgaaattttattggccattttgtcattgcatgcgccagttcagtccccaattcacatcctttgggttggggtcgttttcgcgtgggcagagtttttgaacaataacttttttcattttcattgtcaaccaaatccaacaagtagcctgcaaaattatcaaaaacttcgttttcgttctaaaattttatgtccaaaaatgtttataaaaccagtttttgaagttttctggccataactttttgaaccttaacgaaattttttgaaattttgcggattaatagaggactgttagggctatcgaatgatatcatgattattggtggttaaaaa

SEQ ID NO: 43030 - DNA, 914 bp, Heterodera glycines
cggggcagtccccttcctcccatgcgcccagatttatggggagaccgaatccttcgggaatagcttccctaaagcctgtactgtaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccagatttatggggagaccgaatccttcgggattagcttccctatagtctgtactttaattctgcgttggatttttgctccccatacttgtttgagtaccccaaacggacacttgaataaatcgatttttttatttcataaatattttttcagaaagtgctctaaagtgcaccaaattttatttacatgttagtttaggcactctgatgctttttctatcaaaaagggagatggagaaaaatttttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcgggattttttttcattaggtcgtccgttagcgttcgattgctctagtcaattttcaaatttttgttgaaatatttgtcgtgctctgaagggcggggg

SEQ ID NO: 43031 - DNA, 1013 bp, Heterodera glycines
cttcctttcagtatccctgcaaagtttggtgcgcttctttcagtttctgaaaaaaaagttaagcctaaactttttggcctgtttaaaaaggaattaaaaatttttaaaaattttattcatctttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcct

SEQ ID NO: 43032 - DNA, 1306 bp, Heterodera glycines
aaatattgagtgagttgtttattaattaaaataaaatgaaataaaaaaatatataattaattttatcaatacaattcgacacaaagacatatgaattcaattcgagtgggaaacacaccatgaaattaaaaaataacagtttatacacaaataataacaaaataaaaatcaaaaattgattaaattaaagcaaatattaattcattcattcacttagcttattaaatttgatcaattaagtgtaaaataatcaaaatattgttaaccaatgttaaaacatataacaatgagaacaattcaaatataatttgattaaatgccacatatatcgtaacaacagacggatactacagcagattgttttaaaaaaattgatgaagaaagaaaagttcctttgatataaaattatttaaagaaatttaaaaattaaaataggaactttacatatacactttgaaacttaatcatataatttagcaacgattaaattattgaattattgaaataaataaataaataaattttgtttatcttattaatctattattctaatcaatattttggtttgaagaataacaggtacactaactgcactaacagcggcacatgaagtcgcacacatgaattttttataattcatttaaaagacaattaaaaataaatttaaaaaataatttcactaataatgttcttaattgttatattttctttttgaataattgaaaatttaaaatattctttgctaatgtacactcttggattgggttgagagaggaagaaattataaaggatttcaaaatttaagaacataaaataaacacaatagaatattaccaaaaattatgaagtagattcagaacttttttgacggttacataagcatgcctcaaaaaaataatttttttttttcttcatttatttttatttgtaggaaatttaattaattaactcaatttctcttcttttctgtaatatttattgcatcaaaaatagaaaatattaaaaaataaaaaacttaaataaagaatgaggattgagagaagataattaatataatattattatttacataatttgcagaaataaattaattaataaaaatgtgaaaataatattataaacaatatggtgagatttgaaagaagaaaatatttaaagacgcaaaagaataaacttattttcatgtttaattaatatacaaaaaatcaaatcaggaaaaatattaaaatttcatttataagagttttttatataaaatgctgaaattaaaaaaaaaactgatattttatgaatataatttttaaaa

SEQ ID NO: 43033 - DNA, 939 bp, Heterodera glycines
aaaaaaagagatagtgatttttttggattaggccgaagaaataaaaattaccagctattgaaatgcagtggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaatattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgctaaaatgcacaccctttgacacgtaaaagagatagtgattttttctggattaggccggagaaataaaaattaccagctatttgaaatgcagtgggcaagcacagcgagtcgcttaaatgcacaccctttgacacgtaaaatattccaaaaaaaagagatagtgattttttctggattaggccggagaaataaaaattaccagctattgaaatgcagtgggcaagca

SEQ ID NO: 43034 - DNA, 968 bp, Heterodera glycines
tccctgataagtcattcattcaactaataatttaaagaagttttaacgtaaaaaataaacgtaagcattctaaaagaaatgcttcatcttcatctcattccatctcaatcatttggatgtgatgcgatgaaaatgaaaaggaaaattttttagcaaaaaaaaattcaaataaaagtttcgaagcgaaattttgaattactgtaaatctacatactttttttttgttaaaaatgtcaaacccctaaaatgtagaaagatctgtgctgttttgtccatgcgcaattgtctagataagatttacaatgagattggagtgattttccgagatttttctggagccttgccacttaacaattaagtggtcacgtttgaaaattgaaaaagaagtcaattccattattcgtgttcaagtccggcgttttgaattcgcaaaaaatattattttcatgttcaacgactcaaaaaaaaacaactaaattttccttccttttaaattcaacgagtaaaaataatcgtgattccccaagtgtaagcatcgtgactccctcccccgcccccatctgtgtatgtaatgaagtggtggtgccttatcatttaattagcattcttttgatcactttgccactcctattcccttattgactccaaattataccacgaaatatgttgtcttgtcattaggattttgttttcaaaattttgaactcatttttcaggaatttgctgtctatttctcttttttcgctatggatccgacaaatcagcccggctggaattgctactactacaagtatgtgcacgagagagagagagaggacgtccaatatcatagtttgacgtccaaaatcatagtttgctattggaaatttgagaggaaaaggggcggggatggaaatggcacggattctggaccgatgtgtgcctgaaattatatggcaacagatgcctaaactaaacgacctcccccc

SEQ ID NO: 43035 - DNA, 1052 bp, Heterodera glycines
  misc_feature (40)..(40): n is a, c, g, or t
ttaaattggtcatgtgagatgtttagttttttatttgacncatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttaccaaacaaaaaggcaatagttaagctttgagatataaaaaaatcgtctagaataattatctcaacaatttgtcgggaaagctgaataaatttcagttgcaataggcatattggcacaatacataaatgtagagcaggcacaaaatagaggaaataccaaagattaaaaaattcgtgtttatgccccactctgctttggctggacataactcgccagagagtggagatagaccctttgttgatacatttgaaaatgtagagcccgcctagcgcattcgaataacacaaaatttgttttcatttgcccccaaacaatccgcttatgacgcgccgaaagaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaactattcgagaaaagctgaaaaattttccacttgcatcagaagca

SEQ ID NO: 43036 - DNA, 1139 bp, Heterodera glycines
tcgccattctgacgaagaagatttattttatttttataggatttttatttaaagtagtatactgtatccctaaattggtgcccttggtactgtagccttatagagggattgaaacgggtgaattcatcatttaatttttttcattaccctaaacccattttgtcccctatgaatgccggtgtcatacaactcgtacaaaaggcaactcgtacaatggcttaagcttaggcctaagctttaggctaggccaaggcttacgcttgcttgggcctaggctaagcttaggctttttttttttgtaaaatacgagttgcctttgtaagagttgccattaacccgtttttgtttgtcaataccctaaccccactcttgtccctatgaatcagggctggccgtgattaaatttctaatcacggaaatccgtgagctgtgatcgcggggcttctaaaaaatccgtgacccgtgaaccgtgatcacggcaccccaaaaccccgtgatccgtgattgtatttaaatttaacaaaaaacggaatttaatcgctggaaaaataaatcaaagttttttaaagaaaccaaaccatataggtaacgcttttttttgcggcgtgcttttttcaaaaacttttcgagtacagggggcagaacaggtggtgccgataggcgccgccgggaaaaattttgtacttttaattcgatttgttagcagattttttccaaaaaaaatgaccaaatttactgttttgagccaattttttgaggaaaataaaggactatattttgaacttattgaccaaatctttttttttgattaaatctcttttttttgcggctcgccatttacaaaaacttttgtggtacggatagggtcaggcggtgtgccgataggtgccgccaggaaaaaattgaaatttttagtggaatgtgttaacagattttgtccaaaaaatgtccaatcatttgttaattttgggtttaatgttgttttttaaaaataatgaaaaaaaatttaatgtaagaaaattttctttttaattaaatttcaattaaaattataaaacaaaatataaaaattctcctatcccaatgggaaattgaacccaagggtcaaacaatgaaagacgcaaggcttaatcactagg

SEQ ID NO: 43037 - DNA, 1036 bp, Heterodera glycines
gcgagcgctcagatggcccctggtgtcccttcccctcccccaagggcacgacagctgactcccttccctttgcctcccttccccttctccaataggatttggctttgggttttatttatttttaaatttaatttttttttatttaattttttcaccttctcagatattttttcacctgcccaggggcttacataattattataggtgttttttaaattaacctaaatcttaggaaactggtactgaaatgtccctttccactgggactgaaatggtgggactgaaaaacaaccccgaaaatcttggtgagaactactaataggaaaaaccaaaagacttaaaaaagtaaaattaaaaccaaaataaatatttaattaaaaaataattaactccaagtttcaaccttcgagaaaataaaaatacttcctagtatcctggtcccaagcctattattttgtttttaaaaggaaaaattaaaaatacaatcttattaaaagaataaaatttaaaataaatcacatatttaatagaaataaaaaacaaattatcttaaatgttaaaaaaacataaaacaatatttcaaatattagcagactaaaaaattagtcgtagatattaaaaaatttataaattaaatcgaaaaattatttaaaataatgcaaaaaaaaaataatttgttaataaaactttacatcagttggtttaaatttgtaaaaagtgtcttcataaacaattacgacctactttgccttcttggttttttgaatcagcataaggatggattcaattaaaaaaaataatgtttattgtagagttaaattaaattactaattttttacaaaaattttaaattaatttatgtatcagttgaaaaaattttaacataatactaagaaatattgctttattttaatatttttaatttatttttttatttatcaaaaaacaataaagttttaattgcattctgtccattgaaacggggcggagtcgttatttaaaaaaccatcattttgattttatgataaattattta

SEQ ID NO: 43038 - DNA, 1615 bp, Heterodera glycines
  misc_feature (66)..(66): n is a, c, g, or t
taaaaatgcacagggaaaaaatgctaaaatgccacgaaaaaaagtaattaattaaaatatttcttnttacttaaaatccccatatgaatctcttggttaaatttttttaatattttcttaattttaaaatatttatatatttatttaaaggcaaagttgaaaaatttaaattttttatttggtaaattgaattctttttaaaaaaattgttggcttttcaaaataatgatttatttttttatttaaagacaacattgaaaaattaaaattttttgctaaaattatgcgttattcaaatgagtttatttaaatatggtttcttttcaaattttatttatttgttacagtgttatcaatgccaatgtcgcaaccactcaaactattcagctgaaattcagcggtgccaaagacccgattgccacgttcagtggagtcgataacagcgacccgcaaaattaccatatgatcatcaaaacgtgtgttttgaagggcaatgtgtgccagaaagggtcagagaattaattacattaaataatttatttatttttaacacatttatttattattaataaatgaaatgatgttaaaatatttttaaatcatttttttataaaaaataaaaaaatatttaatgaattatatttaatggatttatttattaaaggaggtgtcaattaaataagcataaaatttattagtcaattaaataagcataaaatttattagtcaattaaataagcataaaatttattagtcaattaaataagcataaaatttattagtcaattaaataagcataaaatttattagtcaattaaataagcataaaatttattcgtcaattaaataagcataaaatgtataattatatgaatgcatttattgtttttataatattacggcataattaatatattttttaataattaaattatataaaaaatcgaaattatactaatttattaaaaagcaacaatattttaatgaaaggcaaaaattaaaaataaataaatatttatatgaaaaccattacaaaattcaaaattttttgttagggtgaccttctgttttgtcggcaaaatggacccaagcgtggcgacaaagggtggccgtttcagtcttgaaaattacaagcaaaacaattcaattgcgacgagttgtgagcaacagctgcaacaatcgggtggaagcgaaacattggccatagggaaggtgctgcacggcttcaacatcgcatttgctgaggacaagctgttgttgacgtcatcgaccagccagaaaaggtatacggtaaagtcgactgtaattgacggtatttttagcaggcccgtccgtatacaaaaaaatttgagaaggcaccctgagctttttttttttaccttcgggtcaaaatttttttctccaatgttatttttaaaattttactgcaccagggccaaaaagtagaaatttgtagcggttttgcgccaaaaaatgactattttttggtgcgaaatctctcaatttttcgagttttgaactgtttcaaaaaccggttttttggcatttccgcaactcgcgacatattttcccatgcttagctccttgagacgaatcgatcggtatatcatttgac

SEQ ID NO: 43039 - DNA, 966 bp, Heterodera glycines
aaaattttggaaaaacgcctatctctttttctgctcaatattctatacaattccaaccccatttacggaataatagcgccaaccctaatttttccggaacggaatttctttctgggcgagtttgattgtgaaaattttggaaaaacgcctatctctttttctgctcaacactctagacaattccaaccccatttacggaataatagcgccaaccctaatttttccggaacggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaacggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaattccaataccataggattacctataagttgtatgattttgcatattttttctgcgcattgaagaaaggggctcaaaaatagcatttctgcattaaaattttttgatgccaaccccatttacggaaaaaaaacttggcaactctagttttactgctgttttctataaaaatgagaagtacagaaaagcatctctacatttgtttcccacttctacacattttttgcttttatgaattatctttaaggtatttatttcttactatttttcct

SEQ ID NO: 43040 - DNA, 1452 bp, Heterodera glycines
  misc_feature (522)..(522): n is a, c, g, or t
ttttcgtgataataatagctgatttttacagaatagcagattaacaaaaatgaatgatctgtggtctgataattagctgtttttttacagaaaattaccgaaatgagtgatctgatcgcgtgcagcgcaacaacaaaaatcaactggtggtaggaggggataattataataataatagcccagcagttggaaagaaggtgataaactgatggatatcattatatccccgacgcggcaggcggaacaatgtgacgccaatgtgtaagtaacagtacccaaaaactaaaaacaggaaatcgcgtcgatattcatcattgatcagttggttgtccacccattagaaggacgggctgtcgattgggtcagactgactgatcagagtgatcgctgactggtctgatcacagagtgatcgcgccactgttcgtgttcaaaaacctgccgtcgccagttgttcagccccagcagaactcatttaacggaaagagacaaattaatgatttatctttttttggacatttgngtgttctattagccaatttgagtgtttatatcatttgcgcaaaaaattgtgtgttttctgtccaaatgatcacaaatgtcagtccaaatggtaccaaattttggggtttctgtccaaatggaaaaaattttgtatttctgtcccaaattgtgtgtaaaaaactaatacaaaatcctctcataaattgcaaaaaatcagctaaaaatttcaaaacttttctcataggttttggtgtccaattgtcaaatgttagctaactgaccatttggttactacccccaaaattatccacgtccaattaagctttatcccttaattttttgtgccattttttaatggcatggaaaatcaaattgcttaaacattgtgatgaatgaatacgcgtgtgttatgcatgcaaaaatgcttcttgctgcgcaatttgaacagctaatatcagttccccgaaaaaagccccaaattgatcggaaaatcgcagtcgtcgcccccggcggtgcttttgccccacccaaatcgcttctctatgctttgttgtgcactataattgctgctgctccagcagcagaagcgccaagaaaacttgcttattcaaaaaagcatcagataagcagcagcagaaaaaaaaagccatcagtcagaaaaaatttgggtaaggggggggggcgactcataaattaattaattagtttggaatcgtaaaattgttttgtgactagcgccactgccgccgctgttgttgatcaaacagcgaacagtagtgaatgtggtgagagataggagcagataaatgataggatgacatagtcgaaaaatgcacaggaaaatcttggtcatttatcaatatttgggtcgggaatggtgttgatctaagcatgaatcaagcccaaagtgatcaagtgaccaagcagagcgcatgatcattccgaaaaa

SEQ ID NO: 43041 - DNA, 966 bp, Heterodera glycines
aaaagggccatcgtttcgggcgggaggccagcaaaattcagctccgtctcaggagacaaaccgacggccggaggcgaaaatgtgcaatgacccggccatggttcgggtaaaatattagcgaatgtcccgaaatgacaactaattattgtggtagaaaatgttggaagaagcgaagacaatggtcgaccaactcgtcgaagtcggctcggtccacgccgcttactacggatgttcggcggagtaccaattccaaatgggcgaccacgaccgttactatgaagaggttggagttttgttcatttttaattgaaaatgcttcaaaaacccattaggcccttcattatctcggctgtgaagacattaacgtgaaattgagcgcggaacagaagcgacaacaagccgagaaaataagcatttcggcactccttggcgaaaacgtgtacaactttggcgagctggtcagttgttcataaactaattcgttttgccattccctctgcttcacttataaaattcgggtaaaaccgaatttttcgattgaaataatttttaatggacgaaaaagatttaaaaccggaggagtagcaaaattatgcaaattaattacaattttatgctagctaattcctcagtgatttttcttttttgagttggcccatccaattttgaacgatttgtccgacacgccaaacgcatggcttaacgaacttttgcacgcggtgaacgccggcgattgggacggctttttgaaggtttgtcactgaaatagcaaaaacccggccgttttcttttaagcacgaagagaaattggtcgccgcttattcggaggcggggcgaaaaattgaggcgttggaacggaaattgcgcctccaatgtttgatcgaggtaagtgttgttttgggagataatatatgatggaaaaaccaggccaatatgggtttaaaacgcggaaagtattgttaattt

SEQ ID NO: 43042 - DNA, 985 bp, Heterodera glycines
ggaagtgcgatcgttttgcggcgttcagtcctgttcctttacctttccctcaaaaaggtttatgtttaattttacgttttaacagcttttctatccgcataaattttaaaattttctcttcagtgtaaataatgtctttaaccaaaaagaatggacggaataaaattgcagacaatggaaatggcaaaccaattgaagctggtccaagtggcaactgtgctagggagaatctaatccgattaaactcccttaatccttacatgtaatttttttgtttatacttttttcgaaaatcgttaattattaatttggattttaagaacgtgccctctgtgcaacggttatttggtcgaagcgaccacagttatcgactgcttgcatactttttgcaaatcctgtctgctcaaatattttgaaggtgggcagcatccaattaaaaactaattttcatcgttattgaagattttttgcctttcagataacaatgattgtccaaagtgccataaccaaatccaccagtcccatccgtctcattatgtggcatttgatcggacaatgcaggacattgtgtacaaattggtgccgggcatgcaggcggaggagcagcgacggagggaacaggtccacccgcacggatttttgttttaattagagtgatttgggttacaattttcctggtttatcatggtcctcctttttaaaaatgtctatccttattttttgcccaaataaatcttcaaattccatttgccgttttgcagtttaaaaagcgccaccaacaaatgaaggaggcgcgcgaaatgaatggccgagcagcggaaaaacataatcatcagaacatttcctcctcctcttcagccaccgccgtcgtaccgccgccaaatacaaacgatgaaaattcagcggagggcgctgaacagcgaaagaacgtaatttggcaaccgcggctcttaaaactgagaaaatggacgaaaacggcgacacc

SEQ ID NO: 43043 - DNA, 831 bp, Heterodera glycines
attaattctcagaaaaatggctatctctttttaggatccaccctgtatcttgtaaccccgatgctaatccgttccggagcagcctcttcaaaattttttccattaccctaagagctgcggaaatttttattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgttattaattctcagaaaaatgggtatctctttttaagacaaatttctatctcggaaccccgatgctaatccg

SEQ ID NO: 43044 - DNA, 1136 bp, Heterodera glycines
  misc_feature (1061)..(1061): n is a, c, g, or t
  misc_feature (1063)..(1063): n is a, c, g, or t
aatgcacaccctttgacacgtaaatattccaaaaaaagagatagtgatttttctggattaggccggagatataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggacaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattangncggagaaataaaaataccagctatttgaaatgcagtgggcaagcacagcgagtcgcttaatgcacacctttga

SEQ ID NO: 43045 - DNA, 1329 bp, Heterodera glycines
  misc_feature (1284)..(1284): n is a, c, g, or t
agcataagggggggggggaaattgagccaaaattacattttgtctaacaaaccgaaagaacaaattgatgtaacggtatctcatcgggtgccatttctgaaatacatgaaagttcagtaaaaattactgcaaattgagtccaaggtcgttcgttcgaattccgtttggtctatcgttttacgttaattcgtaaaattcgctcgcatcgtgcgcgtgtcgtctcgcccccttcacaattttcgattggatgtgaaatgtctcggcaacaaacatttttccacgattttcaatgaaaaattccttccttgcacgctcttttgcctcttgactgataaaaacccaatttaagtgagccaaaaaaagacttaagaccgaccacatgtagctttcgaacttcgcaaaagggagcatgcgaagacggagcaagtagtggggcgagactacgggctacggaagaagtccgcgcgtgatccgcaggcggttgactaattggctttatggaagataaaaatagaataatttgatcactctaaatattatgtattaatgaaaaaataatcctatggtctggcaataaatttggaaaaatgggccctagccaaaattgtctacaaaatcgcttttgaaaagattattaaaattttttggcggtcggtttttcattaaaaagttcgaaaacgccgaaaattgttttcggtttttttaaaaattcttttcaatccattaaatttgagttgtttaaaaaaaattaagtaaaaaggggtaaatttttaagaaattctgttaacatatgtggccaaaactccaattttttcccagacggagcctatagacacagccggaccttaactcgttaaaatttccttcgaaaattggccaaattcgcagaatttggacaaattagttaaaaattacactaaattttcataattttggggcggcttttacgcaattttagatcaattttgaaaatcaagtttatttttttgcaaaatctaccagaaaaaataatttaatgatgaaaaaaatcacattaaaaatcaaaaattctcaaaaatcaacattttttatccaacaattctttgattggttttttcgggtaaaatttgaatagaaaagtcggaaagaccgaaaaaaatgaccgctccgatctcaagttaacacaaatcgtctaaaaatatttcagttttcaaaatttaggcaattcgggaatcaaaaaatgaatgaaaaaaggcagaaatttaaaatgatatgggcaaaagaagtgaagcgcttggcttttanatgcaaaaattcggtaggaaaagctacttaatcactcgtaatttg

SEQ ID NO: 43046 - DNA, 578 bp, Heterodera glycines
tttagaatgaggaatatgccatttaaaaatttatcactgttgttataaatgtttaaaacctggacatagtattataaattgtacgaggaataaatatttttgtgataaatgtaatttatacaataactttgtctaaatcatgtcgaacattacgatcaaacttattttaataatattaatttaaataagttatcattaaatagagaaaaaattttaagccttcaatattcccttaaaaattacttttatttctctaaatttattttatttcctttgaatatttactcaagttatagttgtccaaaaatattaaaaattacacaactattttaacattttttgtgttgaagaaggaacatagttcgtaaaatataaaaaataacgaattatgtttcgattattttatcttttctaaataagcatttgtctacaataatacatataccgtattatggctattatggctctaaatgtaatgttcaaattgggctaaacaaaagaactcattctaaaaagccaaacccaatatattatttgttaaatttaagcaaaaataccgaaatgcatcccgcaaaacc

SEQ ID NO: 43047 - DNA, 906 bp, Heterodera glycines
  misc_feature (19)..(19): n is a, c, g, or t
cagtagtcaagtcgtatancaagtggattttgcgccccgccttttccaccatggcacacgagtgctacggctttggcaatgcgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcgtcggggggtcgccgggccaccgggtggcccgacttaacaccaaaatggacaccccttgcgggcgcactcccgttttaccgattaagttaggatcgatgaaagtagtggtatttcactggcgccttgcggctcccacttatgctacacctctcatga

SEQ ID NO: 43048 - DNA, 1127 bp, Heterodera glycines
cgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaat

SEQ ID NO: 43049 - DNA, 934 bp, Heterodera glycines
cgttggatttttgctccccataattgtttgagtaccccatacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggaaggccccccacgaggcccggaatgaggccgagtgagtaccttcggtgcaggaaaattattaaattttaaaaattttttaattgctttttaaatatgccaaaaaatgtaggcttaacttttttagtgaaaattcgatcactcatattttttgctatttgagcagaagcgcaccaaactttgcagggatactccccggtaaaaggactaacttacactgaaatgagcgccgagctagctggatcaaaaaaatttt

SEQ ID NO: 43050 - DNA, 1274 bp, Heterodera glycines
ggttatatcgttttgcttttggtggggtgcttgcaacagtggcatcatgcgcacccgtccgatctggcaagttaagccacgattactgactagccaaaaggttcggtgtccgtgatgaaacgaacctactctgcttacaccgcggcacccgtcacggtcccccgaaggaatggatttaattaaattctctccttcggggatttttttccattaggtcgtccgttagcgttcgattgctctagtcaatctttcaaaatttttgttgaaatatttgtcgtgctctgaagggcgtgggaggggggggggggggggcgaagcccccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttaacggggcagtccccccgaaccgatgcgcccagatttatg

SEQ ID NO: 43051 - DNA, 923 bp, Heterodera glycines
gctttgaaaaaaataattggcgtataaaattgtcattttcctatttcaacagataagtagcatgccattggatagcattttttatgggctttccaatgataccatatttgcatttgtgacataaacatttatttgatttattttaccatattcacaatttgatcaaaatataggtggtcaaaagtgttgtcccatttcattttttggcacaaatatcaatatttagcatgggaaaaaataatattattcctactccaataaaggaggcagttttgcaagcatgtttaaatggaaagcatgatgggacaacacttatgaccatgactgtagtaaagaaaagcgcatggtatttttttagtttcagagcacaacacacataaacttaaatttttgtttttagaaatttaattgattttttgatccacaaaaattttaatgaaaatttattataaaataaaattttgtaatatttattaattttctctttatagaaaaaattcaacaattttcacttacattgactgtgagcatcctgtctaattttgtacataaaattgggaccaaaattggcatcaattacgatgcctggttcggacagtaaaacacgcggaaacaaatccaattcagtaacatataaatgatggacggtcgcttaaaaaattatgtgaaaactcgatttttaaagtttcgtggttttataacgaatttttctcccattttttgtgtaaatgcttcccacgatgtcaaattctttccgattccaataatgtccccctgatcaaaagtggcaaagccggactgtccgccgaatttgtgcccgcgaattgtgccattggaataataaatatacgaagcattggccttttaatgtgacgagagaagaaattctccactgcactcgattctcttaaaattttgtgaac

SEQ ID NO: 43052 - DNA, 1476 bp, Heterodera glycines
ctcgtcaggagttgattttatcaaaaaatcgtctaacagtttttttgtagagaactttaagcccaatctaatgtgctttatctcatgtttttatcttaaatttaaaaaaagttataaaattaattgtgattttgaaactcaaaaccaaaggggggaccccatggttttgcatttcatgaaaaatttttttgctcctaaattagccaaaatgcatttttatggcctaatttatggtgctgaagacgaatatatactttatttttggtttcagactttttggaaggtggttacaaatttttgaaaaatcgtctaaatttgagccccggaaaatccagtcaaatttcgaaaattcataactctcttcgtttttgatcaaatttagtggaatgtagtttgaaaaatagcaaaaaattaggagaattttatgagattcatttggaatttctatcttccaaaataaaaaagttattccagaatttctggaaaaattcgatttttcagaaaaaaattaagaactcggttatgaaaaagtattttataaaaataatatactcaaaaaatccgcaattttttgctctattttataaattttattttagctttttatcacttttttgaaaaaagttatagaaataaaagtgattttggaatttgggaccacaggggtgtgaccatgatttttgagtggaaaatttttttcaccaaaaatcttccaaaaatatgattttaggggttatttgggccgctgatcacgaatatgtaatcagattttactttagacatggttaagacctcagaatcccagtgttattggggattctgaggggtgggagcgcccgtcctgaggccgcgaagcggccgaatatccccaaaaaaattaaaatacgggcgcgaagcccgtcctgaggccgcgaagcggccgaatgtccccaaaaaaattaaaaaacgggcgcgaagcgcccgtactgaggccgcgaagcggccaaatgtccccaaaaaattaaaaaacgggcgcgaagcgcccgtcctgaggccgcgaagcggccgaatgttcttaacaaaattaaaaacgggcgcgaagcgcccgtcctgaggccgcgaagcggcctaatgttccccacaaaattaaaaaacgggcgcgaagcgcccgtcctgaggccgcgaagcggccgaatatccccaaaaaaattaaaatacgggcgcgaagcccgtcctgaggccgcgaagcggccgaatgtccccaaaaaaattaaaaaacgggcgcgaagcgcccgtactgaggccgcgaagcggccaaatgtccccaaaaaataaaaaaacgggcgcgaagcgcccgtcctgaggccgcgaagcggccgaatgttcttaacaaaaatatgatcgggcgcgaagcgcccgtcctgaggccgcgaaacggcccaatgttccccacaaaagtagaaaacgggcgagaagcgctcttcctgaggtctcgaa

SEQ ID NO: 43053 - DNA, 930 bp, Heterodera glycines
tttttggactcacagcccgtggcattcgctttggccatgccttcccccccccccacccctccctcaaattcactgaccaaaacgtgcggaaaactcgcgccctcgcggcttccgtccccattccattgttcgaagtcgtccaagtggatatctccgttaagcgtccctttcgactgataatttgggtaaaaagtgtgtgccaaaatgtttgatccgtccgcgcccgccccgtcaaatttgtgcgcgtctccgtgctctccgaccgcccataaaatggtaatgtccgcttccgcctccgtcggcgcctcttcaaaaaacagcgaaagactctgaaaaagaaagacatttgtatgaaacttcttaaatttcaatattaactcacttccaatgcgttaattttcacctgtgaagaccaaagactgaatgctttgtgcacaatttttctgaaaatgaaatcgatcggtaattaaattctgtaataaattaatccctttcccgtggcaatcacaatcaattcaaacaaatccgatacatttagccaaatctttggttacggccctctctttaaaatacaacaatttctctctcaatcttcgatcacttttgcctttgatcacttctcttttgtctctttgtcctttgatcccccctcttttccccccttttccatgctcttctcttccacctgatttcttctctgctcatgtcgggcgtgtaattgtggatgaaccacttaagatgaagctcattgttccggactttgtcctcccatcgtgatatataaactgaaggaaatggtcaattcattcatttgaagagaattaattccgaagggccaatttttggacattaaacaaaagggggagcgaattgattatcaaaagacggtcaaatgggaaacggacgcaaaagttcgtcttgaaaaaaatg

SEQ ID NO: 43054 - DNA, 581 bp, Heterodera glycines
  misc_feature (16)..(16): n is a, c, g, or t
catgtactagtaatantttttgaaattaaaaacagaccacttcaaatcgtggagatggcagtcaaatttcaagcgtgcaatgtctttgacaatgttcgaggtcagataggccaggccaatttcaaccctaaaaaacagtcaaaatcaatttcatattttgaaaaaagagtatggaaatgaatgaactctcccaaaacaaacaaacctcaattggaatggagaggacggcgttgtcaagcagtggtcatagcccacaaaaacactttgcaaatggacatgcatatttgcctaacataaggaaattagttgttttttcgtttttaaattgtgtttttttttaaacttttttcaaaaaaattccatttgcccactcccccgccaagaaatcgaataaaatgcttaattgtaagaccatcagtacatcccccagcccatcaatacacacttcaacttttggcagcacatagcccggcactccttcatagtcgggcaccgtgaaaaagttggcaaattgggacacccaaaagaagcgagtgctggcaaatgggcgcaaatggatgagcaaattgcgcatcccaaag

SEQ ID NO: 43055 - DNA, 1059 bp, Heterodera glycines
tttaaaacaacaagcgttggcattttttcaggttaagtttgtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagtaagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagtaagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttagcattttttcaggttaagttagtcctttacaatggagaaaactcgcaaaattggagagattatatcgattttagtgcg

SEQ ID NO: 43056 - DNA, 869 bp, Heterodera glycines
  misc_feature (18)..(18): n is a, c, g, or t
atggtagtgccacacacntttgtgttccatgagcggtcttcaatcgcttgctatgatagtcatagtaggtgggcatgccctccaatgtgatggctttgggccggaaggttaaaaacacgtgtagggggtgacctatgcgcgtttttggctctccaaaaatggcccaaatcatcgctcaggagaggggtcatgcccgatttttttttgggtggccattttctttcattttcgatcaaatcttattgttttcagttttcataaaataaaataatcaaaatcaattttagaaaaaatgagtcagttttctgatgattcccaaccccccgtgcttgatggtccttattcccctgttggtgatggtggggccgaattgatggatgatgcgcctccgctggaagacgtcatgaaacgcctaccaatctccgttagtctttgcgaaaatgtcttaaaattttctattttaattttgcgaggtcttttcaggtcgagccatcggacaacaatgagcgcaaagtccaaaaggagccgtcgattacccatgaattggacgctgagttattcaacggcaacggatttgcatgtctctccgcagcacaggctgaagctggacggttcaaaggtgtggttataaacacaagatttttaataaaatttaaaatttttattgaattttttgatttatgttgtgtaaaattatttcttaaattaactattgtacattttgaacaaaatattttaaatgagccgtttagcgtttcgatttattggccagtttttgatgagcatttcgttcggcgcagttttcccagaggatatattgcgcaacctcttaccatgtgccttgcctatgcggttgaaggagctgagtc

SEQ ID NO: 43057 - DNA, 1529 bp, Heterodera glycines
  misc_feature (551)..(551): n is a, c, g, or t
  misc_feature (1421)..(1421): n is a, c, g, or t
caattgggtgaaaaaatggaacatattaaacaatattatcaactcaaagaacaaaatcaaagaatacaaaattgccgaaattttaaacattccaaaaaactcattacgcaaatacaaaagcaaaatttggcattcaacctaaagaaaaattgctataattaggataaacgatattatgacaagattatttagtggaaaaatcacaattaaaaaagaaaaaaaatgcgaaaatttcaaatttttttttgagaatttgtttttttttcaatattttaatttatataaaaaaagtttaaatttaaacattaaaatcattgatgaatttttaaaaataaatattattcaatgttatttgggtggtgcatagaattagcattttgttctgtgagtgtcaataaatttcagtaattggttaattttttaattgatgcatcgacctaataatttaatttttaatgcattttaatttaaattaattggttttaataaaatctaattttttaaatttaatatgcacaatccaataatataaactaattgaatttaattanaattaaattctaacccattttttctattttacctttcccatggcgagcccatccaatgaaagttggccttccccaacaataaatgccaatgtcgtcctcaccttggcacaaattttcggacaacggaatctgttctttgtcctcaaagcctggacagttccacagagagtcttaaatttcaaaaaataaataaaattaaatttggcattaaaattttttaattttcccactttggccttgtgtacatttgggcgccggcattacaaatgggtaagtgtcgttgttgcgccgaaaaaagcgccaaaatgcgccgtcatcatagcccatggtacggcacgcggtgcccgtgtcaatgctggtccaatttgtcatttgggtacagacggaacgccaacggtcccgaaagcgaatctaatcaaaaaaaaaatttcaaaaaatgtattatgcatttttcaaattaattttaaatgataaaaaggcgttacgaaattaaaaatttaatttttttttttttttttgttacttaattacaatttctaattttttggaacaaaaagatgaaaaaatcatttaagaatcattttagtggtaaacgaaaaaaatttttattagttttttttagactgtaacattcatagttaatttcgaaaaattccaaaattgatcaaatcttgatgacaatgaaaataattctgaaaaatacgctttttttatttttgagcaaaatcttcttttttttttgtaaaatttcagctcaattagacaattattttaaatggctttaaaatgtaaacctcgtattttttatttttaattcaaatgttttttttataaaaaaaacatttttaattgaaaacgaacttttattanatttcgtaaattattttttgaaaaaaaatattaaagaaatttgcctgcagacggcttggcctgacgggtgggaccgtcaattagccgtaattctggcaatttgctatc

SEQ ID NO: 43058 - DNA, 1261 bp, Heterodera glycines
  misc_feature (1205)..(1205): n is a, c, g, or t
  misc_feature (1225)..(1225): n is a, c, g, or t
aatattaaacaattaatataatttattttgaaaatgtcatttctaaatttaatctgaatttacgaagaatttatttataattataattttaattataatttaaatcaattttaatgtaaggaaacgacatcatttcccgtaagtccaataattatttatttttaattaccctttaattacatataaattatttttatatagcaaattatacggtgccaagaagtcgtcgacttcaaccaaatcaattttttgctgaaaattgaagaaaatttttcaagaattcggagctcacccacccaattgtcaaatgcttacatcaaccaattcacttcactggaacacttaatcaattgcagtgaaaatttgttggcaaaggcacacaaattttcggtgaataaaaattaaaattttcaaaaaataaattattaaatttaagacacttccaccgttgccatggcagggcgaaagggtccaagagttggtccaaaaagatggctttttttcgactgaaaaaccaatgtatcgcattttggaccattttttgtctgccggattgttcaaatcaattcctggaatggcatcattatgtccagatgataaggtttattattaataaacggcacaaacgaaccgagaacataaaaaactaccaaagcactaaaaaatccaaaataaattattttaaatttgcaaagcctagattttcttcctaattagagcttcattaaagattgatttacgcctaattgccaccactcattcaataatgataaattaattattattattttttgcccaaatttaaagtttaggcaactttatttcgcgcacttgccataccgttgtgcggcttcatatccgcctacttttcaattcagcaacagtcggacacggtgatccggccaaacgggctgatgccgttttggtatatgaatgtgccgcgctacacatttgatcagaatgtgaaaatgttcatcacaaatatgtactgcaatgcattgaagccgttcaagcaattgcagatgaaccgtgaggagtttgtgctgttgttggccatcctgatcacacaaacttgtgagtttttttaaaatttattttttcatttcaatcaatttgatgcaatgtctgaaaatatttggtctttactttatatctgatcagatgtttgcaatcgaactttggcgttcaaaccaataatagttcanatcagtaaaaatttcttggngattagaatttttcataatttttgaacaaattttca

SEQ ID NO: 43059 - DNA, 1417 bp, Heterodera glycines
tgaaatgatgcggcgtgagaagaaaaagttgctgggaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctgaacattttgcgccaatgtggcacgtggcacctcgatggaactttcaaatgtgctccagcgatgtgggagcagtgcttcgtcattggtgcttcagtgcatcagaggatgtgcatcagcatgtggtgtctcctgcctggaaaacagcgacgctactacgaagaagcactgaattcggcatcggctcaccggcaccatcaactcttacgtggccaaccactgtgagtccacgggagcagcttgttcaatattcgttgagcccgctaccgactttgacagctccttcaggcagaatctttaatcaatcatccgtttaaatttaataaaaaaattcagttccagcgtgggaggacgaaatcgttcgtgcgccacattttccaattccgctttggaacatgcactcacaggcaacatctgccctcgctcgtacaaacaacggactggaggcaactcatcttcattttatggtctttaatttattaaaaacaaattgaaaagaaacatttagaaaggcctctgtcaccaccccgccctctcggacttcatttgtggggttaatgaaagcatcgacagacaggtggacgctgcccgatctgctcgccatttcattcacaagcgacacaaacgatacatcctccaggatgctgtcattatgcgaattttggcggaggcgtcgtacaacagcaatggtgaaattagtgatcttatgacggcgctcggtctccaaaattgaaggatatgcgggaaaattgaaggatttcgagaattttgatgattcaattgtccacgttccgtaaagaattttattgaatgtttaataaaattatttttcttaatatgtgaagctgagggagtgtctatagagagaattcggatggcataggaaccctaaaacttgttcgaattttgatcagcactctttttaggagctttgaattttttttttttgcaattttatgtttatatttgggtccagggttaggaaatgggttatataaatgtcgtattcgtattcagcgacccctaacaccttaatttagacccattttccggctttttaatagctttttcgagttttggacacttcgtgggtttttactcttttggacatttcgtggcttggacaatacgtggcttggacatttcgtggctttgacatttcgtggcttggacattttgtgggtcagcg

SEQ ID NO: 43060 - DNA, 1048 bp, Heterodera glycines
gtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttacatagaaaattactttttcgaaaattttgcacaaataagaggcgaagaaattcaacgaaatttttattaggactttgatttaaaatgttgagaggtttaacaaatttgtacactgaatgttggatcgtcaacaccaatgagaaatgactaacagaaaagagggagaaaagggcgtcgttggctttggaaaaatagcctataataaaggagagactagcagacgatgagtgagagaaaaatagtggtaaaaattgtaaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagtaaattactttttcgaaaattttgcacaaataagaggcgaagaaattcaacgaaatttttattaggattttgatttaaaatgttgagaggtttaacaaatttgtacagtgaatgttggatcgtcaacaccaatgagaaatgcctagtaaggaaagagggagaaaagggcgttgttggcttggaaaaa

SEQ ID NO: 43061 - DNA, 1473 bp, Heterodera glycines
tgtactgctcgtagttgatgtgcctggtcttcactgtctacgctgcttctgttgtcgttcccacagtgtccaccatcgccacttccgacgacgctgttgacggtgcagcggatgacgtcattgtcgtcgacgatgccgttgcccggcgtcgttccctcgtgccgccgccgctgcaactgttcctgctgttcgcgtcctcctccggaatgcttggcagcgggccggccggctcagcactgcccatgccggcgtccgaccgcttgcgcggtgtccgctggccgacggttggtgacgacgcggaggaggaagaggaggactgaccagcagaattggtgccatcgccgccgccggcagcagtgccacaatttgcatcaccgccttaaaaattaatgatgcaaaaaactcatgggttcatggcaaaagcatattcaacttggaggaatggcttataaaaattttaaagcgctagatttatattaattccacgcggatctttttgggggtgcaattcatttccctcttccccgccgttttccattttttactaagaaatttcctaagaatttttttacgaaaaatttgtaggtttgaaaatttttcggggggaaacaacctgctccgctttttgcagtcggatgaaaaaacattttcaggcaagcggattcggacccaaggcggaccaacacaaacaaatggggatgtgacaaaatcgcgccacaatataacccacccggcaattcataataggcttaggctcaagccttattttgtttaattggacgagtttcctttagtattaggaagcgagtaaatgaattttttagccgaatatttattttaatttcggcgacaagattttggagtcgaaaggaggactcaagcttttcaaattccgttcgagttcggcggctggggcgcacccgattttgtgtcaattgaacgcattcattgaccaaatccgtgccgtgccatgccgtcactcaccctctaaaagcgtggtggtggcggcggcagtggtctgctgctgttcagcgtgttcatcgccgccccgatctccctcgtctccttcatcacaaccagggcattttgccgttgttgtgtggtggtggtgccgtggccggtgccgcgggtggggtggcgtcggtggcgatgtcctcgtccggtcgctgttcatgtcattgccgccgttgccctcctcctcatcaccagcatcgtcgtcttcctgctcctcctcctcgtcgtcgtactgacaattaaaatgtttcaaaatactaatcgggtacaccccaaaatttcgccgcgacttaatttcgccgaagaaatttttgaaaaaaatttgttttttagcgatttttttttaaaaattttcgaaaaacttactagtttgccataaatttcaaaaaaatttttctaaattttttcttgaaattttcttataaaaattctaagatttttttcttaaaaaatttctaa

SEQ ID NO: 43062 - DNA, 938 bp, Heterodera glycines
tgatcgaattttcactaaaaaagttaagcctacattctctttgcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccatacatctgggcgcatcggttcggggggactgccccgaaaacaaaaaaatcgattttttcaagtgtccgtttgtggtactcaaacaattatggggagcaaaaatccaacgcagaattaaagtacaggctattgggaagctactcccgaaggattcggtctccccataaatcagggcgcatcgggttctgggggactgccccgaaaacataaaaaatcaatttttt

SEQ ID NO: 43063 - DNA, 929 bp, Heterodera glycines
agcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgcccatttaatttcacagagaatttttaaatttatcttatatccaagaaaaatgactatctcttattttgagaaattttatacgttacaaaagcgctcgagcatgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgtacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaattcacagaga

SEQ ID NO: 43064 - DNA, 1000 bp, Heterodera glycines
  misc_feature (84)..(84): n is a, c, g, or t
  misc_feature (104)..(104): n is a, c, g, or t
ccaaaaaaaatccaaccatttaaaaatctataaaaatttaaaaatgagattcatgcgagattttctggaatagctaataggggncctagttaagctgtaaaaanaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaaaatccaaacatttaaaaatctataaaaaaaataaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaagaatttaaaaatgagaattcatgcgagattttctggaataagctttattgggcctagttaagctggtaaaaaaatttggggcgatttgaaagagaatagaaagaaccaggttcgatgaagttttgttaaggccaaaaaaa

SEQ ID NO: 43065 - DNA, 1278 bp, Heterodera glycines
tgtagtagacaaattactcaaaagcaaccgaatctttctttcattcgttggctttaagtgttatttattagcatgtataattttaaaaatggataagtttcaaataaaataagttgtaaccacaaaggctcacaaaatagctgttctttatcgaacagaatcaagaatggaaaatttatttgcttattagaaaaaaactcctacggtaatttgatgaaaaacgaccaattagcaaaaaataatgctcgatttaaaaaataaataaatattatcaaaaaatgtaatttatttatatatattaatttttcaatgactgtcaatttatgaaatatatttattgaagaaaatttcatttatcccgaggaataatggtcggaggctctaatgaatgaatagccttaggcaatgaatggccatcatatttatttatttgtaaaaatgggtagtgaaaagaaaaaatgtgtcggctgttgtggtgacaccactgccgccatttgtccgtcccccgaggggccatcgatcgacgagcgccgtctccggcgccaatgctcctccgcctcctcaaattttgctgtgtgtgctttgctgaccttcacataattcagtcccaatcaattggtaatagggatagtgttatatgttcctaaatattccaaatatgcaatacgcactaaaattgctagaatatacattaaaaacccaaaaaatgcccaaatatatactaaaattagaaatttagttacaaaaatatgtaaaaaaatgcgtaaagatataaaattgtcaaaaatataattaaaacaatggttaaataacgtattttagatttttgttttttgaaatttatggacgtaaaattgtgtgtattatcttcgaatttttaattttaacacatttgaccacgtaccaaccaaagaaaaatcatcaaatcgttcccggtgatttcgcaatctatgaaaatttatagcattgtaataatagtcgttgaactcgaatttgattgttaatgatgttgaaaaattttaattaatagagggaaaacagggttgagaaaattgtattaataaaaatttataaatttaacaaaagttaaccataaaaaaatatgaacctttcaaaaattaattatattataacttaagtcctcggatcaggattttaaccaaaagtacgaaaattatgtttttcaaccgattcttaaaaagtgtaaagtgattttagataccaaaattattttagtttcaaaatttttatgtgttcatatatgaaacacgaattcag

SEQ ID NO: 43066 - DNA, 1127 bp, Heterodera glycines
aaaaaaaataaaaatggggtttagggaccccggaaacactcccatcggaagcaagttcccccctttgctgtaccccttaacagttggggaaccaatgccggaaaattgcttaaaaaagaaaccaaacaaattctccattttttactcccgttgccaaccgaagggtacattggggcaatggatgtggggctaccgtatcagttattaaaatttttgtttttcaaaaaggatactaaaactgggatacccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagag

SEQ ID NO: 43067 - DNA, 998 bp, Heterodera glycines
  misc_feature (893)..(893): n is a, c, g, or t
taaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaagtttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattanaaatttttagatttttattcatctccctttttgatagtgaaagcatctgagtgcctaaactaaccctgtaataaagttttgtgtgtttcagagcacgttctaaaa

SEQ ID NO: 43068 - DNA, 330 bp, Heterodera glycines
aaaatttctaagttcgcaaatttaaaaaaaaaaaaattctcccaggaaacggcgggggggggggggggaaatgaagtgccctcgtcccccacccccacgccctctttcccctctcctcctccgacttcttctgatcgtcctcgctccctcctacgctcttttggtcatccgcccgccccttttctcgcctgctctccgtccgcctcgtccactttgttcagcaacaacaccaccggctttcggaccagcgcccggtcgtactgctccatctcgcggttgagcagtgccatcatttccaggggcgaacagtgtgtatttgatacaaaaaat

SEQ ID NO: 43069 - DNA, 1083 bp, Heterodera glycines
caccgaccctagggaagagaaaagtcggggatcgagcatttgtcaggatggctggagaaatttttaaaatgtcggggagcaacaaccctcttcgggagtaaattttcgtaaaagtcgaaaaaataaatttttctaaaaagaaaatttagaaattcatttgaagactctcatactatttgagtgcatttgataatatcgcaattccccgaatcgggtcggggtttaaccttcaaccctaattttctagcaaaaaaatgcattgccaatggaaagcaaaaggcaatttagccatttagaagatggccgttggtctatggcctattttgttcagccgtgatggacgaccacacaaaaaagtgtccgtcggtggattttgtgttgtcaggcggtggtgatgtgatgatgatgatgatgataccatcctccgccgcccctcctcctcctttctctcgtcctctactcctagtttttttcttgcccctcattcctttttttacgtttcgccaattcccttttccttttcctctctgccctgtgctatttcgtgcactgtctctcgtcggaggaaaggtgaaattggagagagagatggacggaatggacaatcaattgcagcattgccaactccatcccattagcatcattaatttgatagtgttgctgctgctgtttaatgacaaccactttatacaacagcaattagcagtctgatgtaaatggcatttgcaaaactaaatgatcagcatggcacgtctgagacagacgcgccgagatcgagacgagaataaggatgttatgtccaaaattcaaaaaccaagttttcaagtcaaaagcagacggaggtgagcggaaggttcagcgaatcgcgagaaagctaaggggagggggaccgtaaatcatcacagcagtaacagcggatgaaaggccaactgccgacagtgaagttgaggaaaactgtcagctgcttgtagagtggctcttaaaaggcagggctcgtaggtgtccttatttctttgatttgtgcctaatttggagaggacgaaatcatagaaatttcaaatctcccggcgaatttccaaaata

SEQ ID NO: 43070 - DNA, 763 bp, Heterodera glycines
aggggttcgacaaacccctccccccaccttgtcgctggcgccagtaaccatacagcgagttgatgctcaattctctcaagcaccaatccgagtttgtcacccctcccccctcccattctcgtcctcctttggcgctgatcggatcggtcagcagcatcagacccatcagaacgaacggcaaaaaagggtgcgcttccctttacgacaagcgaacggagtgagcagagagagaaagggacgagagcggtgaagaggagcgggaaccaatcccgcctcagcttggcccaccccaaccccaagcgcgcggcggaaataaaaagattggcgacaataatggatttctcaaaactaacaaaaaaagagataaactgttgtttagccatctaatatattaattttgcaatgtgtatgtgcgttggggccaggccgttttcgtacgagcacatattttttgactataacttttttattttccaaccaaatccaacgatcttgatatcattcgagagcccttaagatgctctattgcctgcaaaattccaaaaaaattttgttcagtttaaaaaaaagttcgagccaaaaaagttggaaaatctggttttttgaattcttctggctataacttttttgaaccttaaccaaaaacttgtgctcgtacgaaaacggcccgtacgaaaacgaccccgacccatgtgtgttgtgggtgtgcgtgtgtgacacaaatgttttgaattatttattgagacgattgttttagagatta

SEQ ID NO: 43071 - DNA, 1003 bp, Heterodera glycines
tgcttctgatcagcttcattgcatgtcacttgcttccgatttgcctgtctccccgttctcatccgccactgatcagcccttttttatccatccgaccaaaggcgcctatggcacttcaattttgttcaacaaccattccgatcaaatggcaccaattcccgatcactctacgatgcttgatccgtcggctacatcattcattaatcaaccattgtgatggcagatggataaatggataagcataaatgacaaaatatactacaatacagtgcaaattgatataattaatctcgagactcacggaacttgactcaattacgaattacgaaaaatacggcattgctcagaattttttaaatggcccctgaaacttagggcatggtttcgaaaaccgagaaatttttcttgccaatttactctcattcaaaaatcggctttaaattgagtataaaaaaatcgccggaattccacgaaattgtcggataaaaattaattaccgagtctcgagcatcaaatttttcatttattaatttaatttttgttgtttagataagaaagagctggtcattcattcaaaatgccttttgaaaaaaattttcaataaaaataaaataaaattttgataacattttatggcctttgggaggagggatgatgattattatatttattaattaccattgtttgtgaaattcaacaatcgatagttttgacgaagcactttgacacgtcaaatttgccgcatttaatagccaggcaaattagtggatggggggggcggactcgggtaatcgctaattttcaaatattaattttcgtaaataaagcaattaatcgccgattttcaagcaaaattggcactcacattccaaaactatgttttgtgttttgaaattttgaccgctgggatttttcagataataaaaaaacaattaaaaaaaaccctgaaaatccggcaggccaaaaatccagattctacacctgtcggtcgcgcaaaaacgcg

SEQ ID NO: 43072 - DNA, 931 bp, Heterodera glycines
  misc_feature (791)..(791): n is a, c, g, or t
  misc_feature (793)..(793): n is a, c, g, or t
tgcgtttcagagcactttctgaaaaaatacttatgccccccctgtgcaaaaaataaataagtaatgaaaaagtcagaactttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaagctacaccactcggcctcttcgcggcctcgtggtgggcctncncttcaaggctcccacgcgcgtcagagcacgacaaatatttcaacaaaaattgggaaatcatgtttcccacttctttcaacaaggggtaatattttggaaagaccttttttccccaataaacttggcaaaacccatttt

SEQ ID NO: 43073 - DNA, 920 bp, Heterodera glycines
atgtttccaagggttttagggatcgctgatcacgaatccgacatccttttcgaacaattccgaaccccggacccgaattcaaacagaaagtcgaaaactcaaattttcctatttcagatgattttttcaagttttgtttaaatacacgggaacgaactactaggtcgttgcataaaaagggcgctttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttatggccaagtccctaattttggcaccaaatttcattggcccatggctgacaggagaacaacttataggacatgctacgtcacccgtcttattccctggaccctatagacttaatttatggctaaattatttctcgcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaattatttgaaaaatttttattactttttcaaaaatgcattgaccatcaattggttggatacaatcactttcaatcgcttatttaaagctgttaagacgatcagggattgaaaaaaacctaattttgaacccgttatttttggacaaaagcgcaaatgtcgggg

SEQ ID NO: 43074 - DNA, 975 bp, Heterodera glycines
  misc_feature (924)..(924): n is a, c, g, or t
  misc_feature (942)..(942): n is a, c, g, or t
  misc_feature (948)..(948): n is a, c, g, or t
tttccgaaatttcctccccatggtccgccgccgcccatccccccgccgtacggcgaaccgtacattccgcctaaacagacaaaagaattatttacataaatattctgaaatgttggcacttttaaattgaatttcatttcaattttcaaaaagccttttttcgaatgatttaaattaaaatgtttgtccatttaaatttggcatgtaattaattaataattgcttaataaaaactcacgtctggcgcgcagagcagcaggttcattgtcaactctctcttcttgcgcggttatcagtggggaaaaagcgcacaaaacgaccaaaagaaaggcaatgataaaacggagaggcgacatcttgagagtaattagtgcgagggtattaaaaggtaattaagtcaattatggctgtgtgagttttggggaccctcttttatagtgtggccttcttcttctaatgtgctactgatcttcggtttgtgccagtttttcttcctttttttctttcctctttagtaaatttttttcagtttgacaaacaaattaattagggagactaatcagcgctaattggcaaatcggcgcacaaaaatcagtggtgaaacatatttgtttattaaatttaattttgtcgtacaattaatcgaaggtgttcttcaaacttgctgctggtgaaagtgaatcacttgcgcaagtttagtgacttcacaataaaataattattcttccccttttgggcaacaaaacaaaaatttaattgcccatcatttgtaaaaataattaatgcaataaaagaaaataaaattaatttctccatgtttcctcaagctaatttttaatattagtggatagagctgagaaatggcaaatataaagggaaattatagaatttcacttatgttaaaattatttcaaaccatagttntaaaaataaagttatttncttaangttattttaaattaattatcttttacc

SEQ ID NO: 43075 - DNA, 1136 bp, Heterodera glycines
  misc_feature (101)..(101): n is a, c, g, or t
  misc_feature (112)..(112): n is a, c, g, or t
tcaaaataattataaagctgattttcttagtcaatttatagttgtcagaatttagacagtctttatggcagtatttatcatgatttagaatttcatttttntaataatgtgnacataaattgttattgtatttttttgtcagaaacatttattattatttatatcattttcaatttagttgtgaattgttaaatttatttttatttctaatcaacaaaaaattatttgtgtttaatttttaaatattttatattttttattgttttattttttcttgtagcttctgatgaactaaattaatttttaagtcgttttaattaattaatagttaacgttaaaagaaataattattcaaatggatcaaattggaaaaatgtttatttattgaaaagtttctgttcctcaaatctccactctatcccgtgaccggaaaatgcgcttgcaaaaatatgcacgaaaaatgtccaaatattcatttggatattttgacagccttggttataaccttataataaaatgagttacagttttaaagtataataaaaaatatttattatcaattcctttaaaatattctttgttctgttgttatttttaggattatttcctcttataaattatttttaaactcttttttgttttttaaaactaaaatttttacgaatttgttatttttaattataatttacaaaatattcttaaatatttaaaacatttattttctattataataaatatcgaacatttatttttttttgtgtgtttttataattaataaattttgaaaaaaattacattttaattattcattttgactttgtttactatatcaattgtctgatctcgattattcgccatggcatccttttatttttggcttcaatcctttaaaataataaaatgattaattagttttaaatccatgtccactagtaaccattagtatcagggaagtgaacacctttaaattaattaattattttatttaatctttatgtgtttaaaaaaacttatattgtcaaccaaattatttttttaatttgttataaaatttattaatttatggtatgtttggataactagggattggtttggtaactttaaatttttccctttttgaaaaaatttttagacac

SEQ ID NO: 43076 - DNA, 110 bp, Heterodera glycines
tgcgcgaatttagtgaaccccggcatctcggaaatttttcccacatttgcagagatgtcggggcccggaagttaatcaatcaaaaaattacccgcaattagcacaccccc

SEQ ID NO: 43077 - DNA, 1228 bp, Heterodera glycines
  misc_feature (148)..(148): n is a, c, g, or t
  misc_feature (1220)..(1220): n is a, c, g, or t
tctacttcatctgctactcgccaattcagcttttcttatgcaggtccaattcttaatacatcaccccaaatagttagctaattactcgttaattatgcccctctctctctacccctgcaggggtctcttcaacttgtccatccatccncccctacgaattcgtccttctgatgaatgccttggccattctttgctccgcttgtaaccctttgctgtacactctcttctccagtcgtttccgcgcgcgaattggtcatttgttgtgcctttgctgcgacattttctatcgccgcaacaataagtgaaacgccaagaaaaatagacaaattgacaatccaatgaatggacgaagcgaaaagtgaagaaagaaaggcacgaataaaacatttagcatttaatatttttgctcgttttggtagggataatccaatttattttttcattcacaattcactcaaaaggatgtcagcaaccaatttattggcaacagtcaatgggaattggtaaaatatcgtacaaagaaaataaagaacagaatctttctaattatactgactctaatttgtgggtccgttgttatacactcatcgaaccgggcgattaattgtggaaaagcgaaaagtttttgatttgtaacaaatggaccggcaaatagcattaaattatacatttataaatgactaatgaggggaaatgttcattttttgaggagtgggaattttgctcaacaataatcgaagaatcattttttctttttggaataaaacatttgcacgaaattcggagaaagaaatgtgggagaaaggggggggggggggggagaagcaccggcaaaaagacaaacaatccaattttgagacggagctcaaagttgaaaaatgccattcatcagcctttttgggagacagcgaaacgaaaggaaaggcaaagcgacagaaaaagggagggaaagtgatggaggacaaatcgaaggacggacggagtgatcgtcgacggaaaaggcattcgctggtcaaaaaattccatgtttgcgtcttcgtctcctccgttcctttcgctgtattcagaaaacgtcgccgggcggtgggccattgccatcctaaaaaagggggaagtgaatggtcattatttccaaaggttttgttgaaaaatgaattcttggattggaattgcatcggaccaaaccaatatttattgctattacccaatgtttcggtatnttttctta

SEQ ID NO: 43078 - DNA, 1267 bp, Heterodera glycines
  misc_feature (87)..(87): n is a, c, g, or t
  misc_feature (115)..(115): n is a, c, g, or t
aacatgacttcaattacggacaggaatccgtaccccgtaattacggggggttggaaagcgccgtaatgggtgcacaccatttccccnccgcccgtatcatctctccacaaaaatnttctatacaaacttgtaaaattttttaaaaaatggacaattttttaacaatttttagaaactttttttttgagaaattggtattcaccaccataaaactgaaaatttaaaaaattcttcatgcaattttctgtttgaaaattttttcgggagatggggaggagggtgaacgagctggcccccgccgtaattgcgcacccaacccctttgctgttccacacacccaccatttccatgcgcggtgatggtggtgtcgccgtcattcgcctcctcctcctcctgcccatcgtcgtcgtcgtcgccgccctttttgccattggtgttggtggtgatgccattttggaagagttttgccgtcgtcgtcgctgtcgccaatttgttgttgccaccaccattcatcgggctggtgccaccgccaccattcaccgccgctgcttcctcctcctcatatccgtcatcgtccacatcccgaaagcccatccgtgccatgcccgcgcaaatgatgtcctccgctgacgacgaggcggaggtggacgagccgaatgagtccaggaaggacatggtcgccgcgtgcgacgcttccaacgcggccagtgggggcgaaggcgccgctttgctttggttattattggtggtggtggtggtgccgtttttctgccgcttttcccacatttggtccgtgaaaatcaactgtttctgatgctgaaaatttgagggaaaatatggtacaaattttttttgttgttgttggtgaaagtgaaatgccatacatttttaagggtgactaaaaatttaattttgttaatttctaaaacagaaaaatgagttttttggcacactatttcttggttgttccttggcaccgaaaatcttttccaaatggattttaccaccaaaacttgagtgccgtgagagaaactaacgaaatttttattaaggggggggggatatgccaacaaatgcattcataaatttttttaaaatttatttgttaaaattctacccatggcaaaagtagagcaccgttcaccaacttctcattcacctaaaaaaatttaaaaaataatgtaacaaatactgtttttaatataccctcaattccgcatgatcaatcagaatttggatcacaattcgggcaatgttattctgaaaa

SEQ ID NO: 43079 - DNA, 821 bp, Heterodera glycines
ttgtacctcttgtaatctctgttgtacctcttctgatcactgttgtacctttttaatcacttttgtacctcttttatcaattttgtacctcttttatcacttttgtgcctcttcatcaaatttgtacctcttctaatcactgttgtaccacttctaatcactgttgtacctcttatcaaatttgtacctcttcaatctctgttgtacctcttctaatcactgttgcacctcttctaatcacttttgtacctcttttatcacttttgtacctcttttatcacttttgtacctcttcatcaaatttgtacctcttctaatctctgttgtacctcttctgatcactgttgcacctcttctaatcacttttgtacctcttttatcacttttgtacctcttttatcacttttgtacctcttcatcaaatttgtacctcttctaatctctgttgtacctcttctgatcactgttgtacctcttatcaaatttgtacctcttcaatctctgttgtacctcttctaatcactgttgcacctcttctaatcactgttgtacctcttttatcacttttgcacctcttttaatcacttttgtacctcttcaatcactgttgtacctcttctaatgactgttgtacctcttctaatcactgttatacctcttctaatcactgttgtacctcttttatcacttttgtacctcttctaatcacttttgtacctcttcatcaaatttgtacctcttctaatctctgttgtacctcttctgatcactgttgtacctcttatcaaatttgtacctcttcaatctctgttgtaactctt

SEQ ID NO: 43080 - DNA, 1662 bp, Heterodera glycines
  misc_feature (1543)..(1543): n is a, c, g, or t
taagtcacttctatacgtggataatttgttgttgttggccgatgccccagccgaagccgaacaaaaggccatcgaagcgcaagaaatttttcagaggcaaaaatgcgcctccgagaatttgtcgcggccaaacctgaacttctgacgaaaattccagaagaggattgcctctctgaagacgagccatcggtgcttggtctgaaatggattttacagtcggacgatttgtccctgccatttcccgaagtaccaaacccagcggtacttactcggaggatagttttgaaaactatcgcatcgtttttcgaccccctagggttatgctccccctgtttagtgggggcaaaaatttatttccagagcttatgggaccagtcccgcggttgggaccagcccatagaaaattccgaaaaacgtgcatgggatttgatcagaagtcagtggagtgatcaaacaattttgatcccaaggaatacgccccgcacaaaaaatggggctattcaattacatgttttttcagatgcttcacccaatgtttttgcgacggcggtatatctgagagcggaaatagagggtcatgtaattaactccctcatttacgcccgttctcgccttaaacccaaaaggatgggtgaaaatcagcccgacgggctcacaattccccgtttggaactcttaggggttctgatcgggaccagggcagccaaattcgtccaatcacatttattttatgacatagaaagtgtccatctctggacggattccaaaattgttttagcatggatttctagcacagaaaaacaaccagtttttgtgtcaaatcgcatacgtgaaatccgaacaaatcgttcagttaattttcactatgttcgttccgctgaaaaccctgccgacctggcaacccacccgaccagtccaaatgagctccgatccgccaaaatatggtggaaaggacccgaatggttagaaaaaccagcaaacctttggccagacgaattgacggcaattctgccaccggaggaaagttcagcgcctgatcccgttgtggtcgccgttgtgaaaattgggccagaaattttcgaattcgaccgattcggttcttggcgaaaacttctcggcactgctttcttcgttttacgattcctgtccaaaatagggaaaagcaaacaactgttccccaacatgagaaattccgattttttggaccccgaaaaccaaaaattcgttttaaattggttattcaaacaaattcagaggggaatgctcccccccccgtcccgacttatcttgacacagacggtttgattaggctcaaatcacggctctgtggaattggagataaagattttgagcatccagtttttgtgccgacggattcgtgggttcttgtcctgctcataaggcactcgcacatccgcttgcttcatgcgggtgtggactccaccctcaccgattttctgtccaaattttggtgtaaaagggcgagacgtacggtcccgtaaatcataaatgaatgcccggtgtgcaaaaaagaccgagcggntaaatttggtctgccaccgatgccgcctcttcctaaatcacggacacgacccgtcttccgtttttgagcaaatcggggatcgactttttagggcccaactctctataaaatgactaacg

SEQ ID NO: 43081 - DNA, 1471 bp, Heterodera glycines
  misc_feature (1339)..(1339): n is a, c, g, or t
  misc_feature (1397)..(1397): n is a, c, g, or t
acgcataaaaagcgtgaatggttgtaagtgaagtgcgcaattgccaaattaaaagaccttgtgacagccacgcttattgatcagaataaaaaaagagaaaaaagaaattgccagaaatacaaatatgtatataagccttccttcatcactagggctggaaatttaagtcactaaaaatcttcaaaaagtcgactaaaaaagtcataaaaaatcgccaaaaagtcataaaaaggcaaaaaagtcacgaaaaattgaaaaaagtcctgagaaaatagccaaaaagtcacaaaaaaaatccaaaaaaacacgtaaaaatgcaaaaaaggcgaaagttaaaaaaaatccaatttttaataatttatagaataacattttgatcgtatttttagacacttaattttataaataggtcctaaaataggcataaaaaagagattcttccaacaattaagaaaaaattctccaggcttcattgcctttttatcgatcgaaattttatttttcggaattttcttcgctaaaattcaaattttgcctcaaaaagtcaaaaaaatctcgaaaaaagtcgcaaaaactcgaaagtcataaaaatcgcaaaaagtgtaaaaaagtcaaaaaaagtcacaaaaaaatgcatgttagaagcttcaaacaaagtttagaacactttttaagtcattttaaggccatttagagttagcaaaaaaaatcatttgacttaaattcccagccctagtaataaccttacatttctttcaatattgtttattcctagattttaaatttagttgtacccattaatgcacattgggaggcaaattacattcattatccatatgattttccttaaaatgatttaatgaaattcatattttggaaagtgttatcaatacaataaagcatcaaaagaattttttaaattattaatttatattttggcattttttaaaattattttgaagcaaagcttcatttttttattaaatcttaaaaatcttctatttatctaatgaataatattagaatagttgaaaatgatcctcctcacagttcactgataaacttttcgtaagaatttgaaatatttttttggtttttaatcaatagttaattattaaataaatatttaatttaatttttctattaccattgttagttttaattaaagaaattttataaaattatttatcacttgtaattttaatacgtcacgtaaaaagatgagggaatttttgatatcaagaaatgaatttgttcatttttctttggttttgtaaaatcttctgatttttccagaaatctaatctatttgattatattcagtaacttcttaacttanattgtcataattcatcttatgcgccttttatttgcttctaattaagattattcaaaanattttgtttttcatttcaattaagcatttgtaaaatctttccagcttactaatatttttcatatcaaaaaaaac

SEQ ID NO: 43082 - DNA, 1001 bp, Heterodera glycines
aaaaaatcgatttttcaagtgttcgtttggggtactcaaacaattatggggagcaaaaatccaacgcagaattaaagtacaggctatagggaagctatccccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactacccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgatttttt

SEQ ID NO: 43083 - DNA, 1497 bp, Heterodera glycines
  misc_feature (1281)..(1281): n is a, c, g, or t
gaaaaaatcgatttatttttgttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggtatttttttcagaaccgatgcgcccagatctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaagggcggggnggggggggggcccataattgtttgagtaccccaaacggacacttgaaaaaatcgatttttttgttttcggggcagtctccccgagccgatgcgcccagatttatggggagaccgaatccttcgggaatagcttccctatagcctgtactttaattctgcgttggatttttgctccccataaatgtttgagtaccccaaacggactgttgaaaaaat

SEQ ID NO: 43084 - DNA, 964 bp, Heterodera glycines
  misc_feature (29)..(29): n is a, c, g, or t
ctaactggcggttgtaccgcaaaatctcngccgccgattcccccggggcggcacatttcgggcagcgagattccggcggtttttattttgtccagaactgactgactaggttttgaaacaatttttataagatttgatctccttgtgtaatagtgccagaatttattggggttttgatagttaaatagttcgagaacgagaacaaaaaaataagttttcttgagttgaaaatcgagtctcgcactcccctaatctttacagtagaccaattccccaatgtttacagtagaccaatttccctgttgttgcaacttggactaaactaaacaagcaaaaaaatgggcaaacgttttggaaattttgactaatttaacttatcattcattaaaatttcaaaaaaaatttcaggcggagcctacggcaccacgggaccccattataccatttttgttgaaattttaactccaaaatagcaaaatttgtctttttttgaaaaaccgctacaaattcctgcttttgcgccccggcggtgaaaattttgaaaaataaccgttgagaaaacaatttttttgcccattcgattgccttccctgaaatttttgaaatttttttctggatacaggccggaatgaagaagccctttgtaataattcagcttaaatattttttcatttaaataccgcgccactttttcgctgctccttccccacttttctgtcatttccacccatttatcccacaaattccttgaattattagttaactaaatgggcgccacaacaaacaaaaaaatccattaaacttaatgccgcttttttcggcaccagtggtgcgcccccccccctcgtcatttgataattgattcctaaacattttcattaaaagataaattgccacgcttttttagtgtgagacagacgacgggaagatgaaaatcactttagggcaaataattaatttcatt

SEQ ID NO: 43085 - DNA, 1498 bp, Heterodera glycines
cagtccgacgaatggcatccaggcgaagacttgatttccctggtcgaagagtcgacgagcgcccggtcgcgggtaacgtcggtcgatctcctcgtagaagccataactgaaaggggaaaaaattgaagattaaaatgaaaaaaacaaaactcacgctttgttgatgttggagcattcgtggttcccgcgcagcagcatgaagttcgatgggtacttgatctgaaattcaattttgggggtaaaatgttgtcaatccctgaaaaccacaccttgtagcagaagagaaggatgattgtctccatcgagtgtgctcctctgtcgacgtagtcgcccaagaacatgtactgctgctccggcggggggccatgcgttgtgaagatcctctgcagatccgagaattgtccgtggatgtctccgacgacgacgaccggcgggcggatcctgacgagcgtcggctgcatccggaagacgtccgtggccgccttgcagagttgtttgagttcctcgtcggtgatctgtgcaaaaaatgaaaatttgattaattgctttaaaacattccaaaatttgtggtccacctcatccgtgaagcgttgaagaggcggctgcgtgacttttctgatgatcgcatccacaaatctgcttgactggccatctccttgcacaagtactgatgccgttgtcgaaggacgacgagattgccccgccgctgccgccgcctttgcatcgaaacagtattcctcctttgccattgttgcaccagggcacgtccgttcgtgagattaaatgttgtagtcgaaggacaattcaataagtaattgtgggaaataaatattaaaattgtgagggcaaagagcgaaaatttcttacttttatacactttatttctcttttttgaactttttaaaggtaatcgttacttttaatggtaccccaaaaaataaaaaaatatataaacgcgggttttatgcgattctgcgttgatttaaaatgcttttgtaaatgtttccgaaattaactatttttttttttttgtttcttcttttattaaaacgatattgttttttgatgaatgatgcttacctaaaaatgaactgacaatttgactaaaattcctaacttccatctacacaggctgaggctgttacaccggaaaacaacccaaccttcgacagttattaaaagccaaacgctctcatcaataattaaaactaacaatttttcgagaatccgttcttttggctgtgtgttaatttgttcacttttccttaaaaaccgtttgttgttcctccgtttgtttatttgtttttaattaagaacaaagttcaaaaactaatctttcgctacaatgaattcggtcaattttccgcttcctcagcagaattatggtggacttaaacttccgctggtgagcgttcatttattgtttataccccctcccctcacatttttttatttccaaggtttgcgtgacgccattcggaaacatttccattctgat

SEQ ID NO: 43086 - DNA, 998 bp, Heterodera glycines
tcatataaatgccgaacaagaacttgagcacaatttttgcaaaatcgggcaccaaatggagcgggggcctgtgttaaaattagaaaaaaaacttcaaaaaaatttccaatttttcacatgctgtccggctcgacgaggccaaacagcgagaaaaacagcatttccaaggtttggctgggcgatgccaaacgcatcagttcggcactgtcctcgtccaccggttggtaggcgggctgaaaacaaattgaaattcaataccgtattcctaaaatatagcccgcccgcccctaaattagtgcccccccccaaaaaataaagaagccgcacttttgagggaggttgaaaaatagagcccacgggggttctatttagagaaataatctttagaaaatttttatttccaaattattttttcctgaaattttcttataaaacttgaacaatttctaaattaaaaaaattaacttttttttccggatggaaaatggatacgggttgggtctctgcattaatgttgaagggttatcctagtcaattttggatattacttgtgaaatggaagtgacgagtaggagagagccgcgaagctttagaaatggaatgacattatcaggagtctgggcgtagaatttttattttaattgtgactatgtgtgtaagtaacggacacaatgacatcaatgtcccccacctgtacaccatcagataatacacatggccgcccaatttgaccgcgtggaaggcccagcccaaccatctgccggccaatgagaagacgatccgcgcggagggacctgtgccgacggagtgaattcagatttagaattgtaaatttgtggcattgagtatctactgctcgagagagttgggtggatggagtaaagagaagcttttggtgttggctcctgtcttgggtttgacaagatgcccgcccacatacactgagttgtttatctctatccaactctctctcattgatttagggtctcacatttact

SEQ ID NO: 43087 - DNA, 1499 bp, Heterodera glycines
  misc_feature (29)..(29): n is a, c, g, or t
  misc_feature (68)..(68): n is a, c, g, or t
  misc_feature (95)..(95): n is a, c, g, or t
  misc_feature (121)..(121): n is a, c, g, or t
  misc_feature (199)..(199): n is a, c, g, or t
  misc_feature (213)..(213): n is a, c, g, or t
aacgcggaaactctgagcacttccgtaanaatatcctataacaaaaataattactggtcaaaatattnatatataatccaatattattacgattntaattagccgatgcggcagtcgtccncaacgttttggcgcccatggcattcgtttgccgtttgatttttgctggtaattcgttacatttccttatggtttcttntaattttgaatctntagcctatttttgtgttctgccgattttctaggcaatttccatggcatcgtttggccaaaatttgaaagtaaaagaaagaagaagcccaggacaaactaaattaataaatttttgtaattttctatgcctttttaataatttgaatttaatgcattaaaaaaccaataaagatttatttattatttgttttttgtagaatattatgtcaaaagcctaaattcaaatttacatcaatccatgaaaatgataacctaatccgccggaaaaatatttaaattttgctgaaatttccagtgaaaaatggatttgaatttaagaaatttattgtatataattcagaatatttaaaaatggtaatagtgagaatcacaaaaaattcctaatcaccacaaaaatgagcttattaatacaatttaattttatcgagcaaaccaaaggcacattagtgctcttatatggtgccaaaaacaaacaaataaaaatgatcaaataaaaaatacaaaatgaataccgtaataaaaatgaataaaaataaatcaaatgttaaaaattcacaggtgattaaaatttagtgtatatgtggcacagaaaatttcctactcagaactcattgcttttactaaacccctgaattcctttgccttattaatttgcaccgctaccactggacggttattccagtttcttactatcctatgaaaaaaattattttgtgttttggccgtgtggcgctttactcgcaaaagtaaaggccgcctgcgcctttctgagaaaaagaaattttgttcagcctctatgctggtgaaccctttaataattttaaaagctgttgtcaaatcattaatttttcttctttcttctaatttatgtaaacccgcgattttaagtctttccacatattttttgtacacaaatccacattttcgaaaaacttttcttgtgaaaaatttttgtacccgttcaattttgtcaatgtctttttttaaatttgggttccaaacttcggtatcgtattctaattgaggtcgtacaaaagttttataagctgctgttagagtctttatttccctgcttttcaacactctcaaaatctgaaagcttctaagatatgcgtttcgtataattttgcttatgtgttctgaaaaattaagtttcgagtcaattataatgcccaagtcacgtacactttccgattctgaaatcttttttgagttaatataatattcttttttcttgttatttttccccaaataaagaacaaaacatttttcagttgaaatttcta

SEQ ID NO: 43088 - DNA, 1176 bp, Heterodera glycines
tgctcccttcactctttccccgcccccgggacatcgaatccgattttgataattttaaaatcgagaaattcagtgacaaataatcattacaaacacttttccattttttcgctcatcgtcaggcggaatcgcgaagcagagacatcgttcatcgaagaaggagaaattgcatttgacgatcaatcgtgctcaaattgttcacaaacgaagagattgaaaaagtccgcaaatttttgcatgaacaattccaatccgacaaaatcaggtgccccggggcaaaaaacaacaccgaaaatggcacctcttttcgatatgaaaatagttttttaaaaaccattcaattttagaggtattctgcagggctctggcggtcagttgcgcgtcaaattcaaaacattgcaaccgatggtgtaccaatcgaaagaacattgccgagttttatttgcacaactcgaggcggtcgaatcaaacacgtaaaaatgggggaagcgaatatttgaaaaatagcgggtgccggggtaaatttattgaaatttgacaaactttcaacgccccgccccttcacattttaggaaaacggaagtgtgaaaatgattgaaaagttaattttgttttttttcagtctccaacttttggccaatacgctcgacgacgcattgacaaaagccgaattggtaaagaaacgtcaaagcgaagatgtgttactgcacatgaccgttctgaacactaaatacttggtaagtggggggggggagagagtaagcagggagagagagacagataaaaggaagagagaaacgaggaggggaaagggattaattgtgagaaggaatgcgagtgagagagagtggtagagacaggaagagacatgggggagagacaaacagccaacaaagagagagacaaagggaaaagagacgcattggagaaaagcgaaaagaaaaggccgtccctttcttcagggctggcagggatggaagaaaacgacgctcaatgtcacccaattgttggaaaagtatggacaattaaactttgacccaatcaacgtcgaggaggttagtggaatggttaaaaaacgatcgaaatttgttcgacctgttccatttccaccggcaccgccggacaaaaaaaaaagaaagatttctggagaaatgttttttgcttttgctttttcat

SEQ ID NO: 43089 - DNA, 1298 bp, Heterodera glycines
  misc_feature (94)..(94): n is a, c, g, or t
aaaaaactgaaaaattaggggtgcaaaataatttaaaaaaattttatttctcataatttaccggttgtttttgcaattcaaaatcaaaatttcntcaagttttcggcagtgaaactcacagttgacccactcgcgcacccattcagatttggatttaattttaggcaatcaaatttttttccgaagggatattcaaatcggaaaatatttgacgaaaaatggcaaaatatgcaaaaatctgaaaatatgcataaaaaatggcaaaatatgcatgcaatatgcagaaaaacccaaaatatgcaaataaaagtcccgatttttatacgcaaacacaaaaaagaaagtgttttcctactatttagagcatggagaagccaggaaaaaaaaagcatttgcatatttttggcagccctgatcgtcactttacgcctaatggtccccgccctttcagtacgatcatttcatcgtttttatttgttccggcgcttcgccaacggtcgacgattttagtgccttcgtcggggaccgacttcggcacgaattgctcgcatttgtggaaaatcctttggcccaatatatccgattttgccatgtgtttccaaaggaaattttaacagaaaattgcacaaaacaaagtgaagcggaacagacaaagcaagggaaaatatttaaataaagtaaataaatattttaagttgcgaaaagcattgggtggtcggaattttaccaaaaacgacaaatggcggctgttttaaaggcaaattgagggcgaaattgaagaaaaagaatatgtgcaataaaatattaaatgattttaaatatccagctttaatggaaattcattcggaatatgtggagggaagggaaaaactgagccaatggtaaaaaaggcaaaaaaaaaatgaaaaaaaaatgtttaaggttcgacgcgaatttttaatgcataaattaatcgaaggaaaagaaaaaatgaacgaatgaactgattgattaattgcctctcttttcaatgttttgagctaattattattattaattgtgtgtaattagtgagtaaattgcgcacaaaatgttcgtgcatttatttgttaaagcaataattcccatttaatttctactgttgatttgtgaagcattcattcattagccgagtatataaaaacacaatgtctatttgtaatttgggcatattccgcccctccccttctctcttctctccccctccccttatctcactccctcttcccttctctcttctctccccctccccttatctcactccctctccccttctctct

SEQ ID NO: 43090 - DNA, 1094 bp, Heterodera glycines
  misc_feature (11)..(11): n is a, c, g, or t
ggcccattttncgggaacatggatttttcctgggcctggattttttgtccaggaaattcaggttttttcaaaatgttaaactctaaatttttgaactcctcctcccaattcaatgctccataacttggcaaagaaacaaccaataaaatgctcttctgttcattcaatagcccaaaggaaaaagcttaaaattctgaaaccagtatttttcaacaaaaaataatttttttttttttttgtaaatgcaaagctaattaaaaaaccctatagggttagagttatccaaatgtccatgaatgttcaatatatgattgcactctgggccaaattatgtaacattgaagagaaaaatgtgagaatattctattaaccacttgccctaaaaattcaatttttcatagggtatgcaagcaagcctcaatttttttttttcaaaaaattttccaacgcgaaagttcgtgcaggctctcatgcaggcttccgctgctgatccctcctccaacacctccggcgcccatttcctgcgcatcaattgcgttactccaatcggtgctcatcggttgaatggggctgaccggactgatcggagagctaatattttcaaaaaaaataaaaaatttgttttaaaattttgtaacaaaatgtaagcctttatacattttacatagtcccggattgtgtcataaaaataaaagttaagataaatttaaaaaaaactgcttttccgaacatttttggcacaaatttattgtttttttttgaaactcaacgtaattttttgaaattttacaggctaatagagagcacaagttacttgttatgaatataaataataaaaatttggttggattcgaacaaatgagaaaggacacttaaccaaaaaactgggccatcgcccatttggccctttccgacataggccaccacacttttggacatgtaatttaggcatttctttataaaaattcaataaatttatacttacgaaaattggtcatcatttgaaccgccggataatcttcttcatttgacgacatcattaacaccaaaaaaagaaagcagaaattaaactgtgtcaaatcctaaattttaaa

SEQ ID NO: 43091 - DNA, 794 bp, Heterodera glycines
  misc_feature (758)..(758): n is a, c, g, or t
tccgactgctatgacaagtaccacgacggagaaaagaagtgccatatgaaaatgttctctgagcggaccctcctcttcgtcctccgtcggcggaatggccgaaaagcgcggcttttcacttgggctgggcacagtgaaagtttgctggaaatgagttggtgccgaagtgtcggccaatgaatgatgccgagaaatggacggcgttggggtggcggagtcggaagggtggcgaacgatttggtggtccgtctcctccgccgggggcgtcattccggacccctttaaccgattggctaatgaatgacgaaccctaaatgcgttaatagcccattcaccccaatgtcgtcctcgtcgtccgggttgaaaaggtctccgctgccctcctccaactcgtgctggcccatctccgactctttctccgcaccattcgctgttttttgtgttgtgccgcaaaaaattgggagaagaagaaaaaagagaaagaaaattgggaggaaacggagggaatttgaggaggaaaaacggaccattggcggaaaataattccttaaaatgaattatattaactgaaaattatttgaaaatggaaatatttttaaaaattaaataaaattaaatgaaataaaatgaaacgaatattttaagttaaaatattgtgaaaagggaaaaattttgttttgttcgtaaataaacgcataaaatggtagcgtaaaaaatgagcaaaagaaagaaagtcattttttatgggaaggaaacgnaaaaggcacagaaatcaattgaaagtcgcggagatg

SEQ ID NO: 43092 - DNA, 681 bp, Heterodera glycines
  misc_feature (51)..(51): n is a, c, g, or t
ttccttttttatttccattcgcttaatttgcatttgttaatcgtaattccnctaaaattcaaatgttcttttcccaccggattggggttctttttccagatttcccattttttgccccctctttgtcctaatcatcgtatttcttcggcaaattcaaaataactgccaaacaaaatgtttagcagggaaaacttcatttgaaattgctggaacattgcattatgtccagtatcaacaattggaagattttagctctaatctttccaaaaaacaaatcggtcattcaaattggctgaattggaattttgattggaaggccacactttggtccttaattggcctccaatcatccatcacatttctaatgattgttggtgtaggcattatttgcctcatcatcttcattaaaatttcacccttctatagactttggaaattaatttcctggtctctgatgagaagagagcacaatcttgtcacagtattgttaatactgtacttggcggggggaggatccttcggatgtggtaatgcgaaatcacgtctcatcttccccaccacgaaaaaattcttcaaacatgagtcatcacgaactcacactcacacgaatgattcatcgaaaattttcaattcaaagtctaatcacgtgatttacgtgatggatgattgtataaaagggtg

SEQ ID NO: 43093 - DNA, 910 bp, Heterodera glycines
aagtaaaaattataaaaaatgaaattgaaatacaaaaaaatgactatgatattctcttggtgatgtgggaattggctgaggaattcggacttggcaagtgaatataatttaaaaataatataacaaataaattggggtaaacccaactcatccatagctcatccatgcataaaaatgccatgaccaaaaccgctcaacgtaaaaattctacgatcaagacctcataaaaaatgccaagacaaaaatgccacgacggcgacccgcgtcgtgttgtggatgagttgggcgtgacacaactaaattaattattttatatatgtattaaaaataaattttaaataatcgacaaaaaaaacatttgcacagattttgcaaatatttgtgaagctggaaaaagttataaaaaagaatataacaatgccaatttaattcagaagggattatataatttaaaaagttattccataatgactgcaaagttttatttgggttcagttataaatcaatttccaattagcacatatgaacaacagttaggcaagggttttatggcttacaaagaattatatgacaaaatggacaaaaaaaaagatgatgccaaattcaacaaaaagtatgctaaagtgccgaaaaacaatgctgaagagatgaagccgttgccggacccatgtgagcaggcaaagctcaaatggaagaagaattgaagaagttgaaagacgaacattgaaattgagaggagctttttcggtgctatgtttttataaaaaaaagcatcgaaaaaggcgtaataaaaaaacgatcaaaagaaaatttttaacaaaaaatgacccataactttgctcaaaagcaaccaaattttaaattaataatttcattcgatagataatttgtttcctaatagcctacaaaa

SEQ ID NO: 43094 - DNA, 1146 bp, Heterodera glycines
  misc_feature (1063)..(1063): n is a, c, g, or t
  misc_feature (1068)..(1069): n is a, c, g, or t
cggctacgatgtctaaatttgactctcacttttctgttagccaaaaaaattactatctatttttcaactacttttaatatgacaaatcgaatatggaatatgccaacgccccatatatccacatgattagacttagctcgattttttcggctacgatgtctaaatttgactctcaattttctgtttgcctcaaaaaatgactatcaatttttcaactatttttatacgataaatctaaaatggaatatgccaacgacccatatatccacatgattagacttagctcgattttttcggctacgatgtctaaatttgactctcaattttctgttagccaaaaaaattactatctatttttcaactatttttaatatgacaaatctaaaatggaatatgccaacgacccatatatccacatgattagacttagctcgattttttcggctacgatgtctaaatttggctctcaattttctgttagccaaaaaaattactatctatttttcaactatttttaatatgacaaatcgaatatggaatatgccaacgccccatatatccacatgattagacttagctcgattttttcggctacgatgtctaaatttgactctcaattttctgttagccaaaaaaattactatctatttttcaactatttttatacgataatacgataaatctaaaatggaatatgcaaacgacccatatatccacatgattagacttagctcgattttttcggctacgatgtctaaatttgactctcaattttctgtttgcctcaaaaaatgactatcaatttttcaactatttttatacgataaatctaaaatggaatatgccaacgacccatatatccacatgattagacttagctcgattttttcggctacgatgtctaaatttgactctcaattttctgttagccaaaaaaattactatctatttttcaactatttttaatatgacaaatctaaaatggaatatgccaacgacccatatatccacatgattagacttagctcgattttttcggctacgatgtctaaatttgactctncattnntctgtagccaaaaaaattactatctattttttcactatttttaatatgacaaatcgaatatggaatatgccaacgcc

SEQ ID NO: 43095 - DNA, 1558 bp, Heterodera glycines
tcaaatccaaccatatttttttctttttatttcgtcctatgagatggcccaaaccaacaataatcatcttaaacatgcttttgctctttttttggtcaccgcttttgtcattttaatcgccgtcgttttggcggaaaaaagtgtcaccaattcggacagtgccactgccgcaaaggtaagtggaaaagagaaaatgtgccttatgtggagcctataaaagtttaaaacacggttaaacagcctaaatttgcatattattgaacaaaaaaaaaagttcacatcacttttcaataagttcactttttgtggtgcgctttttaaaaacttttgatgaacagagggggggggggggggtgccgataggcgccgccggagaaaaacttgaaaattgctgatattttaattgattttgtccaaataatgatcaaaattttgcgattttgagtaaattatgagaaaattaaagatattgggtccaaatgtaaaatttgagaagtttatgcaatttgtcattagtagagaccgactaaaaggcaccaaaaaccgtgaacaaggcactataataggcaccaaaaaataattgaaaaacgcacaaaaatcccgaaaaaggcaagctttttaaaaatttattaaggatttttagggaaaaaaacacgaaatttaatcgaaaaaattaattttgatcatttaaatgattaatatcggaactaatgcccagaaaaaaagatatatgactaaaaagtcagtctttatgaattttctggttatgtaaaactattttttttgttgttgtaaatttgccaaaatcaaataaaaaaaaggtttttcaagtttaaatcctttcaaaaaaacaatttaaacactttccgtaaacttttttcaattgtttggcatcagaaggcctataaaaggttgtttttggtttgtttttttgctctaggacatatgatacccaattctgaaaaatgaacaattcacccgatacgtaaaaacagggtccgttctttccaatttcgtggataaatatttaattgttgaggggatattgatggattttctttcctttattgaattgtttcaattaaaaaacaacaaaaaaatcattaaggatattcaacggatggaaaaattacagaaagcacaggaatatgtggacaaattgaacgaagcgcaaaattattggactgttcgtccgattttatctatcaccgcaaaattatttttaaaattatttatttatttaaggccgtcgttcacaaaaattttgtaattatggacagaaagccatttaaaaaaatggcgaatgggccaattgaaacaccaaaacagcagaaaaaaacgcagcagagaaaggctaatgtaaattatattttagcaattaaatttaaaaaatagaaaaatgacaaattaaaaatttttaattccgaagttttggcgttagaattggggtctgggattattgtacgatccttgcccattataaggtttattttttttgcaaatgttctgttacagaagtcggcatcggcacttccgtctaaatttgatgcgcgaaaac

SEQ ID NO: 43096 - DNA, 1218 bp, Heterodera glycines
  misc_feature (108)..(108): n is a, c, g, or t
ttaaaaattctctgtgaaattaatggcgattgcgcacgccctccctctcacgctcgagcgcttttgtaacgtataaaatttctcaaaataagagatagtcattttctnggatataagataaattaaaaattctctgtgaaataaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcactccctatcatgctcgagagcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcttttataacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaataaatggcgattgcgcaccgcacttcctatcatgctcgagagcatttgtaacgtataaaatttctcaaaa

SEQ ID NO: 43097 - DNA, 196 bp, Heterodera glycines
cccgcggcggacgggcgggaccatccccccgcggcggacgcggtgcatcaccgcgcggcgcacgcggaccatctccgcgcggtccccgcggaccatccccacgcggcggcctcgagccctccgggcggggggtgcgcggaccttcgctgcgcggtccgcggccctcaccacggggtgcagcgccaaactccccgga

SEQ ID NO: 43098 - DNA, 824 bp, Heterodera glycines
agatgggtggtccgtgtgtagcagagggcgaggcgcttgggcagatgaagcgcgagctcaccgaccgacggatcatcgagttcgttgcgggaggccccaagaactacggcatccgccacactgcgggggaaggctccgaagagcgcgccaacctcaagatccgcagattccgcctgtccaacactgcgcaacaactgctcacctttgaggcgatgaaagacctgacgctagccacgtacaacattgacggaccaatgtgagttttcaacatatcattttgattatagatcacatattaaattgaattttagcgatgatgccttggacaatgacgacctttacgtgtacggaggcggcgaacatcgtgccataagcgtcaatttcccgcaaattgatcgcaatgtgtacgccgatctctacacgcatgaggcccacaaagactacaggcccttctatgccaaggggcgcgttcggcctgggatgcagacgcgcccctttggctatgtggaggatgatggacagccgaacggaggacaacggacgccggacgcatcgacgatagagaaattttttggaacaagatcccacacagcccggacactctgggtggttctgatgttgtgatgttattttatttatttattttttattttcatttaatttgatatttattgtttatgtttaaattgtacaaaatattgtgaccaataaatcatttacgaaaatagtcaggtacaatattagataaattggtaaatgactggtgcaaaatatcaagagactttgcctcagtgacaatgaccttcctcgaaatataaattagg

SEQ ID NO: 43099 - DNA, 1117 bp, Heterodera glycines
ggtaatttttttttgtccggcctatcccagaaaaaatcactatttcttttttgggaatattttacgtgtaaaagggtgggcatttaagggactcgctgtgcttgcccacgcatttcaaatagcgggtatttttatttctccggcttaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttggaatattttacgtgtcaaagggtgtgcatttaagcgactcgctgtgcttgcccactgcatttcaaataggtggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggtctaatccagaaaaaatcactatctctttttttggaatattttacgtgtcaaagggtgtgcatttaagcgactcgctgtgcttgcccactgcatttcatatagctggtaatttttatttctccggtctaatccagaaaaatcactatctctttttttggatattttacgtgtcaaagggtgtgcatttaagcgactcgctgtgcttgcccactgcatttcaa

SEQ ID NO: 43100 - DNA, 1055 bp, Heterodera glycines
tttaatctggtcgcgtattggagcatcccgtgaggggtcttttgcactctgtcccccccccccctcctccctttcccttttctctgctcatttttatttacgcccctccggcgaacaaaacattggtgaaagagatttccttccgtgcactgtccccttccccccccccccccgacaaatgcccataaaaaattgggcactcttcgaattggccgccaattgtcccgccaaaattggggtaacagaatttgaaccattccaagagaattttcagttttttttattttattcttttcttgccaaaaatggtcgacgttccggctgattttgctgttctgctaaactccgcgccgccaattagccgaattgagtcaaacaaaatgcattggctgcgaaaacggcaacagacaaatgcgacggcattgcaacgcggcatcgatcagattggccaactcgcgacggaggtgcgaaaaattggaacaaaattagggacaaagaaagaatttaatacttaagtgagtgggaaaaataaattgagttaaaaaattataaaataaaaaatatttttccattttaataaatctcttaaaatatgaattttatttgccgaatccaaaaattaattagtgccatttaatgatcatttttctttcttcctaagagtcgaggtttgaagcgtccggtgaccagttttgcgcgttttgcggattctcccgacgaacaggcgctgtatttgctgtgggaaccgctcacttcggaccaaccgacggcaaacggagggccgtcctcacggatttatggatatttaaaagtgaaattaacaaataaagaactgtgcaattaaccataataattgtttaatgctgctgaattgatggcttatttattaaaaaaacaattttctcattgagcaaaggtcgtccgggaccgacgattgtatttggtggacggagaagggcgacagttcgtcacgacggtgagttaaattgtttcattttaaatttattttaattattttaaatcaatttttaaaatatttttgggcctctctcctt

SEQ ID NO: 43101 - DNA, 975 bp, Heterodera glycines
  misc_feature (962)..(962): n is a, c, g, or t
tctttccatttcagccccatgataaaatattttcttgcttgacatgcgtcccaatcggtgctcgtcgccgctctccgagttcagtcggctcatccgccgctgtccgctgttcggctcactaactcccccgtaaaaaagtgccgtgacggcggtaccaagcgcaacagcaaccagaccgagattctgaacgagtggagattttggatgttgaaaagtccgacaagaaatcaattttgcttgtgggtcgaacccgaaaattggccaaatcggacggtttgattttgctggtgtccttgtcttgggccaaaaacagaaagagacaggcaaacacgaacagattggctgccacggtgaaaccgtaccgataggaagtcattgactgaaaagggatggctaaaatgacattgctctcattaattgcttttccgctgaccattcgcgtatgctcggagttggacagctcgggaatcattgccaagtgcgaaatttggacagcggcccagccaaattggaaaagcataatgggcggaatgaaccaaagaaggcgcagaaaaggcagccaatggcagagcaaacaaccggagaaaatcagcgggaaggaaagagtgacacaaacggtgccgaaaacgcaaaggttgaaataggaaatggaaaaatgccaaaccaacctatgatatgccacgactttcgtcgcccaaaacggcgtaaaatgccgggcagaagggacaaatcgctgagcattccaaccaacggagtggacacggcgtcagtcacctggcggaaaatggcgaaatgtttttgtccgtctacatttgcagtttttccatggaatattcattgattgtcagtccgtgtttgcctgtccaatgaacatgagcagaccagcttgccaacttagcagcaggacgaccttctcaagaaaatcagcagataggtgaaccacatcgatgcgcacaaatcgntgtaaaaatgacc

SEQ ID NO: 43102 - DNA, 367 bp, Heterodera glycines
tgaccgttcaacagacaatgatacgattgtcaatttatcgttttcgacatttcttctgtttgtttatgtctgcaacatgtataaatttcgtctgtttgcacccgtggttcagtggtataaacgtttggttgtagcatgcatcgcgctccattaccaagggggacaacaccgttggcaacactgcttttcaattgaaagcacacacgtgcgctcatttgtaaaattgataagaaatgctgccaacgcagttcactctccaggaaaaaaaaaatttttttttttgatttcgataaaattttgtaaataaaatacttggcaaataaggacagcgaaaagtttgttcctacccaccacccccaccgctgac

SEQ ID NO: 43103 - DNA, 847 bp, Heterodera glycines
  misc_feature (26)..(26): n is a, c, g, or t
aattagacaatttacgactgctttancctcatttttttccattgcaagaaaaataaaataatattttctaaataactctgtttccggactcaccgcgaggaggtagcagaattttgagcccatactaaccacaacacaatagacaaatcacaatacattttaatatgtacagtacaccctttccaatttttatttaaaacgcctttcccaagggccaacgggaacagaaattcatcaagggcattcaaaaagttaaaggcgactttactgtctaattgcgtacagcaacaaaatgccgaggtcatcttttctgtttcttagagtccgtaattagagttaatttttaaaatattattttatttttcttgcaatggaattaactctagctaaagcagtcgtaaatttgtctaatttgagataaatttttaaatattttttttgttttaataaaatccccaaatgtcggatccccaaatgtcgtgtgcccaaatgtcgggttccccaaatgtcgggtccccaaatgtcgggatcaccatgaaatgatttagaatgatattatgacaaaagtcagatttatttaatgataaatttctaagatttatataaatcatttaattttgcggcgttttttaaatggcaataaacatgcatcggtcgacaaattcccaattttttcgcaatttttctttcaattttattccaaattttaggcgaatatttccttcttttcttaattccttcttttatcgcatcaaatttatgaacaatttcgcattttttctgaccatcaaattgaacattctgatcattgtgaattgcatcggccaaatttaattcattttgatca

SEQ ID NO: 43104 - DNA, 984 bp, Heterodera glycines
ggggcagttccccggaacagagcccccaaatttatggggagccgaatccttcgggaaaaacttccccttagtttgttctttaattctgcggttggatttttgttccccataaatgtttgagtcccccaaacggccacttaaaaaaatcgattttttgtttttgggggcaatccccccgacccgatgcgcccagatttatggggagccggatcctttcgggaatagcttccctatagtctgtactttaattctgcgttggattaaaatttttcataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgcgttggatttttgctccccataattgtttgagtaccccaaacggactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctcccccataaatgtttgagtaccccaaacgcacacttgaaaaaaaggatttttttgttt

SEQ ID NO: 43105 - DNA, 1239 bp, Heterodera glycines
ttttcttttttccatctttttagagttgcatttccaattttcaaaatgccagcaatttcttgatcagtttaagtgggatttccattcttcatttcataataatcatttaatttgctcattttttgttcatcggtgaatcgaattggacctacgaatataataaaatttaattgttaaattactttgaaaaattaaaattaaaatttatcgatttcaatgccaaattcttttttccattttcggaatgtttttatgcgaatgcctttcacaaaatgtttctgttttccatttttggacattcttttaaactcatcaattcgttcaacaaattcttgttttttcatttgataataatgttttagtccattgtttttcggaaataaatccatcatatttcgccattttgtgggtttagagttggttatttttggcaaaaaaactcattgtaaaaaaattaaaaataaacgaaaagtttttagcatttaaaaaataatcaagaaaaaacttcaaaaattttgacttatttaatgggtcgtaattacgaaatatcatgtgaaattatgatgaaattcatggctttcaattctttaatcttatttactaatattttataaattctacttacatatgttcagatacatttattgatcgcatttttgccaatgcttctctatattcattaaaatttaaataaaaattattttctgatgaattaacttagtttttaatataaatatatttaataaaatattaaaaaataattaattaattatttataactttttttagtgatgctttttctcctttttgtatttgtgtttttaattataaacaattcaactgacaaaatattgtcagttaatctgtgtaaaaaattgggccaaatttttctgaaatatttggcgaagaatgggcaaatccacaaatggaagaaaatcaaaatgaattaattaatcagaccgatcagttggattttcagaaaaaatgtcaaattattcacaaatttcatgcaataaaagaaagaattaacaaaaaaaaaaaatattcggaaaaaaattggaataaaatcgaacaaaaaatagcagaaaaattgagaatttgtcgaatgaaaatttataaatggaaaagagaatttggactaaatttaagaaataataaaaattattatcaaatgaaaaaacaagaatttgttgaacgaattgatgagtttaaaagaatgtccaaaaatggaaaaaagaa

SEQ ID NO: 43106 - DNA, 970 bp, Heterodera glycines
cgaaacaacaaagatgctgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaatatatttgcaatttatcaacaattttgagaagtgagttagaaatgataaacttcacgattcaaatcaattttcgttgctctaattaaccgcgataaaaacattcgaatcaattaaataacttctgagataataaggtttatcataaaatttcaattaaaaataaaccctcaattattggtatgaacgatactttccaaacatgcacacgttttgcgctcgagctatttatcatcgggcttgtcaatccaaagcgaaacaacaaagatgctgttttgaacgaataaagggcataggttattttgaagaagtgtcaaagaacatgcagcaataagcctgcaaatctaataagtggaaaatacatgagtatagaatttattttcagaaagtgtcaacagacttttg

SEQ ID NO: 43107 - DNA, 971 bp, Heterodera glycines
  misc_feature (53)..(53): n is a, c, g, or t
ctagagacatatgcgctacccataaaaaagatgaatcatttttgaaaaattantatagttcgactaaatttgcaaatcgatttatggtgtacaggatgtttgtcgaaacataactcgtcaggcctttaagatagacctgccattgctattcctgcaaatattgagtctagtcagcccaatcgattgctattcgaatggtttggggtcgttggcccaaacaaaagtggtgctacttcttgcaaagaagacttagcctactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgaaaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgatgcttcttgcaaagaagacttagccaactgtaaacagcaagccatccaaatgcttcaatgtaaaaaaaaattacatttggatgcaacctttatttttcctcgcctctcttttcgaaaagaaaagctattagcaaacgtgtttggaccaattctaaaacaaatcggggtaattaatttaatctgactttataagataaatgggaatttaagcgaaggat

SEQ ID NO: 43108 - DNA, 1116 bp, Heterodera glycines
  misc_feature (149)..(149): n is a, c, g, or t
taaaaaaagtattagaaatattaaatttaattattatttaaaacttattgctgaaataagaattagtcaaatgaatcaaacttgatattgagaaatagctctacttatccactgctatattatgtatttaaaaaaatctagcaaaaatntaaaaaaaagttgtaacgaaaaaaagttcgtcataatttatactcaatattattgcccctaacattattgaaactcaataaaaaattttgaaatttaattaattgatttatagataaatctttgaactatctaataattggtatggctttaattgaagtttgatcaatgatcattttttttgtatttatataatcttagatttttggtgaccataaaaatatgaaacattgatcgttacttttttcagaaacaaccaaatttaaatttcattatagaattctatttattattgataataattagggctccaatttttaggcaaaaggctatttttttcctgagctccccgtggcctaaaatgcacgaaaaacatgtttttttgggctgttgttaagctacttttcgagttattagtgcctattttctaggcttttatttttagcgcctaaaaaattttgaaagagcctacttttgcctattttggcgttttgccgaaaatttgttagcaaaaatgcaataaaaacaaaaaaaaatacacccctaagaatcgatttttttgaattttaaaaatacacccctaagcagagattcaaaaatttctgaaaataaatccccgaagaaattaaaattttctcaaaaatcgtctttaaaaatttttttaagacaattttttgaatttaaaaaataatgtaactcaatactgaactgacttatttttttaccatttgaataaatttttttcattttacacccctaaatttgagactttttagagcctattttgggggttttttagagcctaaagcctacctattttagcggtttttagtgcctataaattggagccctaataataataataaatttaaacatttctttcattgatacttttttaggttcgcctcattgactttttttggttaggactcaacatggacgtatgacactttctctctctctctctct

SEQ ID NO: 43109 - DNA, 700 bp, Heterodera glycines
atttcggccccaccgattgcgcccgtgccctcccaatgccgggcaggtcggcgatggacagagtgaacggtgccgtcgaagtgttggcattttccgactcaatttcctcctcgtcgcccaagcggattttgttgaccactgacaacgcctcggacaattccttgtccgcatcgccatcactgtcctcatctgttggggtctaaaaatgaaaccaaaaaagggtgaaatgaatgaaaaattgcaatttgagtcgtttacaaattcggaaaggtcccgcttttttgggtataactcctttcataatggtatgaattgaacaatttggtatcgttcatttgccctgtgaattctcaatttataaagcaagagatggaaaaaattcattaaatttcaaaaaagttatggcaaaaaaacaacaattcgtaagactttttttttctttgaaaattttttgccattttttttgaaacttcagttaatgaaatttttcgaaatattttgcagacaaatagaatacccccgtttgagaaccgaatggatttttctcttcagagtttggaggattacagaaaaattaagggctagcaaaagacaccataaataaaaaaggaatttttttcgaaaaaatttctaaattttattgtaaattgcactattttccagggacggtcccaggggggggggggggtacgcggggtac

SEQ ID NO: 43110 - DNA, 1263 bp, Heterodera glycines
  misc_feature (220)..(220): n is a, c, g, or t
  misc_feature (265)..(265): n is a, c, g, or t
aaaaattaaaaatttggttgcctttgagctaagttataaataatttttcatcaaatcatattgatggttttttatagagtagagcgggaccgggaccaaaaccacggacaactgagtaccgaagtcctggttttgaccgggaccgagaccattcccgggtttcccagccaaaaattccctgttttcaacccgaaaaggtcccggttttgcccaaaattcnccggtcccgctcaactctgagttttttaaataacgacttccgccncctatcaaatttgtcagatataaaaaaagtaagaaatgcaaaaaatttttcctatttttcgagtttctaaccagtttcataattgttaaagcaacaatgcaagtaactgctcataaaacaattggccaaattacttttttcaagctcttttatcgagttcaaattttgcctagaaatgatttcaaattcgtcgctgataaaattcggttggctgcagtctcgtactgaatagcagcgactcggcctggcgtgccaattcggcgtaacgaagtgtcgccgccatgttgccgtggttggtgtgcaaatggttcatcaacgtattggtgtaatgttcagacaaatgttgcagtgcgaggcgaccagcatcggacagaccgctaattgctgaacaatttagaaaattgacaaaaattattttactaattattattagggttataagttgtatgcactaaaaaatgccaaattatgcgcataaaatatgcactaaaaatccctcaaatatgcactaaaactccgaaaaatatccaaatatgcactaaaatatgccctaaaaattacccaaaatggcttataaccgtaaaaaatgccaaaaatgcaatttcgaatttgtaaaatttttgtcaaaggtatgttaaaacaaattacatttttctactattgttttcaaaagttcttataaaaaattcaaaattctcgattttcaagggtatgtttttgaaattcccaaaaaagtcgatccgtaggggtgtatttttcgtttttattgcatttttcttatgaaaatttgccaaaaatgaccgaaatatgctctaaaaaacgcaaaatgccaaatctgcatttattctcgaaaacccccaaaatatgcttttatatgcaataaaaaccttcaccaaatcaaaaaattttaacgcagaaatgttatttttgagcccctttcttcatagcatatgcgcagaaaaaatatgcaaaatcatacaatttataaccctatttat

SEQ ID NO: 43111 - DNA, 895 bp, Heterodera glycines
ttcagcttcatctctgccgattgttggctttcggtgttcgatttgcttgcgcctttaaaacttggcctcggaattgcgctgatcagccaccgttttgacttttacgtggacgaacacttcaaaacgcgcaaatgggcattggaaacttttgacattcgaagcaaaattggagaaaatggcacaaaggaaatggaaattgtcaattacaatggaaaatcattaccaacactccgcatcaaacaatgtgccaaaaatattgaaatgctttttttcacggatctgcggaagaattggcctctgaaaatggaagccttcaaagcggtgctttcatttacatatcatttcgtattccttaatcaatttttccatgttttaggcatttgccaatgcttcgtctcccgccaatttcatcgtttccacttggttttattatcttcctgactccgttgtgctcttcgatctgacaaatgaattgactcgggaactattggcattgaaaggaactgacgacagctggcgtcttctgttggtccgttatccaattgcgcgagacgaaagcaaatggacaaaatgggaaaaggaagcgattggctgagaatttcatgatgatcagtggaatcaaattaacatgtatatttacagtgaagacgaaatcgggaacgggtcagtgaatgattattcaaaaaggtaatagtgtactttgtactagagaccggacaactggggtcggagggatcccgagtcgggatcccgactgaatcccgatcccgagcaatcccgaacattttggaaaacgatcgggacggatcccgggtcgggatcccgaccgaatcccgatcccgatcaatgccgaagattttttttcgggatcccgcgggattatcgggatttgctc

SEQ ID NO: 43112 - DNA, 903 bp, Heterodera glycines
cgcacccgttttttattttttgggagaattcggtcgcttcgcggcctcaggacgggcgcttcgcgcccgttttttaattttttgggtggacattcgcccgcttcgcggcctcatgacgggcgcttcgcgcccgttttttaattttttgggggaattcggccgcttcgcggcctcaggacgggcgcttcgcgcccgttttttaattttttgggggaattcggccgcttcgcggcctcaggacgggcgcttcgcgcccgttttttaattttttgcgggacattcggccgcttcgcggcctcgggacgggcgcttcgcgcccgttttttaattttgtggggaacattcggccgcttcgcggcctcaggacgggcgcttcgcgcccgttttttaataaattaaaaaataataaacacggcctgggtccgaacatgccgccccacccctcagaatccccaatcacacagggattctgagctcttaaccatgtctaaagtaaaatatgtttgcatattcgtgatcagcggcccaattaacccctaaaatcatatttttggaagatttttggtgaaaaaaattttccactcaaaaatcatggtcacacccctgtggtcccaaattccaaaatgacttttatttctataacttttttcaaaaaagtgataaaaatgccaaataaaatttataaaatagagcaaaaaattgcggattttttgagtatatcatttttataaaatactttttcagaatggagttaggaatttttttctgaaaaatcgaatttttccagaaattctggaataacttatttatattgaaagataggaattgtaaataaatcccataaaattctcctaatttttttttaaaggcaaactttattccactaaattgaccaaaagcgaa

SEQ ID NO: 43113 - DNA, 1094 bp, Heterodera glycines
aatttttgggttcctaaaaggatttccattatggacactttctattaacaatgccttcacgaccgacgaatctcaccttatccgaagaccaaaagcccggtcaaagacttcagtgtcggcactttttttgtcctctggcatttccgccaagatcattgtgcttgccttttttctaactaaaaactaaataatttaacaaataataataataaatgaataaaaggaaataacgaaattagcaactttttttattttattattgagttatgcagaatctaaatttaaatagtcgtagaaatgactttatacgcattgtcatgggaagaaaatgataaagagccaaaaattaaagaaaacggcagctttcgtctgactaaaatgcctatggcaaattctaaagcaagcaaagtaaagaacataggcagagaatgaagcagatacgcacccgtacaattgacgaaagtgtcaattgttctcggaaatttaaaatgaatggaggtaatgtacaaataaaagagaatgaacacataagacgaaaaggtgataaaataaatccactagaacaagtcatcgtttgagcaatgcgttctaacgctttgatgaagacactgacgaagctgcgcttattggggtggcaccagcaaaatcaccagggattggcagaacagaaatacggtagaagcgcgtgtccaggggaaggttataactgaaaagagaaacaaggcgaagaatcaaagcgacgcctacgcttaaattaccgatttgccgcttttctaatctgacacatttcaatgctctccacaagcacaaacatccagggacggggcattgatgccggagaaaatgcgatggatgaagcatcagtcgactgaatggcgggacgcggtggacgacgaattcccaacttctcgaaactgctgtctttgacaatgtatggcgaattgggaaaggccgagctaaataatgaaagggatttttgaaaagaaatttggattcattcaggaaaaatacttccgtgcagcatatgcattcaattgggaattccaaatgatcaaagcgccacagtcttcatacagctaaaaaaacaattataa

SEQ ID NO: 43114 - DNA, 1371 bp, Heterodera glycines
cagcaagtgaattttgtttacctgctatatgtactattctcaccttataattttgaagctcaataagccacctagccaacttttgatgtgtttctgccttttttaatagaaaagctaatggcttgtgatctgtatgtaattcgatatttgacataaaaatgaacggtttgaattgccgaagcgaaaaaattattgctcctaattcagtctgaacaggaggccaatttctctcagttttagaaagcgttctgctacaataagcaattgcattatagactcggttttcagaatcccattgcattaatgcgcctccctgacccacattagaagcatcacaaaatatgtgaaatggctttgaatagtccggaaatatcagaacaggtttttcagacagaattttcttaattttttcaaaagctttttcttgctcatcagtccaattgaattgcttctctttcctagttaatctcgttaatggttccacaatagttgaaaaattcggaatatgctttctgaaaaagcttgccattcccactacttgccttatttcctttacattggttggattttgcagattaagaattgattcaactttgcttatgcttgaagtatatccatttttgtttacaatataccccagaaaattcatacttgccgaagccaaaatacatttttgtggtttaagttttaaattaaaccttctgaatctttcaaaaacacttttaagagagtctaagtgttcatcaaagtcatcagattttgtgaaaaccaaaatgtcatccacataagcaataacattttcaagacctgttaacacatgtgccacaattgattggactcataaaatacttttggactcataaaagtcgattggactcataaactgcattagagcctaatttttccaaatgtcaacagaaatgccaacaaaaagccaatttaaaaaaatttccattttttttgcgccgctccctttgaaatgcaccgccaaaaatcagtccaccacaaattcacaagacattttttgtgcatgtgttatgttacaacaacaaatgatggacactctctctgcttttcttctgttgttcggcgatgttttttggtcgccgttctttacacttttaaaaataaatgtttgaaaatgtaatttttatttatttttccccatattttttgaaggtcgtcgtcatccatcaaaaaatcatattctctgatcagtcgctcattgaaaacacctctctccacatcttctcagatcatagtaattgctgctgctgcttgtcccgtgcattttgccgaaatttgcgcaatttttttttcgcatgtgtgaaaagctgttggcagttgtgttggttgcacgccacgcgcgcg

SEQ ID NO: 43115 - DNA, 1126 bp, Heterodera glycines
gcatgcgtggcacccgtgctcagttggaacccgagggctttggcgcatgggcatgcgtggcacacgtgagcagttggaatgggcatgcgtggcacccgtgctcagttggaatgggcatgcgtggcacccgtgctcagttggaacccgaggcttggcgaatgggcatgcgtggcacccgtgaacagttggaacccgagggcttggcgaatgggcatgcgtggcacccgtgaacagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgagcagttggaacccgagggcttggtttatgggcatgcgtggcacccgtgagccgagttggaatgggcatgcgtggcacccgtgatcagttggaatgggcatgcgtggcacccgtgatcagttggaaaccgagggcttggcgaatgggcatgcgtggcacccgtgctcagttggaatgggcatgcgtggcacccgtgctcagttggaacccgagggcttggcgaatgggcatgcgtggcacccgtgagcagttggaatgggcatgcgtggcacccgtgagcagttggaacccgagggcttggtttatgggcatgcgtggcacccgtgagcagttggaatgggcatgcgtggcacccgtgctcagttggaatgggcatgcgtggcacccgtgctcagttggaacccgagggcttggcgaatgggcatgcgtggcacccgtgacagttggaacccgagggcttggaatgggcatgcgtggcacccgtgaacagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgaacagttggaacccgaggcttggcgaatggggatgcgtggcacccgtgaacagttggaacccgagggcttggcgaacgagcatgcgtg

SEQ ID NO: 43116 - DNA, 1383 bp, Heterodera glycines
  misc_feature (13)..(13): n is a, c, g, or t
ttttcaccgggtntaataaatctaggaaaattagtaagcttttgtagtgttccgatacgtatctctgcaaaatttggtgagccgctgatcaattacaaattatttatggacgatcaaattttttgaaatttttttaagtgcaaaagtggtgggtgtcttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatatttggattttttttggcttaacaaaacttcatcgaacctggttctttctattctctttcaaatcgccccaaattttttttacagcttaactagtcccaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactagtcccaattaagcttatttccagaaaatctcgcatgaattctcatttttaaattttttatagatttttaaatatttggattttttttggcttaccaaaacttcatcgaacctggttctttctattctcattcaaatcgccccaatttttttttacagcttaactaggccctattaagcttatttccagaaaatctcgcatgaattctcattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctatattaaatattatctagtcagttcatttaaataatttttatcca

SEQ ID NO: 43117 - DNA, 1259 bp, Heterodera glycines
tccttcatttgcattgtctttttcttttcttttggctttctctcgaaatttgtgccatcattttttggcattaattgggtcaataaaatttcagccaaagattctttctcggaaatttgttcttccatttttcttaatgcattttcttcctccgaatttgtgccaattttcgatggcattttgtttgaattttgattttcttctcccaattttgtgccaattttcgatggcattttgtttgaattttgattttcttctcccaattttgtgtcaatttccgatggcattttgtttgaattttgattttcttctcccaattttgtgtcaatttccgatggcattttgtttgaattttgattttcttctcccaattttgtgtcaatttccgatggcattttgtttgaattttgattttcttctcccaattttatgccaattttcgatggcattttgtttgaattttgattttcttctcccaattttgtgtcaatttccgatggcattttgtttggctttggctttttctttcccttttttttctttttatcttttccctcattattctcctccgaattcacatattttagtgcttcgtccacgtcataagtttctgtttggtcggcttcttcttcatctttcttcaatttcttttcattttttgtttctttttcttccgaataattttctttatttttttcattaaaattttcattttcatttttggcattttcttccaaatttgcaaatttttctttgcatttttcggcgtgatcatagatttcgctgacattttctgctccgcccacaattgtaccaattcgcattatattatccattgctccttaatcagcaattttattaggtaattgcttaaacagcttgatgcttagcagaataatttcattattatgcctttaattttttatttgatggtattattttttggaaattaaagttccttttttttgtccaccattaatcagcagagaaatagcatttttaggcaaaaaaatcgcaaaaaaaaatattaaaggaacaatacgcaaataagaggatgttttagaaacaaaaacacacacaaaaaaaaacaacttaattttggttatatgtactcaattaacgaaaataaatattgtaaacgaagatttaattatgtacaatattcttcgatttgcacaatttttaaaaccaaaaaatttgccaacaaaaagtaaattaaatttaagggaatgcatttttgagaaaatttttcaattctt

SEQ ID NO: 43118 - DNA, 967 bp, Heterodera glycines
tttttgatttatattaacgatcttctgatgcttgcctttcaggagtaagaattaaattatatgctgatgatgttaaattgtatatttgttataaagcaagaaccgaaacagaaattatgcataaagcattgcataatttatcggaatgggcaaataaatggcagatcagaatctcaattaaaaaaacttttgtacttcatttggggaataaaaaccccaaagaaatatataaaattggtggaaatataataaatgtcgtggatacaattagggattcgggcataaatattgataataaattgcaattttccaatcatgtcacacaaataataaagaatgcatatttacgtatgcgctctttatttcgggttattaaatcaaaatcttctaggatttggattagtcggcacgaaatgaccaattagtggccaaagcggaactgttggccagaatacgaaggtgcatagtgttttttttgtccaataaaaattttaaaaaatggaattttatatttcttttaagatttacagcgcggacgaaggcacaaaatcggatggcacgggcagcgggcgtacgacacgctgtgcagcttctacaagttggcggagagcaaaatcaaccaggcctatgttgaggaggtgggtcggccggggaccggattacccaaaagtacagacgccagtccgggcggtgggttgttcaaaaacatatttttgataaatttctacgtttgaaattgtttaaaaaaattttagttgggtgagagacacaattttttaatgaaaaatccttttttttgtgttctttaattatagaataatccccaaattttaatcaatttgcttatattatatcaatcattttgttggcacagtcactgatgtgttgatgcacatgatcatcctgctcaatgacaaaaacgactgacgagtccgtgccgcattcttcgaggcgagcccgatgctag

SEQ ID NO: 43119 - DNA, 935 bp, Heterodera glycines
agattcatctgctattacattacaatttctatttctcatttgttctaaacgcatccgtctttgtgctacagattcatctgctattgcattacaatttctatttctcatctgttctaagcgcacatttctggattcttgtgacttattctgccatctaatcctatctctctctcttttctttcgcaaattctcaagtctcctatcttcaaattgactgtcagtcatacgggatgaccccgcaacctcagcatccaaattcattgatccctgactgggaccaccatccacaaatctttgtctcttagcatagttatgctcttcaaacacatcataattcctaatatttctttcattttcttgatctaaaatctcaacacattcttccatttcatcaaaatctaaatcataaacataatcataatctcgaacataatctaaatcgtttattgaagccataataataaatacctaaaaattaatttaaaataaaaaaagttgaagatatttgaaatgaaaatcagatgaataaaattcataacataaaatttattatttatttaaaattttactatttacgatcagttaaccaataacaaaatcattattcttttgaagagatccaatggtcagcccagtcagtacacacttcattgcttaaataattatatttggttaattttaacatattgcaaagaaatttcataatgaagtcatagaacaaactctaatgtttatcaaaaaaatgacacacattattgtgtcacactaaagtcacagaacaaacactattgttttatcaaaaacataagacacattattgtgtcacactaaattcatagaacaaacactattgttttatcaaaaacataagacacattattgtgtcacactaaagtcacagaacaaaccactaatgttttatcaaaagcatgaca

SEQ ID NO: 43120 - DNA, 970 bp, Heterodera glycines
  misc_feature (886)..(886): n is a, c, g, or t
  misc_feature (914)..(914): n is a, c, g, or t
tctagagtcaatggcttgggcaacagttgggcgccaaaacacaaacagacctcccgtgaaaacaaaaccatcgccaggaagggccaatttttcatatcgtaattcattttttgattttggtattcattttttgcgacaaaagaattccaaatttatttactgtaactaaagtcaatattcaagaatcttttgttctggataaattctcacacttgaatcaatttgtcatttaattttccaatttatcctttttaaatattttttggcatttgtcaaattagaattttcagaacttttttaaaagatttatttaaatactgaaaatcttttatttttcctcaacaaattatgccgaaggcagcaggtgaattttgtggtcttgttccccgttgtcttttgtcttaatatgccccccccccctttcgtggtaaaaacagtcggtccatagacagaaaaagcggcaggtgtctgctgatgaatgagcgtgtaaaagttgtggcacccctggcaaaacaaaagcaatgcttcctccctttttccaccaattaccaaccattccactgcttctccccacccccatttgttaatgtgccaatgcgcgaaaaatgagcaggttaaaaaattcccccggcacggcacggcttttcgttgtcccatttaatcacacaatgaatgaatgccccggtgcgcggaaaaaggtgttaattaatttgtctgcttccataaccgacactttgccgcccaaccttttcttttctcccccttttacacatctacaatttcctccgacggcacttcaaatggaataataatttttcccgttggcgtcaaatattttttcagtgcctttttcaccgtcttaaaactaaggacagttttcctgtcncaattttttgctgtttttgtattgtgtnaaatgaattaatggaattaaaaaagcaatttcagaatttgcatttcttaaattact

SEQ ID NO: 43121 - DNA, 1283 bp, Heterodera glycines
  misc_feature (122)..(124): n is a, c, g, or t
  misc_feature (203)..(203): n is a, c, g, or t
agagaaacaaataaaatttattttcatttacataaatcaactgatttggcctaattaattttaaaatataaattaaaaaaagagaaatcaataaaattaattcaaaatgtatgcaaacaacnnnccaacagatggtactattacactgcattgaatacgacgagagattaaaaaaattagcaataataaataatttaaacatntaaaaaagccgaatttaaaagaaatgaaaagggcattttttaaaacaaattaaattaaatatatttcccttaagatcgatgtatatatgctagagtagagcgggaccgggaccaaaacacggacaactgagtacaactgagtaccgaggtcccggttttgaccgggaccagtcccggggtttttcccgtttttcccagccaaaaattcccggtttttcaacccgaataggtcccggtcccggttaagcccaaaattcccgatcccgctctactctaatatatgcataatattatttattgtttatctaaaaaatggaaaaatatgtccgatgaaaattgtgaaagaattgcaaacatccaatttaaattggttaaaaatattagatcacaataattgattacatataggctgcccccccaaaaaaaaagaaataaagaaattaaataaataaaacaaattaattttttagctcaacagaataaatttaaaaatatatctcttgtcgacgtgaacttcttgtaaaccacaacatgaaataaaacaacagatcttaattttataagaatttaagttttaaattctatttaaatttccattaatttaggtattaaaattaaaagaatataaaatttgaaaatgacagaaatattagccaaagtatggaataaaatatgctcagtgtcattaattgtttatctaaaaaagagaaaaaatatgtgaggcgaaatttgcgtaagaattgggaaaataaaaaaatttaaatcgattaaaattaaaaaattcagtaaattacaatgaaaaaacagcaacaaaggaacaattaattaattcaacatataaaaaagtatatttaaaacaccatatgaaatcaccacgagagattaaaaaaattagcaatgaaaaatatgtaaagtgaaatttgtggaagaattagaaaaatcaaattaaaacgtttaaaattttatatcactgtaattagttacataaacactgccctcataaaatgtaaataagttggagagaattaattatgcaaatgacataagaattgataattatttatgtttaatattttattt

SEQ ID NO: 43122 - DNA, 1732 bp, Heterodera glycines
gttgggtttggatgagttgggtttacccctaaattatataatttttaattgctgccacttgaaatatttgacaaaaatttattgcatttttaagggcacattttccatggaattgttgtcgtcaaaaataggaaaagaaatgcgcagatacacaaaaaaattgttgaattttcaaaaccatttgaatttatgggattttgatggcaaattaaataaattggttaaaaaaatatgctgagaaatccaataaaataatgatggcattattaaagacttttcttgtgctttccggtcttcaaatgctttgtccaatccgatgatttattggtcgaatattcacactgaggacactggaaaaaagggcaaaataaatgtttatacctaatttaataaaatggggacatttccgtctctgaaaaatcaaaaaaaaattcttaaaaaaataattgaaaaaattatttaatttaaagatagatataaaggaaattgttcataaaagaaaaaacaggtgaagaccatattttcgggattttcttgaaaagttcaaaaagattttcctgatttttttttatttaaaaaaacttttaaagggcatgaaagtttctttgaataaaccaataaataaacgaacatgaaaccgcttcatgtcactgtgcgtgtatcggtgtgccgaaagtgaagagtgttgaccaaacgtggcatggcactgatcacactgttgtacaaacaaataaaaattataaaatatagtaatatttatcaggcgtaacgcatccagaaaaacaaaataatgggatgggtaaacccgaattttccgacaaaaattgctattttgtgtcagatttttaaaaattttgaattttgttgctctacggttaaccgattttgatgaatgttaagttagttaaaaatttaaaaaacatatatagataatctaaatattaactagttactcaagaactcgactcgattgtcaaattgctcctcaaatgaaaaattttgatcagtagggcacttaagaattgatcataagcgtaattaaaattaatcaccagggcacttaagaattgatcacaagcgtaattaaaattaatcaccagggcaattaagaattgatcacaagcgtaattaaaattaatcaccagggcacttaagaattgatcacaagcgtaattaaaattaatcaccagggcacttaagaattgatcacaagcgtaattaaaattaatcaccagggcaattaagaattgatcacaagcgtaattaaaaagcaaccaagcactgatcaacaatcgattgtcaaattgcctctctaattaagcattttgatcgcagcatcgcttaatcacctgataaggccgttcgcccgtgtgcttgcgcttgtgcttgttcaagtcgcccccgtaagcagttgcatatgcacagccgggccaatcgcagtgaaaacgcaactcgcgcttcagtttggccgatcgcgacgatgagcccaccttggaatcgtcgtcagctgctgacgacgaaccaatacctagaaaaacagaaaaaaatgctaacaaatataagaatttttttttaatataaaattgaatatttttaaaattttaagcaattgaaaatcaaaaaatgtcctgaattttcagattgtcctgaattttgaggtctctgataaaattaaaaaaagggcgatatgttgtaataaaaatcattaaaaatttcaaaaaaaatttcccgg

SEQ ID NO: 43123 - DNA, 1147 bp, Heterodera glycines
  misc_feature (3)..(3): n is a, c, g, or t
  misc_feature (11)..(11): n is a, c, g, or t
ccnttgataantctgaaatttaaaaattaaatcgaaattacattgaaattttagtgtaaaaattcaaaaaaaaatttttataccaaggaaatccacatacagacacagatgtgtcgtgcccccggacaccacttcggcggtcgccaacaccgcccggagctcatattggtcgtccggctggtcgggttccgggcggcgtggacggaccttcttcggcgttttgcccttaggaatgcggattgatgggggcggcggctaaaaagaaaagaaatttggaagatatttttaaaaataattattaaaaccatttttataataattttaaaagactatgaaaggttaatatttttaattatttaaatgctatgaaatttaaactttttattaaagcttgcctgttttttgttgaatttgtttttgttgtttttatccctctttttttgtcgtgtgatttcttcggcggaaagtgacgacgacgacggctgaggaacatttgctgctgttgatgatgatgatgagcagccggcaggtggcggcggcgcttaaatttcaaaaaattttaataaaggaaatacaatgaatttataatcaattttaaattttttttattaattttttaaaaattaaactcacgaattgcaagtgccggaaccgcttcctcctccgctgcacgccgttgtgcactgcgcgtgaccattgtcaatgcggtggatgatgtagagcagccggtatttcggctggcgatgacttttgctgctgttgttgttgaagttgtggcatttggttcggcgacgacttcggcatttgatggtggcattggcaacggcaaaccatcttcaatttgtgatggtggtggtggtggcggcgcttaaattgtcaaaaaataaataaaggaaatgtaatggattataattaattttaaaatttatttaattttttaaattaaactcacgatttgcaagtggacctcttcgaaagcccatttgtctctttgccggcggcaccgcgtcctccgctgcttcacgtcgttgtgcactgcgcgtgaccttcaaaagttgagccaatgtctggagaaaacaggaattatttttgaaaatctcaggattttattttactctttttgggggcatgatgcgacaacaattgg

SEQ ID NO: 43124 - DNA, 601 bp, Heterodera glycines
ttgattttcataaatctacatgccattcttttatttttaaatccattaaaatattttttaagaatgaatacatcaatctggaaaatatgtctatttgaaaaatcaaaggatggcaaaagggcggagtgccgagaatgtaaagaaaatgcaaggcccaagtatgaatttatggagtcgggggcgtttgggcccccgcgtttgagcccccgcgtttggagcctcacgatcgggacctcgttcgtgcgacctcgggcctcaaatacctgaatgatatgccgctaacgactgacaaaggacaacctaaaaatttttcagagggagcattctccctcatcattttgcgtcatttacttgtgcttcaccatcctcagtcttattttgccgcctgcgttgcacaacccgacgtcgcatctcacctttggtggcccctcccccattgaccgttgccattatattggcgatctgcgttgctaattcattaacggtggccaaatagtcgaaatggagagaggtgagccaatttccctacgtacctgctgggcagacacaaaaaagacacgccattctctcgcgtcgaaggcagaagcgagcgacaggggag

SEQ ID NO: 43125 - DNA, 909 bp, Heterodera glycines
aggattcggtctccccataaatctgggcgcatcggtcctgggggactgccccgaaaacaaaaaaatcgattttttcaagtgtccgtttggggtactcaaacaattatggggagcaaaaatccaacgcagaattaaagtacaggctatagggaagctattccggaaagattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaacccaaaaaaaattttttggataaaatttatt

SEQ ID NO: 43126 - DNA, 990 bp, Heterodera glycines
  misc_feature (892)..(892): n is a, c, g, or t
atttttgttggattttggctcacggtgaattttaatcttttaaatttcgctaatgcaaaaaaacaaaacttaataggcatcccaccgattatctatttggtgtccaacaaaactgttcgtcatgatgtgtacagcatgtttattcgtggacttgatatggtattcccatgtattaccgtaccacctcaactctctgggccagcagcaggcgcggtcattcgcgttgtgccaatctcttcaccgtttaattgaagttcaaaaatgcgaaaaataatagaatttgaattgaatgatgatgagtagggaacggattttgttcggagaaaatgggtttttcgtgcttctctcatcaagtactatccgcaaaaaaaaaaaaggttaaaacctaaaaacccgttccctattgatgaggaataaaccggcacatcacataaaaatttactaaattccaaataaattgcaaatacaagaaatttaaaaatatattttcattttcgatattgaagatttgtccccattttctactacatcaatgtataatttataggataagtactaactttttttatatttttggtatactatcatttaatttttcatatccactaatataatataataaatgagatgaggctccgccccttggattaaatggtaaacaaaaaattaactaggtatatgaaagttagagccaaaattataatcaaaattaaacagaaaaacagaaatatttgcatttttccgcgattatattcccaaatatgaatttatattatattttttcaaatctatccaaattattagttttagtccattaaaagcttttttattcacatggaaaaatcacaattctactgaattttcggaaaaaatctccaatccaatttattanaaataatgatgatttttcttcactactgatcacttttatttaaagagaaattttttcattaaataaatttaattaaaaaaaggaaaaaaacttacttt

SEQ ID NO: 43127 - DNA, 1054 bp, Heterodera glycines
  misc_feature (32)..(32): n is a, c, g, or t
  misc_feature (107)..(107): n is a, c, g, or t
  misc_feature (121)..(121): n is a, c, g, or t
  misc_feature (1027)..(1028): n is a, c, g, or t
taatcaaaatgttattgctcacagttccttcncgaccttctgacaaaggaagaaatgctcggcatttaccaattccattgccatccgccgaattcgcccggggcatntcagctgaaattcncaagccaaggacgcatttgtgatcggaatgaatacactcttttgctggacattgagaagttttctgaatttgctcgagagaattttgggagtgaacggagcagcgaaacggtgcatatagagggactctcgtggaaaatattggcacaaaaaattaaaaatgactttggcgttttcctttgctgcaccgcttcaaaagaaggtaaaaaaatgctcattaaatgtaattaaatttaattaaaaataagacacgaattggagttacaaatgttcggcaacccttcgaattgtctctcaaaagaatgagacggaacattacacttggaaattcattgaccacatttttaacagtaaatcaagtcacttggctttccccgctttattttcatttgtggtgagtgtcgaccaatggaatttcgttttttcagttaaatttggagctgttatttgttttcttgatatcatctttcctcaatataagccccttttgagggagcttgaaagattggagcccccggcggaaacctatttaaatagttaccggacaagtggttcgatcggttttaccgataaaaaaaccgaataaacaagatcgatcgtaccggtcctctaattttaagactataaaatcggtatcttggatctgatcatatcattggtacaggataatctttattttaataaattaaattcagcgattgatggatccgagcaaaggacttcacaacaaaattgcggacaaagtcacattggccattgacatcactgaagtggagaaattggattcgaatccaaacaaacccaacgggacaattgtaatggaaattgacagattgtcgaactttgcgcaaaggttttgtgggagtgtatggagcagcaatgcagttttcattggaggattccatgnnaaataatgcaaaaaacacgacaatgc

SEQ ID NO: 43128 - DNA, 972 bp, Heterodera glycines
ggggaccagagcgtttgggcccccgtttttgggccccggggtcgtttgggcccccgtttttgggccccggggtcgtttgggcccccgtttttgggccccggggtcgtttgggccccaacccaaaaatagaaaaatgtgctttttaaaaaattaagattctaaaaactaagcctgagggatccctcgccacttggcataagttaggtttaattaacattcgctcattttttacaattttacttattccaaatcctattattttttaatagttaaccaatttgatgtacattcagatttggacatttttcagaaatggctaaccaattgcaaccaaaaaacaaaaagtaaaattgtcttacgaacgccacctttacaccttcgctaaaatgagttctgatgggatgacaaaattttggagatgcgagttcaaaaaatcaatttcacattattttggagtttctccggggaatttctcgcaactatcgaatgaacccgtgattttttgttttattgtccaaattaccttatgaacccgtgaatttctgttaatttttacattttttattgttaaaattattgttgaatttatttttaaaatgtttattttacatttttatgctggaatttaaaaagttgtttttactgtgatttttcatttttctgtacttggggcccaaacgaccctggggcccaaaaacgagggcccaaaaacgggggcccaacgcccccgactcgactctgccagtgtaaataagtttttttttatttagtaatcagaacgccagaactttgcaaaacataaaattttttggggattttcccttgtaaaaacgcaagagccgatctcgagttaaaaagcattttgacaaataagcaaaggaggacttgaaccttggaccccctttttggtgactaactcacagatcactccaacgaaaaatccaacttatttacactgggagcccaaaattg

SEQ ID NO: 43129 - DNA, 1264 bp, Heterodera glycines
  misc_feature (36)..(36): n is a, c, g, or t
tatataaaaacatgacgaatgcatgtcgaatagacnacatacatgtattaatgcttttatgtgatacgcgtgggaatattaatatcatgaagatgtgactaatgcgcgaattaaatttaaataattgttaatatatttttaaacttattttatttatttattttttatttttttattattactattttttaattgtattaagcatatctaatttgtataaatgaatattattgctatttatttatttttttattttttttttgaaatgcaattatggtgtgaatttgtgaaatgcaattatggtgtgaaatacgataaatgtactaacataataaatagtaataaaaacgtaggcacactcaaacataacacgtaaatgtgaggcaataaatgaacccctcagggtgggactgatcaaaagaaatgatcgaaaaggagactgatcaaaatgaatttggggcgacttgatcaaaataaaatgggaggtgggactgatcagaagcaatggcagaaaaaggattgatcaaaagaaatgaccgatttgatcaaagaaatagggagggaatgggactgatcacataatatggcgaaaaaggaaactgattaaataaatttggccaatttgatcaaaagtaatggggaatggcactgagcaaaaagaaaacgcgcttatttgatcaaaagagaaaaaatgggggaatatatgatcactgaaaatgtcggaagacaatgatcagaagcaatgagggagggatgagactgagcaattgaaatggccaaatttgatcagtgaaaatgggtgagggatggtactgatcaaaagaaaatggccgtaaaggagattgatcaaaataaatgggccatgatcaaaagaaaatggagggggtgggagactgatcggaagaaagagaaatgggactgaccaatagaattgggaccattgattaaataaaatgggggaagtgtgaacaataattgggcccctcagggtgggcctgatcagaagaaatgcccgaataggaggctgattaaaagaaatgtggcacattccatcaaaagaaaatgggctgggtttgatcagaatgggagaaaggcactgattaatgcgcaatttgatcaatgaagaatgggtaggatggaactgatcagaagaaatggccactttgatcaaagaaaatgggtgaggattgaccaaaataatttgcgcagtttgatcaaaaaatgaggatgaacaacagaagtggggcaatggtgcctgatcaat

SEQ ID NO: 43130 - DNA, 767 bp, Heterodera glycines
tgagacgaaaccatgttcagtttaatttctggttttccacagttgttctgattagacaaaagtattgagccaaaccagaaactgttcagtttaatttctggttttccaccgttgttctggttaacaaagaaatgagccaaaccagaaactgttcaatttaatttctggttttccaccgttgttctgattagacaaaagaaaagacaaaaccagaaacatgaccagaaaaacaaccataaagttaccaatacaaaacaaatgagacgaaaccatgttcagtttaatttctggttttccacagttgttctgattagacaaaagaaaagacaaaaccagaaactgaccagaaaaacaaccataaagttaccaatacaaaacaaatgagacgaaaccatgttcagtttaatttctggttttccacagttgttctggttagacaaaagaaatgagccaaaaccagaaacatgaccagaaaaacatctggcatcaagttgttctaataccaaacaaatgagacgaaaccaactgttcagtttaatttctggttttccaccgttgttctggttaacaaagaaatgagccaaaccagaaactgttcaatttaatttctggttttccacagttgttctgattagacaaaagataagacaaaaccagaaacatgaccagaaaaacaaccataaagttagcaatacaaaacaaatgagacgaaaccatgttcagtttaatttctggttttcacaggtgttctgattagataaaagaaa

SEQ ID NO: 43131 - DNA, 1468 bp, Heterodera glycines
ttatatagaaaaaaaaatgcaaaattggaaaattttccctcacctttaggggttaatgaggccgtttatgcagggggtccctctaatagattatatttgaaaataccaaaatatgtataaagaaatgtgtccgtaagctaaaattacaataaaaaatgtaccgaaaatgcatcccccaaaaatgaacaaattattccgatggattgcggcggtggcgccggaatttggccgcaaaatgaaatcggattcgcactgaactttaaacctgcaaacggaaaaaaaaatttgcataaatcattaaaatacataacacaactcaccagacattacttcgggcacccaaaagagcaaaagggaaaatgtacagccaattgcaatcctaaaaaggtgggagaaacgtattcgaataaagaaaaaagggtaaaactgcagaaaggcggtcccaccggaaaacaaagttaaaatttctgtagaaaaacgcctagaccaaaaacaaaacatatttatataatggaggggagccgaacccaaaccatcaaaactaaaaaatgcactcccccaaaaaagtttttgtcaaccaaaattatttaagcgtttgaaacgcacccaaaaaatgattcacttgatgaaattatatggaaattcaatgatctaggaaatcatagctcaaattcatgaccaacgcattttctacactagtcaaactgtaaagaaattaaaatttgtttccgatggaatcgcaattttgcagcattgcgtgaaaaagaacccacgcggtaataaatgtccctttcgtcgtaacaatagccgccccagcagagcaaacagcctcaaagttattaacaaattcaaaaggaaaaagcaaaggcgggtggattaggcacctcggtattcgacacaaatgtgcccagccacgggggtcagagattcagtcgtatcaatctaaaaaacaaaaataaggaaaagagttagcaaattgtgagataatttaagggaaatacaggaaatatgaggaaaatgaacaaaggtgacctcaaagttgagctgattattttcttcgaagaaactttgcgtatttgcttgagaactttctggttcaatgtgtaaaatgtgggaatccatttggacatcttaaaaattagctgaaattacatttacgtaaattaaatacgaaaaagcaaatcctaaaaaataaaaaaataataatgctgataaaagggaattttggcataatatactaattaattttaaactttttattggacatttatacttgaacgttttttagtgtttcaaatttatggcctgtaattttgttacagactgtacaaaccctatattttatgtttttttggtcaagggttatgaaatggccggccgagataaaggctataattgtgttcagcgtaccagaaaattaaaaaaggccaagaaaaaccaggacctagtcattgtcccgaccaatgga

SEQ ID NO: 43132 - DNA, 1040 bp, Heterodera glycines
ccaaaactttgggtttttggggggtattactggcgcaagctagctgcaactacaatggcatatgggcgattaggtagaccttacaatgttaatgtggccgcacatttctacgttcggcatcgtattaaacttcgccatccatttcttcattgtgtcatcgaacgctttcctgaaggacaagaggatcgtttttatcctcttgagttatgcaaaattgaggaagttgatgaatcaaaatggcttggtcagattttcaccgagattaacaacaacaatttagtgcaactaattcaacaaattttgctgacactcaaacttcaaatgatgattcgaaaagtgttgatgggcgcgatgaatgtagccaaaatgattgctactctttgtggtagattaagcttttttccattttgtatcttctctctcttaattttgccatttttcacccaaaattgacctcttctattccttaatatttttcaatttatatttccatttaaataaatttttcttttttcaactttatgcaacgaatcaatgagtggaataaccaaaatcaagcacgcgaaaatcacgagagcaaacaatccctttgccaacatatggtttatatattttttgaagtggtgcggaggtgacattcccatcttttacaatggggcgtaggaaatgaggatacaatactttgattggtggtgattttccggtacgtacaaattctaagacgcgagttttgaaagtgtcgtaacaaagcccctgatttttggtcacatcataatttagggttatccctctaagtttgagcacgtagtcaaactcattttcgctgcccttcttccgaagcttcagaccatattgctttgctccaccacttataaattccaaaatgtcatgctgaatttaaatttatttctttaaatcaaaaatcattacctttggaaatcatccgtaactcacccagtgaggacccgtcttcaaaggatttgcgccttttgggttgacataaatcaccgaatccgtatcttaaaaaatttaattttttc

SEQ ID NO: 43133 - DNA, 1190 bp, Heterodera glycines
aaatttgggacaaaactctgggcggaggcagctctgtcgcgctggtcagatcagatgagatggctctttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaaactcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaggagctgctcaatcgttagattctcgctccgcacattgacacgtgtgatgaagtcaa

SEQ ID NO: 43134 - DNA, 1154 bp, Heterodera glycines
cgttattagcaaattccattcagcaggcgtcgtcccactttccaaaggaacggcgtccatttggcctttttcgtcgccccttcgggcgtcttccgcttccgcaaccattctctcggggaccgtcttctctatgaatcgccccacccctccagcgacgaaggggggcaaagcaatcggtggaattgactatttctaataattattgctaattgatgatgtcattaaacacaatgttaattatttaatttttattcgaagtgtctacaaacactttctgttggagctgtttccaaacgccgcggaggctgactttttccatcgctcagttcggcaaccgtccgaccagataactttcgacttcaaccgagaaagtgccatccttccctttttcatttaaattgtttttttttcattagcccgtctttggcagggctatggccgaaagacggcctatggccatgccgagaatgaatctctgttggcattggcctacaaaacggtgcgcgtcgacggagcagtggcgggagttgcgggcattgaggtgcggagactgctaacgatgcccccaaatgtgtcaccaatttgctcatttttaagttcctttacgatacgctcgtcgcccaaatgcgccacatcggctgtatgtccgccgatgtgagtttcttctcagtccttccattcatcacccttttctgatcacttattcatcgactttcgcttttctgatcactccctttggcagagtgatcgctcccgttgctatttgctcgatgagcatggctacgtgttgttctccaggtactgccccacaatacgcttctgccacaattccttcactcatttagcagtcattccactcgctattccgactttgtccatcagaacattgtccttcctcaaattgcgtttgtgacggcacaaaatatgacactttcggggcgaaaaagaaaggggcaaaaagcattcattgcgagtcgaacggcacaacagcagcaggagcaggaacagcaagaacaatgggacaccgccggaggggcgttggagttgggacgcttttttgggcaactgaacagagtgacagagtggacgatggaactcctgctgaggaaaggcctttacaagaggtaacaacaacattcgaaagccgaacttta

SEQ ID NO: 43135 - DNA, 1056 bp, Heterodera glycines
  misc_feature (939)..(939): n is a, c, g, or t
  misc_feature (1003)..(1003): n is a, c, g, or t
tatctcttatgtttgagaaattttatacgttacaaaagccctctcagggtgagagggagggcggtgcgcaatcgccatttactttctcagagaatttttaaatttatcttatatccaagaaaaatgactatctcttcttttagaaattttatacgttacaaaagcgctcgagcgtgagagggagggcggtgcgcaatcgccatttaatttctcagagaatttttaaatttatcttatatccaagaaaaatgactatctcttattttgataaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggnagggcggtgcgcaatcgccatttaatttctcagagaatttttaaatttatcttatatccaaganaaatgactatctcttattttgagaaattttatacgtttacaaagcgctcgagc

SEQ ID NO: 43136 - DNA, 1228 bp, Heterodera glycines
  misc_feature (1214)..(1214): n is a, c, g, or t
ttcaatagacaatccttattaaatttatttttttttcctttaagctttttgttaaaattaaaccaatccatttttgaaataatttaaatagttaattatttaaaataggttttattaagagataagacgatttttacaaattgaaataacaatttttggataattttttgacctagtacacacacaattcgattaaacttttcaataatttaatttttaataataaatttcagggcaaattttatatatttattaaaaaaattttacccctaaagtgattaaagaaattacacattaaattataattttcaaataaaaaaattaaaatttcaaatatacaagatgacaaataatcctctaataatttatcattttaaccagtctttagtctcactttttaaaaaaagtaaaatttgagaaataaaaatttattctaaataattattttcactgaccaaacgcgttttatgaaaataaatgaaattaaataaaattgtttatgacttcagtaagaaagaatatttttcttaaagaattgaataaagaaattaatttaaaatgataaaccttcgtaaacaaattattattattaatataaaccaataacaattaaagcaatttgaaatgttaaaataaacgacgacaaacaattttgagtatcaaataagaaaaaaggagacttcggttctgttgcgaaaagctcaaaataaatttcgttaaatctaatttcacccactccatttcctccccactatctgcgactttttagtcagaattttttagtgtcgttgatttgattttttaaaaattactgtagaagtaattaaaattaattttttcattataatttattaaaaatcagcatctcaaaaaaaaaatctgcttttacccttgaatcagcaaaataatgataaatctgcagaaagcctgctggataattgtaaattttcataaatttatgcattaaaaattataaaaattcagttatttagaaatttgaaaatttacgtcaaaaattttgatattttaaaagttttacaaaggttttttaaagatttgtattgtttttgcgtttggatatgcgttggatgaaaagaagtgaaatgcaaaataacctgagatttaaaagaataaagaagaaaatagttggatttgacacttctttcgttcaattttcgttcgtcggaaacactttttaattttagcccagcganagaattctgagaaa

SEQ ID NO: 43137 - DNA, 1074 bp, Heterodera glycines
  misc_feature (81)..(81): n is a, c, g, or t
  misc_feature (98)..(98): n is a, c, g, or t
  misc_feature (127)..(127): n is a, c, g, or t
  misc_feature (1039)..(1039): n is a, c, g, or t
  misc_feature (1064)..(1064): n is a, c, g, or t
ggatttccaaattttgagaccgaaacgtttgctataaaggtatgatttcctttcttttttttcctgcaaaatatgaataangaaaggagctcaaaatntagggtattttttgatagataaaaatatntaatcataaatactgggcaattagcttctaagaaccatatcggttttacccaagttcaggcacttttggtgctggaattccgcggtgaagattccggtaaaattcaaatgttagatttttaagatgtgcttcaaaaaaaaaattaattgatgccaaaatttggcgaaaaaaaatgtcctcatctaagcgccaacgccgttcattctagacagtccaagtttaggcgacacgcctacaaacattcacaacacaacgtagctggaaaatttttctttgaaatggacggcacatgtattaaatgcggcactctcttaaagggtttgattacccctaaataaggggaaataagagtgattactagttcgcctagttcgcctacttagctcagttggaagagcgcggcaccgattgctggggtcgcgggttccccaccgcgggttggtattttactaatcctcacaaagaacacgacgctcaagaatccaaatgaatgtcataatattgtttttataaaatcttttccatattaaaaaaaaatacatttggcacacattgctttagactcttctaaaagtcaagaatttatcaaaaaaaaatattttgaaaaattgggcagttttatcggcttttcattccaaattttggattcttcattccttcgacattcttccaatgtaattgttcacaaaactggacaaatacagaaaatcgcctccatcatcatcaacctaattaaatgatttccatgagattgaaaaaaattttttgagacctccgaaatgtgtgaaatcactgatccctcggggtcgtgccaagagcgcaaaatcatgccgttcaaatccaattgtaacacaatgccatgcgtcgatccgacaacaaaacgctgcaggacgttgtcaggcagaattttcnaaagctgaaaataggctaagtttcnaatgcttaat

SEQ ID NO: 43138 - DNA, 1085 bp, Heterodera glycines
atcattgggaaagctctaagtgtcctttattagcctgccctcctaagaaaatttagtttaggttcaaaaaagttatggccccaagaattcaaaaaaccaaattttccaacttttttggccataaattggttcaaaattaacaaaaatttttggaattttgcaggctagtagagcatctgaagagctttcgattacgccaaaaagagaaatattcccttccttggccgcttccttttatcgtttttccctttcctctacttattttttcttggttgaaattcataattacggtttataacggaattctgtcgcgtccaatttctccgagttggacgcggtcatccatttcttggaggagttgcggccagacacggcaagtgaaccgaacagtgatttaatggcatttacccgtgacgagagtgatcagactgtgttacggtgctgatcagcccttaaataatcctaaaaaaaccggtagaaacccgagagaaattccgaaatctcgagacttgagcagcacttttttgttcaaaaggcaatttccctattggcccttctcattccgattattttgctggccacaactttgaacccgctttaccaacacatccatccctacctcaaatagtcagtctcgaaattttaatagtgaataagtattttaaattaaaaaagcaaaaatttaaatcgaaaatttgctgctgccttttgttgtcagctattgtatccacgccaactaacgttaattgtttcaaaatatgtttttaaatttaaatttgttcattcagtccgctgctgcacaccggcaactcgtcgcccagtcacgacgcgttcgccaccgacatttacgcgatggtcggctcgcagcagcagcaacagtaccatttgctgccaacgcagcagctcaaccacaacaggaacaagcagtacacgacacaacaacaacagcagcaacagttcacctcgccgtacgccacctccaactacggttaccacgaactgacccatccaccggcctacagtatgagcatggtcggcggcggagacgcggggcaacgacgatagacaatggagatgaaccaaca

SEQ ID NO: 43139 - DNA, 1062 bp, Heterodera glycines
tctcttggagaatgaaagtcataagttccccgccttgaggcttaacaaaagctaagaaaaggaacggacgggcgtatggccatggcaaaacattggaatggcagagaagagggaaggacggagggagggcattggctggttactcactcgctctcttattccttcgtcaccctttttctatttgatggaggcggcagtctctctgctgttcttcgacaatcgataagctcagcaaaatttgagagagtaaaaatgcactgaacttttgaagttttcggctaataatgtaataaaaagcgtgcgctcattctccaccaaatggtcagctctttgcgcagttcgcagcttgaagttttggttgagcgtcgcgaatggcaccgcgtcaacgtgtcactcgaggagaccgcgttggtcctttctccgctcggcgatggttttgtcgatttaggcgcgacttcgatagaattgactggtacgaacaattaattaaagttaattaggtaattaaccaaacaaatattccttcgcagatgcactcgcccccaatattggaacatggaatccaaatcccgagaaacgttttgtgcgcattctcaagcaggagaaccaggggttggggataagcattcagggaggcgcggaggggggacgacccattgtgatcaggtgtgttgtgttttcgggaaccgcccagttcggcgccgaccctttcggcgccgttgctaataacttttctcattatcaaccaaattaaatattttcggttccattcgatagctcttaacgttctctattagcctgcaaaatttcaaaaaactttgacagtttacaaaatcagttatttttcaattttttcgatcaaaaatgtattaaatactatatttttagtctcccattattggttttaacaattttggtgagcaaataagcaaatcataaatttcagtacattccggatcaaaaaatcagattttacgaaatttttttgcggtgcatttttaaaaagacttaggggaacaagcggggcgggtggcgccgataggcaccgccgggaaaattttt

SEQ ID NO: 43140 - DNA, 1038 bp, Heterodera glycines
  misc_feature (52)..(52): n is a, c, g, or t
aaatcccgagggccaaaaattgccaaaaaataaagaatttttaaaaaatccnaaaaattatgaaacttaaaatagacatcatattcgtactcagcaccttattttaccccagaaaaatatttttcacactctttttcgaccccaaaaaattttttgaaaatttctagggggcctagctcgaaaatttttgaaaattttacatcatgtagtacaccattcgatagcatttaaaatgctctacaaaaatgttctaagacaatttttcgataaacttaactcctgccgagttataggcccgggactcaaatgtcccgctcaggccaaaaattttttctatttccggaaaaaaaccgaatttttttcaaaaaaattaccaatcgatagagctcgaaaaactatgttttggaagtggtcttcgtttctctgggaaaaatcgttaaaaaatcataaaattaaaaaacacgaaaaccgttttttaggcctaactcgaaaaattttgaaaattttcgaaattttaaaatttggaaaaatcgggcttttaaagctctacaataagtctgctggccaccctgcgcacaggtcaaagcctaatgagttattcgcctggtactgaagtgggaaaaaaaaattaactgagtctccgtgtctgtacaggtccgggatttggtctgatcaaaaaaaaaaaataccggattatagaggacacttctgcggagtgccctcacagcgggcactttttgattcgggttttagaaaaaaagttacgggccctaaactgcaagaaaaagtgagaaatcgctcctcgggactcagttgggcgtcgagaatttttttctatagttttcccagatgcgcctcaaaaagttgtaagacccttccactactttcagacccgtcccattagccgttaaagctcaaattagtttttgaaacgaaactccttgtcaatataacgtatatattacctagcgcgtgcgtgaaccgtcgtgtattttaactgggataaagcgcttcacgctttgggagcttcgctaccta

SEQ ID NO: 43141 - DNA, 1343 bp, Heterodera glycines
gagtcggccatacacataaaataaaaattaagtggggacgggcgttagagacaaccctcaatatcaaaacacacgaaattcatgagctaaagggcttggtcgacacgggaacaaaattagctcgaaaataaatgcgaccggaatgaaaatcaaaaaaagaactcccataaataactaacatttatttaaacaaattatttttaaagtttacaaagaccaatctataaattctcgagtttcgaaaggcgagacaaagacccgcgacttttcttgagtcgagatcaagtctcgaaaatcactaagcaacaataaaaattatttaaacttctgattaacaacacatctatcaataacattgaattttggttgtcggattaatttgttgaggaagtgaacgatggcatcgagtaacaagcatcgatgtacaaatgggcgacttcctcaacaagccctttgtccgggattttggctgccattccataaatcgcagcctttaaaaaaaattaggcaaaatttagcctcatccgccaaatgtggcaccgtttttgaatttgcccctcggtcgggcaacgcggccacttcttcgcaggcttttttaaggtccactaagaaggcgtttagcactccgtcagccgtttgattgtaagtgatacaaaaatgaaggctaaaaaggaaatgcaaacagagaggaaaagcaaaaacaaacgcatcgggcttttgaaggaaattcaaattccagcccattttactcagacagtcgcctaacgcgtgaatgttaaagcgatgtgaagaaaaggccacctttcaatgtaagtctgccataatgcaaatatgggatgatattcaaatattttctgaccacggacacttcaggggttccgacaaggcaaattccggggactttagcgacagcgtcggccaattgtgtggtcttctgcagaattaggtgggctcgtcttgcatattctttttctccgaagtgttggagtgtggcccaagttagcgcaatgttcagacccggccgacttccttaagacggaaaaggcggaggagcattagacaaatggacagcagaaaaggggggatattcagttgccaagaaatttttattattcgaagcggcgaatgttctcaccagaaagtgtcggcgtagcgtaaagtccaccgggccattctgtcgagcaaaagtattgttggtgaagcaaatcatggctacggtagagaattacagaagtacccttcggggcataaccatactcaaagaaaaaaagcgtcaaaattggacaaaagtttggcacacttagtgagtgtcacaggaaattgaagtgacgccgagaaacggt

SEQ ID NO: 43142 - DNA, 916 bp, Heterodera glycines
cctttattcgatgtatcgcctcgatttaattctttttggtataattacacagatattgtctaaaaatgaccaaatttaaggattataaattatgccagaatagtcaatttttatgggtgtttttgtctaaatccagggtttctatctcaaaattttcaaaataagaatagaggccaaaaaataagattttagggtcaaaaataagaacattttgcaaaagacattttaaataatttttctagggtaaaagttatatggagagaagtgaatattatttttcctaataatgaaaatattagatagtacgccaaaaggagagaaaagttagagaaaaaaagtttctctgcactctctctttattgacacatgtctcgttttttgactcggtgtgtaaatattcaatccccattcttctctacactcatcttgaaatcaaattctcatatattggataatcagatcccggaactccgccttttgggtaaaaccgggactgggactttcgggttgaaaaccctggactttttggctacgttttttcagtatcaggtccctgtcccgctctactctattttcataggatcgctgaattgtcaacccttgttctaaaaataaaaatgcccagatttcaaaacatactttggcacttatttagcatattgtgtccattttatttagttagggaagttacaacaaaaatcgaagatgtgggtttcaaaaatttgcattttactttttgttcgatttatgaattaggaatttgtccaaattgatgttcgatttgtgaacaggagaaagttcttactacttgttaacaaaaaattgctcacataaaaggttatatacttaacggaaaatggctccgaatccaataaatgacgcggctgatgagtggttgtacgacaaagaagtcact

SEQ ID NO: 43143 - DNA, 500 bp, Heterodera glycines
gtttttaaaaaattcaaaagcccgtacttcttaaatagcgccttttatcttctaaaaattatgtggccgcaaaactgaacttttcgattcttatacatatttctaacatcagtcattttcctactttggatagtttaatggccattgaaactgtgccgccctttttgctatttttgtacaaaactttctcccccccccaaaaaatgattgggcaaagtaacggcacggccaatgccgcccataaaaaagggtcattgagtcttcttcacttcacacatcggcggacgatggaccgccgccgaccccaaagggcgcacataaaaaattggggaagggattcactcgcatttattcatccctcccctccccccccccccattttttctcctctcggcccgccaaatccgccgccaatcggccgagccgtttcgcaaatcccccgggggatttgacggcgcgaaaaattgagtctgtttgtgggaaggggaaaaagagcgccc

SEQ ID NO: 43144 - DNA, 963 bp, Heterodera glycines
  misc_feature (810)..(810): n is a, c, g, or t
  misc_feature (868)..(868): n is a, c, g, or t
aattaacaccaattaacgcttttttctccccatggcacagcatccaattttattatgggccagtgacgtgccttctgaacaaggaaaatcggtgagtaaatgacgaacgctttccaagcaattagtgattatctgggaaaattcaagccttaactcagcacaactaggaaatcctgaattcactttatcttttttgtactttttttggcaaaataagtttgacaaaatggttaatttattttgaagaatttttttatttaaagtccaatttttcggaattcaaaaagtccgctatcccgtactgatgatcccacaataatgttcggtttcttatattaagaatttctgtgccactatttgtaaaaaaaaaattttaaataggatttttaaaaaagcaaaaaaattttgaatgcgcttccgcgtccgcttttgcgcattttttctgttcgtgctccttccccgctggcttcaacactttcagattgtctgatcccgagcatttcaacttcgatgcccagggaaacaaccgacacagctattttgacaatcggtgtggagcggaaagtatgaaatttcttcattttggcattttgatttcaaatttggaaaaagaaaaattttaaaaagcaattttatttcgactttgctccattattcccttaaaatcaaaaaagcatttaatgccaaacaacaacaggagaaatgactgccaattatttgggcacattttgcggtggcggcggtggcaccactgagacgacaacggcacaactcaaagtgctgaagaaaaagtggcggaagaagaagaanaacaaaagtgccagcggtggtgccaaaaagagcggcaaaaacaaaaatattggcattntgtcctcgtcatcgtcgtcggtggagcagcagccggaagagaacggcaccgtcacaacgccacagcagcaacgacacatggccggcagcatcatt

SEQ ID NO: 43145 - DNA, 814 bp, Heterodera glycines
taacttttttcattgtaaaccaaatccaacaatcttggtatcattgtgaagctcttcacatgcctctattagtcttacaatgtacctatttttaagcatgtgcaaaaagttataaagaaagatttatacttttttattgttgtcgttgttgtaattcgcaatgccataacttttgaaattgtctaatctcgaagcaatagtttagaaatatgtagcttccaaaacatggtaagcttttgcgattgattgataccaagcttgttggattttgtccataactaaaaaaaagttatcgtcataaaaccgccggaacgtcggcgccgccaaaacacgacccacactccaatattcacgtccttttttttgtaccaaaacctcattcaaatgtggttttcttggttccattcaaaagcttagtctcaagaattatttaaaaaaagcaacagacaataagaaaaaacacacacacagtgacaaaactacaaattcaactcttacgaatatactcaagaacgactttttgtctgttgttatgagaacccaaaataagttagacaaaaacttctaaagccaaagacttttcgattgatacccaagatttagataccaaggattaatttttctgtaaatatgtcgtcgtcttctactgaaaaaatacttctttttctgttcgtcattgctcaacgaatcgacgatacggtaaaaggaaggggagggggaataaaaatgaataatttctagcccaaaaatatatggacctttgcttttttagctgttcaatccctcaaattgttccatgtccgaatcatttttt

SEQ ID NO: 43146 - DNA, 1003 bp, Heterodera glycines
  misc_feature (973)..(973): n is a, c, g, or t
cttgaattggctctaaatatttaaaatttcaccagtttttcttttttcatttttttgacttctctaaacattatttttttttttttggcctatttaatcccttgcactttttggcacaatcgtcgcttggccaaaataaaaaaatggtcttttttggtggtctcccctttgggccagaaataacaagttgcccccgggggaatctgtttattccaccagcgccttctgaacttttcccgatgcttttgacatcggtcgctgacacccccgcataaaaaagtgaaaaatgggggggggggagggaagggacggcgaacaccgaattttggcactttttgaggaacggaaaaatgcagaacactcagcgaactgagccgaaggtcagtggcaattattgttggatttttaaaacgaatcgcagactaataaaaaaaaattgccaaatttgcgaaaagacatttgttggattattagctaattcattttaaaaatccatccttagaagtgccggcttttcttctgttattaaatccaaattaaatgatcacagttctcttttgtaggctttggcttatggtaggattatttatgagtgttcactgtgctcaattggccacggatttccattgtccccaagggctaaaatggcggagacataaaagtgccgggtgttcgcctaagatttggccaagataaatggtcggctaatacatcaccaaatgttgcctccaaactttccatttttggctcccatttttcatatttgaattccattttaaaaaataattcatgtacgaaccttttatataaatggtttttttggggttcgaatttgggaacatttaaatttttgcacgaaatatttataaatttcttaaaagttcaaaatttatgttctgaaaataaattaattttgtatatttattttaaattctataaccaaaaaatattattaaaatattttctgacggcngtataaaataatttgtcactgttttttgga

SEQ ID NO: 43147 - DNA, 1095 bp, Heterodera glycines
  misc_feature (1020)..(1020): n is a, c, g, or t
  misc_feature (1027)..(1027): n is a, c, g, or t
  misc_feature (1042)..(1042): n is a, c, g, or t
  misc_feature (1044)..(1044): n is a, c, g, or t
cagaagctatttaatgaattcgaatgttttatcccggttaattagagcaacgaaaattggtttgaatcgtgaagtttatcatttctaactcacttctcaaaaatgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcccggttaattagagcaacgaaaattggtttgaatcgaaaagtttatcatttctaactcatttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaaagcgtgcatgtttggaaagtatcgttcataccaataattgagggtttatttttaaatgaaattttatgataaacattattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgtggacactttcttaaataaattctatactcatgtattttccacttattagataaggcagncttattnctgcatgttctttgncncttcttcaaagaagcctatgccctttattcgttcaaaacagcatctttgtt

SEQ ID NO: 43148 - DNA, 918 bp, Heterodera glycines
gtgcagaaattcacacgggccaaggacgagcagtactacaacaacttggcctatgtaacaattgtacaaataggcatatttgaagaaagctgtgtttacttaaggtggaaaaaccgcaaaaagatttccccggcttggagttggagccggtgcagctgaaggccggccaagtgtccaggtatcaaccggtgcacgagaagttggagacggtcgcgctgagagagttgaaagagaaggaggcaaagaaagaggcggagccgttgccggactgggccagcggagaggtgaagctgggcgagccggttggaaagtgagcgacggaagggatgacaaataaagaaatgcttaaaaatggcatttagaatctcacaaggtcccgagcctgagcgggagccgagcattccgcaccgggaccaggtgaagctgaagacggccaagccgaagccggccaccgaagcgccgccggtagagcacgtgaccattgaggaggaccgagcgaaaatggcctcaatccaacagggccccccaattgagcaagagccatttgtacggatggcatttagcaaataattaattagggtttattatttcgaaatcccatttgaaggtggcgcacaaagaccaagtgcagataaagcagcagttcaaaccgaaggaagtgaaagtgcacgagcagggcaaagtggagggcgcggacaaacagctcaaagacattccgccagtggtcaaagagtgggttttattacttaatggggcaaattcaattaaaacgaatgaaatgtttttcagagagttcgaacggagttcggtgccgaacaaagtgcgttttcatttgtcgatttttgaacatttcaattttttcgttggttttctttaccaatgatgcttttgcgattttaatttatgattcctggttta

SEQ ID NO: 43149 - DNA, 921 bp, Heterodera glycines
  misc_feature (875)..(876): n is a, c, g, or t
aaggcttgacagattgttttgctcgatcgtgggcattaaagagttgacggcccagcttttgtgggcacaacttcttggtggatgtttggtggtgcattgactggcttcgagtcaaagataataagcaataacagttctgtgatgaatgtctgggaatgtacagcacattgcaatattgtgcgtagctacgaggactactcctagtaaagatgcgttatcaaaccatcttgaatacgtccctgccctttttacacaccgcccgtcgctgctcagaactgagctatttcgtgattttcgtggacggttagtgtttcggcttcggctgtgacgcagactggaaacgagttgatcgcaatggcttgatctgggcaaaaaagtcgttgattttatggaaaagagagtggttggcggtaagggttccccgcatgtgaatgtgaattggattgacaggtctgtttagaaagtgccgcgagcaatgtgtacttcttccgttggatttggtatgccgcccagtgctgcacaagtgaaagccaactggtaggctgcttgtgtggtaatgggatggtggcggatcgccttgctttggtgggtttgctgtccggcggaggagacacgttcgtggtgcgaaagaaaagtgcgtccatgcgctcgtacgtgagtaccctgactgcgcagcaggcgaaagcgtatgcttgagtgttatggatggactcaatgttgaactagcgaggcaccaccacatgccccgtctggcgcttgcagacggtcagacccgttcgatgtggtctgacgctggtgatgatacattgttacatacggttcacagtatgtcccgtgaccctcaagtgccgcgagcaatgtgtactttctcccgnnttggatttggtatgcccgtccagtgctgcactagtgaaagccaac

SEQ ID NO: 43150 - DNA, 1033 bp, Heterodera glycines
  misc_feature (122)..(122): n is a, c, g, or t
  misc_feature (246)..(246): n is a, c, g, or t
agatagagactcgatcccgagacagaaaatcgcgagaccgagacccaaaaaattcgagactagagacttttttcaaaaaaaattcctttttcgcttaaaaaccgattaaatttctatagttntaaaaaagcaattttttgaggcttttcataataaatttttggcttttttttaatttgattcaacgaaaaactttcatttctaagtactttcgcgccgtggtttttgagtcaattgggttccggncggtgccgaaaggcggccgcccgggaaaattaaaatttttgaatttttaatgaattttgttctgcccatggactgactaaagtcgtgggttcgattccatccgagttttaacgtttttcccgtttcttactgaatgctggattgactgagctgctctgatcactgattttaaatttatgattttttattatgaatacccgcaattcaattcatcgattgtttacgcaaaatgaatcaatggcattttttgatatttctttttgaatttcaatttcttaatttatttcaatttccttgtccaattaatttctcattctttctccagcaataaatgcttctcaattgagcagaagccctccgttgtccgcattgatcagtccctccccccggcaattctttcgcatcgacggagcagcagcagcgcaattcgcaccattcgggcagaaatgacacgattaattgtataatttcctcccctccctccgcccatttacgctccgacttccccccgccaagcgccggaaatggcaattaatcacagcgactgataggggagggggagggggtgattattttggtgggcagtgaattgggggaaacgccgcccagccaaagaaaagaaaactcgcaattcattcagcagcagcacccttttgactctttgggcggcaatcatttgataacttcttccatttgtttttgtttgttttttcattttcttttgccgggttttctccacaaaatgcacagtctctcctccatttccctctcgtgtgatcatttttta

SEQ ID NO: 43151 - DNA, 1191 bp, Heterodera glycines
  misc_feature (889)..(889): n is a, c, g, or t
  misc_feature (1053)..(1053): n is a, c, g, or t
  misc_feature (1090)..(1090): n is a, c, g, or t
tttaaattaacatttgggtgcgtttcagagcagtttctcattaatatttatgaattaattttgctaaaaaaataaaatactgtagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttanaaaggaattaaaaatttttaaaaattttattcatctcccttttgatagaaaaagcatcagagagccttatttaactttaaattaacatttggtgcgtttcagagcagtttctgaaaaatatttatgaattaattttgctaaaaaaataaaatagtgaagctttnaaaattaataaaaaatttttaattcagaattactggnagtagcatcatagcagtgcttttccttgtcttttgatgctctcgcaaatctggttcgcttctgatcagtttataaaaacaaaagtaaagcctaaaaatttt

SEQ ID NO: 43152 - DNA, 675 bp, Heterodera glycines
gtggggttcggacggtgcgcaacatatacaacggcatgactggcacacccgtgggatgacacaatttaaactacttgcacaacatcccccttcatccttctggattgttatcttttaggcccacgacgatcggcctccccaaagtatgtgccttcaaatggggaagaggcctgatgagacaatgacgcctaacccctctgtgcaaagccgcactccgaacaagttaaactcacaatagagtctgttcggatcacgcctatttatagacgccccttcccccgacaacctcccatatctctttacgacgcacgatgaaatgctccctgaatgcgcattacaacagagctgaggccaactccgacaaaagacagcgccaaatttacaaacatatatcccaaactcacgcttaagcccaagcccacgccatactctaatctatacaagtgaacgagatgactataatggattcggaaccggcaaccatttcttgtcattttaacagcagatacaacaattacttgtatgcctcctaaatacattttttactgttgcacgcctcatgagacatcgccctggtttacgtttctataacatattaataggaaaattcctatgattctaagttatcgaatattcattattctatttatagctttgtttcgtcttccagataat

SEQ ID NO: 43153 - DNA, 1612 bp, Heterodera glycines
ctccccataattgtttgagtaccccaaacggacactcgtaaaaatcgatttttttgttttcggggcagtctccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttattctgcggtggatttttgctccccataattgtttgagtaccccaaacggacacttgaaaaaatcgatttttttgttttacgaacagttttccccgaaccgatgcgcccaaatttatgggagaccgaatcctcccggatagcttcctatagcctgtactttaattctgctgtgggatttttgctccccataaaggtttaagtacccccaaacggacacttgaaaaaatttttatttccttttttaaaagggcccaaaaatttaaacttgggggggaaaggggaaaaactgggttcccccccccgaaaaaaattttaaaaaaaaattttaaaatattttgaggggggtccccccaagattcccccccaaaaatttttggggggtttttttttaaccccctcaaaaaaaagtggggggagtgaaaaaaaaaaaaaaaaaaaaaaaaaaaaaaaaaaaaaaaaaaaaatgtggggggggggggggggggggggggggaaaaaaaagggtggtttccccccccccccaaaaaaaaaaaaaaaaaaaaaaaaaaaaaaattaaataaaaaaaattttttattggggggggggcctccccccccaccccccccccccccccccccacaaaaaaaaaatgttgggggggggggcggcgtctctctctttttccccccccaccacacacacacacaaaaaaggggggggggggtggggggaagaaaaaaaagaaaaaaaaaaaaagaaaaaaaaaaaaaaataaaataatataaaataaaaaaaataaaaaaaaaaaaaataaaaaaaaaaaag

SEQ ID NO: 43154 - DNA, 939 bp, Heterodera glycines
  misc_feature (34)..(34): n is a, c, g, or t
  misc_feature (829)..(829): n is a, c, g, or t
aaagaaaaaataataatttttaaattgaaatatntttctcaggggaattgaacccacacgaaaaataatgaaaggcaaaaggttggtatagccactagaccacgcaaccacaagaaaaaatgctttaaaaaattaataataacttattttttttctcaaaatttctccttgtccgccgatttccttatctacctagtttcatccagacccctctcttattttgacccgaaacgcgaccaaaatcatcgggtcgggtttcgggtcgagaaaaatgtcgggtttcgggtaacccgcggcaaccctgctgtacatatcctttatcgcattttcgtgtcatttgtatctcatatcagctagaaccttttcgtgtaagcaccagagatggcacgcaattctgactttcgaaaaattttggtaaaaggtcggaaattttcggaaatttcactttttgaaaagaacgcaccgcgaaaattcccttccccaaaaatgttctaaaatagtttctgatgaaaatcagtgaataattttttcaagcaagaaccaaattttttaaaatttttggggcctcggaatgccatccctgatgctcctcccttatttgttaggcgcacatacaacagtagtttatcaaaaattttaaattgtgctcgttgggccttgagcaagccattggaaaaaactttttttctttgtcttattgattttatttggatttctcgataatgcaatttgagtagtgaattttttacgaagccgcaaatgtcgtgccgcaatttcccgctttggcttgcgccgcaaaacaaaaaaaaaatgggccgcaaatgcgggntaaccgctgttataaaaccacaaatcattcaccaatcggctcaattgtaaagaaatattattgggttaataagttcataatttgggcttacgagggataaccttgcctca

SEQ ID NO: 43155 - DNA, 188 bp, Heterodera glycines
tctagagtcaaaaaaaaaaaaaaccatttacagctcctaaatgtttacatggtcctctattggaaccattctctttttttcttgttgtttgttttgtttttttgagatggagttttgctctttgttgcccaggctggattgcaatagcacgatctccgctcactgcaacctccacctcccaggttcaa

SEQ ID NO: 43156 - DNA, 796 bp, Heterodera glycines
atttagggatagtattttgtcagggatttaggtcagatggggcatggctggtgtagtgcctctgccggtactaccatggctgtccggacttcccggagatttgtcctacgacgcggaattcgccccagcaggtgcgattggcatcataaaaagaattcgcattattctcccatgcctttaccatgtaattattaaaatttggttggctcttatcaccggaccaaagaggagtgaccgggacagccgggacttcccggtttaccgtgagaggtggacctgccgggcactcccgggacgccaggtcccgagggcccatccggtccaattggactgtttgacctccctggtgtgcgtgtatcttagtttctccgcgggacatttggactacccgtttcacgatgccgtgagctgggaagcaatatttttattacggattgctttttaagtgtattgcccatggccgctgcgatcgaccgtttatcgtcaactgaaataatgttagaatatatagatattttacagactttcattaagcgaatcttgctcaagatgaatctgtctcgacattatttatgatttgacatttaatgcttagggcgatatgatattattttgttgcatcaaattgctttcgattccattcatcattcattctctcctacataccccccagaacgcatataattattccatgacatctatttatcgcatatatgcatttgaagacgatcattgactcgatacactaattggctcgagtacaggaatcgtataggtatattatatttatcgctga

SEQ ID NO: 43157 - DNA, 1375 bp, Heterodera glycines
tttttttccttctctcaccccccccccctttctctctctctgtctctatctttctgtctatctctctccccctctctctctcttccttctctctcactttgtcttcctctcgatctcctatctttctcccctctctcttactccctgtcgctctgtgtcctctctttcctttctccctcttcctctctctcctctcactgtctccccttcatccctcttttattccgctttctcattgatttccctctcgctcgctctctctcttttcctctgttctctcctctctctctctctctttatcctcctcactctctttttcttttctctctctgcctcctttcctctcttatcccctcgccctctaactcacttttcctctcttctctcgctctcaatccctttttctcgcttctcaccccccccctctctctctctctcctcgctctctctctctctctctcctcgctctctctctctctcttccttctctctcactttgtcttcctctcgatgatttccctctcgctctctctctctcttgctctctctctatctctctcttatgcaacgtacgtagcaaggatagcacgaaaatccgatttccgaaattctgtaacaaaaaaagacagaaattttcaaaattttttttgaattttagcctttttgtacaatttcatctgaaataaaaaaggtgaacaaaataatccctttctcaaaaatgttctaaaacaatataaaataacatgaaaaaaggttttgctgaaaatcactgaattttttttcaacctgatataccaaaagcatttttgaaacatcttttacttggttaagaattttaaaatttcctattaaaatgtttaaaattttttgttatattttatatattttaaaaaatttccaacttaacttcagatttcctatgtttttgggatcggaattcgatttacgaaaaatttttgaccccaggaagtatggacttccaaaaatttttggggcccatccctgggtctttaaattttaaaagtcaaatcaatttttaatcccgaatccccaaaattaattcgagcaaaagtcgagtttaaatttacgaacctggcatttttcgtacaaaagggcttaaataatacattatttctttttggaaaaaaaaacgaaatttgaaaaatcgaattcatgttaaaattgatcaaattaaatggtaaactccttgttcaacatgccagaaaaatcccattggaaacatttttttgagtttttcaacttccaaaaaaatttgaaaaaaaaggagggtaaatttaaataatcccaaaattggtgagggaaaaaaattcaaaaaaaagcaaaaaaacaaaaatacccaaattttttaaaatgc

SEQ ID NO: 43158 - DNA, 1046 bp, Heterodera glycines
  misc_feature (994)..(995): n is a, c, g, or t
  misc_feature (1000)..(1000): n is a, c, g, or t
atttcaaaatttcaattttttctagtctatctactcaaaacggttcagaattcgataaaaataacattcacggtgcgaaaaaaggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaatcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcnnaaacngctcagaattcaataaaataaacattcacggtgcggaaaaaagggg

SEQ ID NO: 43159 - DNA, 941 bp, Heterodera glycines
cccttctttgtggactcgaatgcttgtctctgcaacggaacaataaaaaatgggggtaaatattaattatagtcccgaaatttcgaaatttgccacaaaaaaagattttaattgctgtaataaaaagaaaattaagaacgcgcttgccattttttatttaaataaaatcgtcgtgctgagtaatttcttaatttgcgccaaggggtaggaaaacaaacaaaaaaatgtaatcatttattttcataatttgactgaatttcaaccaaattaatttttcatggtaatatttaatagctcattgatcagatcttccaattataacaaataagttcggctaattacgttttaatgacttaaaaattttaaatgactataattctattatatatgtgcaaggcaaaagaggcagcatgaaaatgcttttaatgtttttcagaaaaaactaaattaaattttctttatagaatttgatttgaataatctattaaacattaaaaaatggataaagaataaaaaaatattggtactaaatccattttcactagtgactcagttatcataaccaaaaatgaaagaagaccacaattttgaatttggtgggctattatgattattaatttgacaaaccactgccaaatgactgccagcagcttcgaatgcaattaaaaggccaccatcatatttctcacgcaaatattcgggcaatgatttgccatttggacgatcatttgggctaaacaattctgtgacaccaaatttggcagctaaaagaaattttgaatttttatatttcatttgtttagaaaacagatttacgaacagcataaataaattccagaccaataattataaaaaaattgaaaaaaatatatattttagttttttgacatcattttccacataaattctaaagggattggtaaattattattattttttgg

SEQ ID NO: 43160 - DNA, 990 bp, Heterodera glycines
ctcatacgcaagcgcttttgtgaggtataaaatttctcataaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttcctggaataacctctaaatataaaaatcctctgtgaaataaa

SEQ ID NO: 43161 - DNA, 1019 bp, Heterodera glycines
  misc_feature (56)..(57): n is a, c, g, or t
  misc_feature (61)..(61): n is a, c, g, or t
cgctcataattgggatgtataaaggcgattgtagaaggccttaaatgtgctaaaannggangaggagcaagaggagcggacttacgattttacttacaccatttttttctaggcttagaccacatgcgattttcggcactctgataattttagcgctcataatgggatgtataaaggcgattgtagaaggaattggaagcgctaaaattgtttgaggagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgattttacttacaccattttttgctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttaacgctcataatgggatgtataaaggcgattgtagaaggaattggaagcgctaaaattgtttgaaaagctttttgagcgtaattacgattttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccatttt

SEQ ID NO: 43162 - DNA, 829 bp, Heterodera glycines
ctgctcaacagtaataggaattccaaccgcattctcctcttttttacgccgatactaattgttctggaatttgtttctcgccgcgtttgtttgggaaaaatttggaaaattggctatctctttttatgctcaacagtaataggaattccaaccgcattctcagaataattacgccgatactaattgttctggaatttgtttctctgcgcgtttgtttgaggaaaaatttacgaaaattggctatctctttttctgctcaacagtaataggaattccaaccgcattctcagaataattacgccgatactaattgttctggaatttgtttctcgttgcgtttgtttgggaaaaatttggaaaattggctatctctttttctgctcaacagtaataggaattccaaccgcattctcagaataattacgccgatactaattgttctggaatttgtttctctgcgcgtttgtttggaaaaatttggaaaattggctatctctttttctgctcaacagtaataggaattccaaccgcattctcataataattacgccgatactaattggtctggaatttgtttctctcgcgtttgtttgggaaaaatttggaaaattggctatctctttttctgctcaacagaaataggaattccaaccgcattctcagaataattacgccgatactaattgttctggaatttgtttctcggcgcgattgttttggaaaatttggaaaattggctatctctttttctgctcaacagtaaaaggaattccaaccgcattctcagaataattacgccgatactaattgttctggaatttgtttctct

SEQ ID NO: 43163 - DNA, 926 bp, Heterodera glycines
  misc_feature (916)..(917): n is a, c, g, or t
ttgagggccgaagcattgcacattaaatagtcaatacaaagccaaactgacgggggaggagggaatttggttggataaaacacggcaaaatgagcggaagaagtgatcagacataaaggaagtgatcagacagtttgacagaaaaaaagagaatggaggtgatcggacagttagcaaacaattggcaaatttgccacttacattggcacagtgcgtaaccaaagccccaactttgagccacctgaacggacaaaagggtcggctcagaataacataattattgccatttagaattctcgtgtttttttgtctgttgtcatatttctttctcacttttggagtgtcttctattttttggtttattaaaaaaattttctgaaaagaacccaccgtatacaaagtcatcaacggaatggatacgatacctatgggggagaaaggacatttaatcactgaaaaacggacaattgaacattaccaactgtcagatcagcaacagccagggaaaagagaaagtagtttgagatggtctgcagttttttgtccacgcaaatggaaagctgaagtaatggaaaaaaataaatcatttttataaaattttaattgataaatttgggactttcccccgccccccccccgaggggatgaaaaaaaacagaggaaaacaagcaattcaattgtttaatattggaaattcaatcatccaactttaaaattgcattaattgccacaattttgaaaaaaagcattgttcgtgtgatgcccgtctccaaaacggtcctttctttaattaaaatttaattgtcaatagggattaattttagctgttcaattttttgcttcccttccttccgtccactgaccattacgagggcatttccggatgtcgtggccacggtgaaaacactccgatcannatgatcaaa

SEQ ID NO: 43164 - DNA, 821 bp, Heterodera glycines
ttttcggcagtcccattttcaaatttttcatttttattttttggcgtcattattttaacctcattttcagaatttttgtttgaaagaattgccttctccaaaaaatgtaccgtaatgtttacagtaggtgttactgtaatattcggagcttgggttatctttggcatttccgttactgaacttggtttaggcattgaaatttcacccttgaattttattttttgggttggttttacatttgattcgaaatttgtttttggtacttttggtaatttggtagtatgtgaaatggtatgattcgaaacagtaaactgtgttttgggttttactgtagttttgacttttggcagctgtgatttccattctttcaaaccccgaattttgtaaaattgttgcgttcgatttgcttgtaattgaaattgttccgtaaatttcattggtaccataatatcagtggccattgttgtttttaatttgacttcggtttttgtcttttgtgtggttgttaccaaatttcccattttggttgtttttgcaggtgctttggtttttgttttccgcatttcggttgtcaaattaatttctaacaccttttttggggtgttccaatttaattttttgggttgagacagtcgaatgaatttgtgggctttttgtggtactcaaaactgatggtctgatggttgttggtgtcgcgggtgtacttgcactgataattttcccttgtgataaatccgtactcccaaagtccgaataatttttatttttgaattttttcactttccattctgattggtttaattttggcttccttttttgac

SEQ ID NO: 43165 - DNA, 1225 bp, Heterodera glycines
  misc_feature (1165)..(1165): n is a, c, g, or t
  misc_feature (1204)..(1204): n is a, c, g, or t
aaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatggttccgggtcgcccacattgcacaattttcttgaaaataccatgaaaaatgctctaactnctcagagacttagtgagcgcactgcaaggagaaccctancacagttcagcacaaaaaaat

SEQ ID NO: 43166 - DNA, 1014 bp, Heterodera glycines
agatttatggggataccgcatcattcgggaataacttccctatagcctgtactttaattctgcgttggatttttgctcgccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcagtccccccgaaccgatgcgcccagatttatggggagttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaaaagaattaacctgttttatcacattagcttgtcatcagtttttataaaaaattttcaaaattctgagtctcctattatttttttttttttcaaaattttgaagggcgggggggggg

SEQ ID NO: 43167 - DNA, 938 bp, Heterodera glycines
taagagctgtggaaattgtgaattaattctcagatcttcctggatctctttttaggacaattttctatctcgtaacctttatgctaatccgttccggagagcctcttcaaaattttttccattaccataagagctgcggaaattgtgaattaattctcagaaaaatggctatctctttttaggacaattttctatctcgtaaccccgatgctaatccgttccggagagcctcttcaaaattttttccattaccgcaagagctgcggaaattgtgaattaattctcagaaaaatggctctctttttaggacaattttctatctcgtaaccccgatgctaatccgttccggagagcctcttcaaaattttttcctttaccctaaaagctggggaaattgtgaattaattctcagaaaaatgggtatctctttttaggacaattttctatctcgtaacccccatggtaatccgttccggagagcctcttcaaaatttttcccttaccctaaaaactgcggaaattgggaattaattctcaaaaaaatgggtatctctttttaggacaattttctatctcgtaaccccgatggtaatccggtccggagagcctcttcaaaattttttccattaccgtaagagctgcggaaattgggaattaattctcaaaaaaatggctatctctttttaggacaattttctatctcgtaaccccgatgctaatccgttccggagagcctcttcaaaattttttcctttcccgcaaaagcgggggaaattgggaattatttcccaaaaaaagggtatttccttttaaggaaaatttctattcccgaacccccaaggtaaacccgtccccaaaagcccctccaaaatttttcccttaccccaagaagtggggaaattgggaaattattttcaaaaaaaagggttttccttttt

SEQ ID NO: 43168 - DNA, 989 bp, Heterodera glycines
  misc_feature (79)..(79): n is a, c, g, or t
cccccccctcccccgcccctcagagcacgacaaatatttcaacaaaaatttgaaaatcatgtttcccactcccttctcncaggggtattattttgtaaagtctttttttccccaataaacttgtcaaaccccatttttcgcaccgtgaatgttatttttattgacccccgcaccgttttgagtagatgagacgataaaaaattgaaaattttgaaatcatgtttcccactcccttctcccaggggtattattttgtaaagtctttttttccacaataaacttttcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaacaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcccccaataaacttttcaaaccccatttttcgcaccgtgaatgttatttttatcgaattctgaaccgttttgagtagatt

SEQ ID NO: 43169 - DNA, 1131 bp, Heterodera glycines
gcgactaatcccacgcattggccaaggcagaggtaccttttatgatgaattgttcgatcagtggtccttttgtttctctctaactttgtgatcaattgtccgggcattagttcttttgtccctcttcagctgtaattaattaattaattatgtcctccgcccgctcactttgtccttttcttcctccctttcgcttattttctcctctccaataatgtcgacaatgtcggagagggaaaaagaagcgcaaatggaagagaagcaaagggaagaaaggccaaaggaaacggagaaaaacggcgccggaggcaatccattggaacgcatcgaacgactgctcacttgcccaatttgtttggacaggtcaaatggggggggggggttaataagtgtgtaggtcttttgaaaaaacaatgcttttagtgatattctcggaagtgtcgactccgagtcgagaaaagtttggctttctcgattctctgggcccactccgattttgggcttactttttgttcaaattttgtttctttctcttccactctctttcattagcttcttcttttcttccttgttaaagttcagctccttttcaggtacaaacagccaaagcttctcttctgccaacacactttttggtggcttttcccttcttttctctctctctctctctgtctctctctctgtctctcaccgtttccttctcttccctcccctttcctttagtctttcttgcttggaaagttacgtcgaatcgtccgccattgctcggccccgaattcgttgccccgaatgccgtggcgaaaccggtagtaaacataattcattaacaaattcttgggcatcgtttgttttgtgtttctttagcattgtcagacggagggaatgtgcaaagtttgccgacgaatttgacacttttggcattttcggaaattcatttggaagcgagcgatgtgaatgcagcagaaatacaagggtatgttcagaggtaggacaaaggagcagcagaagcagcagccaaaccaccacattggcatttccactagattcaacttggaaaaggggcgagttcggaagaaaagaccgagtggaacttagtggagattgcgagcgcaaatgttgcggggaataccg

SEQ ID NO: 43170 - DNA, 1647 bp, Heterodera glycines
ccataccacttgcataaatttactgtcattttatgacagccaaaaataattctattgtgcatttgctgctaattatttcatgcaaagagcgataaaatattttcaagaatcttttgcattcgacaccgttgaacagttgtatgcgcattttaaagaagagattttgagctcccccggtgaatattacccaaaccctctttgtgtgcttgattgtgtacacattgtcaacgacgaacacgctgatttgccggtgttcattgaaggaacgcttgatttgatcgcaggactagtactgtattccacatgttatccgaggacggaagcagggacaatcaaatggtaagcgagcagagaaatcaaaattcctagataaaaaaacatttttaatttaggagcgaagtcttgtacgtggagttgaaggacatgatgatttgtcgaggcgaatcggctcgctgtcgctgcgcacaatccatcaacaacaacctgtcacactaccagcttatcgtggacgaactggaccgttggctgatggacaacaaccaactcaatcggcgggacgtcgtcgaacaagaagaagaggaaaacgtcgaccactcaacctggtgaaggcactgtgtcgtttcaacgggggctgcatgccatcagttttgccgcagatgattcagaggagaagaatggaaaatttgggttttcttcgtgatctcaggctgcaaacagtgcatctgaagaataacattatgatttccgccaattcattttcatttcatagtgccggcagtttgcttgcctaccgtggctatttgtccataacggtagagcagcacttgtacgttcgccaccgcgttcgtcttagatttcccttcctgccctgtgttgcgcagtatgggggaaatcaccatcattattattttccattagaactgcttgaaatatgttcacgtccaactgacgaatcctcctaatctactcatcttccgaaacttttattgttagttattgtgaaaaataaatgtttgttaacaaaagtgctgattttagatgcttattttagggtgagcacttttcctctattccaactttcttccctcctgtgcgttattctggactatttagtttgccgccgcctcctcctcatcatcgccgctatcgtcatcagtgacttcggcttcagactcagttgaagaactctgggccacttctcgatgagagtccatagctatttttttaattttgtaataatcatcatcatcatcatcatcatcatcatctgattaccattggaacaatgcgcggcctccaaatcacgaaccttttcctcagaacgttcaaccctacaaaaaaaaaattggttgatcgtgtcaacgcagtttatttttgctaatacttttttagtatggtgtccaatgagtcttccccaaaatcgaccacgtctgaggcattgtcgtccacacccatttcttcctccagtttggagtatttttttcgagcgcatccagcctattttttgttaggagacatatctatgtttttagactttcaatttaccattcggcacgtgattcgccttgtgccttcatcattgtgcccagcatttgagtagcggacccatcaacgaatgacgtcgttttccgctataccactgctcgt

SEQ ID NO: 43171 - DNA, 1303 bp, Heterodera glycines
cccccccccccccccttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatagggaagctattcccgaaggattcggactccttataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaatttacactaaaaaagttaagcctacattttttggcatatttaaaaagcaattaaaaaatttttaaaatttaataattttcctg

SEQ ID NO: 43172 - DNA, 1343 bp, Heterodera glycines
  misc_feature (113)..(113): n is a, c, g, or t
atttttcctcgcctctctttcgaaaagaaaagctattagcaagcgtgtttggaccaattctaaaacaaatcggggtaataatttaatctgactttataagataaatgggaatntaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctacttcttgcaaagaagactaagccaattgtaaacagcaagccatccaaatgcttcaatgtaaaaaaaaattacatttggatgcaacctttatttttcctcgcctctcttttcgaaaagaaaagctattagcaagcgtatttggaccaattctaaaacaaatcggagtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtatttggaccaattctaaaacaaatcggagtaattaatttaatctgactttataagataaatgggaatttaagcgaaggattcatgcagaataataatctatagaaattatcaaaaaagtagttcctcgcagattcggagaccgtttctataaagctagagacatatgcgctaaccataaaaaagatgaatcattttttgaaaaatttatatagttcgactaaatttgaaaatcgatttatggtgtacaggat

SEQ ID NO: 43173 - DNA, 1456 bp, Heterodera glycines
  misc_feature (74)..(75): n is a, c, g, or t
  misc_feature (118)..(118): n is a, c, g, or t
  misc_feature (127)..(127): n is a, c, g, or t
aattaattatgcccttctaaaagagtcacactcattacgtccctgtaattagccatttatttcggcgtcctgannccaggacacgaagctcattaaccattttgtcatggttttccanagtctttcntcctgtccttgctttttgacgtccttgaacaaggacatgaagccgattaaccatttttcatgattttttccacgtcttaatcctgtcattggcctttccattttcatttcccaaaaaattggctacaaaaatgccaaaacgggttaaaattcgggactgataccgaatccgtgcgcgggcttttccgtttccgtgtccgagttgcgcgggtgatcatgtccaaaacggccaattgcatccggttcagcttttccgatgtttgggatttcgttttcatcggttggggcatggttgggcatgaacagttcaggcttggtggcgtaaacaaaaaacaatacgaagaaggcacataccatgaagagaaccggacggcacattatgccgaacattctgaaaggcaacaaaatctcttaattagccataagtgtaaaaagcttggcaatgatatcgtccaaagcacacactaattaattaagctaatcgtttttaattacccatgggtgttaagctaattccactcgttccccagtgtaagagtcattaagccacggggctaagtaatgtcttaattagtcattgccatcagtgtaagctaattggcccgaggtttggtattgagatcggttccccagtgtaagagtcattaagccacggggctaatgtaatgtcttaattagtcattgccatcagtgtaagctaattggcccgaggtttggcattgagatcggttccccagtgtaagagtcattaagccacagggctaatgtaatgttttaattagtcattgccatcagtgtaagctaattggctcgaggtttgacattgagatcgtacgtacaacacactaattttcacacgctattcaactaatcgtttttattacccacaggtgttaagctaattgtacttgttccccaattaaggatcattaagccacagggctaattgccttaagctgacaattttattcttcctaattaatgtctttgtgttcaggccagtactaatggagctcaattagcggacttgaccgacccggagtcgtgctaattagattgtaacttccctctaatgaccgactaatcccatttagtgtccttaggaacttggctctatcagagaactaacttaattcttatcctaatttattttatttattaagaatatttatttagaaaatttatttcatttgaaaacaaatgattgaatgaatgaatgaattctgcggttgttcggctaacattggcaaggggcggagctttgcctctggaaaagcagcagccaatcagagccaaacacaacgaattagcccaaccccccacagaaaat

SEQ ID NO: 43174 - DNA, 1215 bp, Heterodera glycines
cctggagagtcgggttggctgccctcgtgtttcgctgatttaacgccacgcttgttgccacttgggatgccgagagctgtgatgcgagctgttctggtcggatgcctcttccatcttgtcgtggtgctgacaatgtcgtcgtattgctccttggcaattccgaagttctgttcggacatgacgatgcgtgtgccatcgcaggcgatgagttctggcgcatttttggcgaaagttaatgccttttggtgatcttcggagatccaagtggctactgtttctccataagctgcggtaaattttccgctgatgatttccgctcgatcgtagtcgcatgtttggcattcgttgccattgcaggttgatttccaaatcagggttgagttgtcgggcagttggcagaattcggttgcgtattgacagttctgaatttggtggactggcgaaaacatctgcagattgtgccgttttacgaaaagtgttgctggttgagcaaagcagtttgtcgccgtgctgatttgttcgcctttgaaaagtccggcgattggtccagggaagttgacttccaattcgtcattcgttgaccacaattgtgcttcgtgattcgtcatttcagacttggcgaatgggcattcctggtgaatggccatttgtttgcagatccgcttgttgaccggtggaaattccttctcaatggtgacgaacttatcggccaacaaatttgtataataacgttcactggtacgtttgatggagcaatgccatgcgaatgcgatttgctctggcttgatgacttttgcgaagagctcaattgccagattgtgccattgagcagtgagtgttggcgggggacggcagaaaggtgaattttccgtgcccttgagttcccaaatcgtactgcccctgtcggaacaccagaaaacgtccgctccgtcacggttcgttcccaagtctctttttgctgattttgccgatttgatcgtgccgggaggtgtcgttgcatccgtttgttggcttcttgctttcgtgacgtattggattcgggttcgtcttgtcgtccaagttgatgcgctgcttgacatcgttggagtccatctttgcttggtagtcgtcatcggtgcccatcttgttgttgtccatggatttgtcttcgtggttgtcgtggttgtcatcttttcaaaaggagttattgtgctgtaccacgacgaagttactggt

SEQ ID NO: 43175 - DNA, 1679 bp, Heterodera glycines
ttaatatatagccaaaatttcaaaaaaatttcccagcggcgcctatcggcaccgccggatccttaaaatccttaattttcttaaaaaacttgctcaatttgcaaaaaatggtcatttttgaacagaatctaacaatgtattgtattaaaattttcaatttttttcccggcggcgcctaccggcaccgccggcctccctcctcctccttggtcaccaaaaagttttttcgagaaatacaccgcaaaaaattttgtaaaattaataaagggagtcaaaaatataaagttaataaatgttttgttcgaattaattataaaaaataatttatttaagcaattcgaaaaaattttctgatttttgactcaaaaataagatttttttatttcaaatttctcctttataaatttttctatatatttttaatttaataaattgattgtcctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgtcccggaaaattttgaactcccgatcccgctcccgctcccagaaatttttttttaccggactctaatcaaaatcacggaaaaattgaaaaaatccgtgagccgtgatccgtgatcatggcacccaaaaacccccgtgattcccggtatttgtattaaaattgtaaaacacaaacttttagtgggtattttccggtatttgtattacaattgtaaaacacaaactaaaaatgtgtatttttcggtatttgtattataattgtaaaacacaaactaaaaatgtgcattttccgctatttgcattaaaattgtaaaacacaaactaaaagtgggtattttccggtatttgtattacaattgtaaaacacaaactaaaaatgtgcattttccgctatttgcattaaaattgtaaaacacaaactaaaagtgggtattttccggtattttattacaattgtaaaacacaaactaaaagtgggtattttccggtatttgtattacaattgtaaaacacaagctaaaagtgggtattttccggtatttgtattacaattgtaaaacacaaactaaaaatgtgcattttccggtatttgcattaaaattgtaaaacacaaactaaaagtgggtatttttcagtatttgtattacaattgtaagaaactaaaaatgtgcatttttcagtatttgtattacaattgtaagaaactaaaaatgtgtatttttcggtatttgtattacaattgtaaaacacaaactaaaaatgtgcattttccgctatttgcattaaaattgtaaaacacaaactaaaagtgggtattttccggtattttattacaattgtaaaacacaaactaaaagtgggtattttccggtatttgtattacaattgtaaaacaccaactaaaaatgtgcattttccgctatttacattaaaattgtaaaacacaaactaaaaatgtgtatttttcggtatttgtattacaattgtaaaacacaaactaaaaatgtgcattttccggtatttgtattacaattgtaaaacacaaactaagaatttgtattttcccgtatttgtattacaattgtaaaacacaa

SEQ ID NO: 43176 - DNA, 1608 bp, Heterodera glycines
  misc_feature (27)..(27): n is a, c, g, or t
actttcgcaatgcattgttagcaaacncggagtaagttacaattttccaacatttgcccagcagttgcatcattacgttgtagcgatggacgttttctttaaaaagcttacattaaatgaaaactccaaaaaatgcaaaaattagatgctcgtaattcaaatttgcgaatccggttgcagaattagggtttaatttttataattttttttgttgctggactgactccgtccatcgacggttaaaaaaaaacggtaaaagttgccaataaattattggcgtaataaacaaaatgccaacaaacaaacgtttcttttttttccactttcactctcactttggcgtactatctcttcatttttgataatgtaaaaacaacatttacttttctatgggtagcttcttttccctatgttaaaccttcaccaaattttgcatatcgaactctagaaaaaaaaaactgttttagctgtattgtaaagaacttagggggcgttaactcttgaattgtaatttgctcacagctaagacacatagtatgcatttgaatgcattggcattttgtatattacgtcaatgatttattggcaattttttccgttttttaccgtccatgagtcggattaatccattttcgtccattttatattttaattcattattttaatccaattatttttatgtccacctttgtttgtcgttcgccttttcagggcagttccattttgtttttctttccaaaaataaattgtcccaattttcttccgtttctccaacttccgtctgcagcgacttttgtttatccgcttctttttcttcttctgcttcttttctttctttcaaaatctctgttgttggcgagccttaagaaaatgttaatttggatttgtgtttaattagttgttaaattagaagtttttctaactgaaaaaagattaaaaaaatagaaattaaaaattttcgttggtcaataatctacaggatgtaaataggataatctagcattatcccaaagtcaagctatatagtcctaaggaattgacaaaaagatatgactgtataacatttacatactcatccgtaaatacaaaaaaaaatctttttaaaaaagaattttaaaaatatttattttgaaaaaatctaaatttaaaattattattaaggatattgtccttaggattagccaagaacggagagccctgtcctgcactgcccttggcgatgattacttgatgagctcgcatgcttttcagtgttagttgtctcattttcgtctgatgagctgctgccgccataaaatgactttctaaactgagaaaatatcgcagcaggcgacggaaaaatgcccaaaattccctttcttccttcagctccatcgtcactttgcgcctctgcaaaacaaattctaattgtttgatttgttacttttgatggaatgccatcgcaaaaaaacactcaaaagattggctcatgggcttaaaatccggtaaaaacccgtcaaagcttcccccgccttcccgaaaataaaatttaagcttttttccaattacatattcagagggctaaacaaataaattttttttacaaatttttaataattttttttacta

SEQ ID NO: 43177 - DNA, 564 bp, Heterodera glycines
  misc_feature (349)..(349): n is a, c, g, or t
aatcgaagaaaaaaatttttaatttgaaaattatgttaataattatggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgttaaaacataaaaatccgggccctattaatcactacactatgggcggaccagncggtttttcgcgtgggccgttttcgcgtggagcgagtttttgaactataacttttttatttgtcaaccaaatctaactttcttgatatcattcgatagcccttagtgtcctctattatcttgtaaaaattgcgaaaaatttcgtcaaggttcaaaaaagttatggccaaaaattttcgaaaatctggttttttgaattcttctaatcatatcttt

SEQ ID NO: 43178 - DNA, 1094 bp, Heterodera glycines
aattgcctaattaattaatttattgccctttcgtctctctttgcccatttttcaatgaaatttcgttccctcgcactttctcttcgcgtgttccaccttcggcgccaacatcaacagcatcagcagggagcgaatgaggtgggttaattagggttaattggggataatgaggtgaggatgggcggattggggcgggttttatcatattaaagacagttaaataattgaacctaaatgcgaaccaatgagcacaagcacttttatctctaagtaaagttttggattccgagtcgggatctcttctcgaaccatttcatcaaatttttgaaaaaaatttgcctatcaaaacaaaatgataagaaaatgctgtcgccgaataaactaaatttgcaacgaaataatgttttacattcgcatttttttaaattttccttttttggcctttgacttattgtataatctttcatagaaatggcataaatgagaaattttctgcgatgaaattgggccaattttagcacagaaggcgaaggacgggcggaaaattccccggaaattgttgccggagggagggggggggggggggggaaattgtggcaaattttaacccttggatggaattttatgcatctatttaatgtttttatatccggatttcgttgattcttcttttaacgatatatttatatgttcaacaaatttccaaagagcaaaaagtgccaaaatcgcatcttacgccccaaaaatcattagaaaaacataaaaaggaggcaaaaaagctcaaattagttgaagtctggcaaatctatgtcaaattctttttcttttcctcgggaattgttttttcgtttttaaattaaaattatttggcatttccaaatttggcatttcattcctcgaatttcacagcaattttggtctttttcattggaaaattacacctcgaagcgctaaaagatttgtttgagattggtttctctgccctccggcactttgccattcgctgcctttgtcctcccttttttttacccttcgtttgccttttcagcagaaaaagtctgtttgcttagcaggcatattttgcattaaagtgc

SEQ ID NO: 43179 - DNA, 1145 bp, Heterodera glycines
  misc_feature (1124)..(1124): n is a, c, g, or t
cattttttggcgacataaaaaaatttcaaaaatttttcactaaaaaatcagtcgaaaaacaatccccccgtctccatttatcccaccgtatctaataatccccccccctttctaaggaggttgaacaataatccccccggggtgataattggagataatacggtactcacatgaccatgattttcaaccaaaacaggggattaaaccttgattttaaattcattttttaattttatttatttattttttacaaaaaaaaccttaaaaaccaaaaaagtgattccattaaactgtaaccaatgaatagaagtttagtcgtgttataagcttttattttttgcattgcacatcgttttttttcattttacatatatttatttggctttttcaaaagttttagtattttcagaaataaatatatttttaatgaattaatatttattgttttaggtcactcaatggcacatcaaattaccttttggcacttttctcctttttcgaaattcttcaccaatttggccattttctgttcgtttacatcgcattttatggacaaaatttaattgagtatcgtttggcagcaaagattgtatttatctcatcacttggttatggtaattttaaaaattttaaattttataaattatttggcaggtgcaatttatatttcaatgcttttcactggcgttgaccgactaattgtaataatttttgacgaaatgtatgcaattattgcttattaaaataaataaattaatttaatttaaatttataggaacaataagcataaaattcgtttgtatttggcaactgtcacaattatgtctgctttctgcggttgcatttctactgtttcactgtaccaagatgcacaattgcatggtgatttgatgatcaccggttgcactgtcgatttttttatggtttaattataaatttaaattaataattattttagtttacgccaatcttccgtatcattatttgtttgttgatcaatattatcactttaatcatttatatggttgttggaatggtgttcaaatttaaatctgccggttgcttaatgcttaattacactattcaaattttaattacccactaaatttaggtttacccacggnctgatgtgtatttactacaac

SEQ ID NO: 43180 - DNA, 960 bp, Heterodera glycines
ataactcgttttagaagaagaaaaaaagctattttttgagaaaaccgaccaaaaaccaaatttccattttttggaaaattttctggtctttggtgtcaaaacggccaattaactaatggggaccgttctaatagggtttttggaaaaatgccagaatatggacataaaacatggacttaaatccaaaatatggaatggaaatgtgtggtccaggaaaaaatggatttccatatttttggatgcctttttagggcatattttatgccaccatttttggcatggggttttgagggtcgctgatcaccaatatgacattcttttcgaccaatttcgaatcccgaagccgagttcgaacaaaaagtcgaaaattcaaaaattctcgattttcagatttatgttcaaactttgtttaaacacacgaatatcatcagtgcttcagtaaaaggtcatctaaaccattcttagactaaaaaagaaaatcgaaaaattttgagttttcgattttttgttcgaactcgggtccggaattcggaatcggtcgaaaagaatctcatattcgtgatcagcaaccctctttccacaattggtaaacattatttcgtttttgtctcgtcttcaattttgtgcggaaaaaaattagcagaaaaaaagaaaaccgagaaaaacaaggaaataatttgcggaagcaaaagggaagggaaaagtgagcgaatgaaagaaaatggaagaaaggagggcttttatagcaaggcgtcgaatacgaatgaccgtttaggtaataaaatcgtttaaaaattggcaaaaaaattattttaatgtaaaagtctatgctcttccgccagagcggtaatcgttttggtgccgccgttttggcgacagggtcgttttggcgccaagacaaaattaaaaaattgtgaatccaagatcgattccaatttttaaaaattataacttttcata

SEQ ID NO: 43181 - DNA, 1679 bp, Heterodera glycines
  misc_feature (1597)..(1597): n is a, c, g, or t
tctctatcaatttttcttggccttcttggttgcaatcccttcaacatcatttttttcttttggcacatcactgtcatcattccctgggcacttcttgaacaaattgacaatccaatcaaatccagtgtacgtctgattgttcgcctagggcgtggtttgtcaaatacataataaatagcaacaaaaaaccttaatgttaactttcgcaattatcttcacagcaatcaaatcgtccaagtgtttcgcaaggctttccggctccttctccttggctagcaattcggcagctttcattcccaaaaactcttcagcaacactcgaaaacatggtgacacgttgagcaatgtctgcttgttcaacatcctgcagcagaagacgaacaaacaccgtgtggatgggagcaatcgctttttggccgcacgcctcacacatgttatcatcggacaattttcggcggcaaatgagccccttggaacgaaatgggcatgcctaaactagaaaaaattaataatttaattaattaatttaatttggactttgtaaacacggtactgcatatttgtcacttttcccaaaacataaaaaacgccggccgaattgaagttgaccacatcgctgatgtgtttcggttcaactgaatccaactcctcttgctgtcgtgtcccttgctccgggagttgaaagcgtttaagagaattcattgcaggaagaacagaaaaaacgaatgtggatggaattttttttaaatggacgaatgatttttttatgtagaaaaactgtgattaaatagaaaaaaaatggggcgggacaaaagaaactaaaagcaaaaaaggcggagtcaacttcttagtaaagcaaaacaaaaatcaatggggtgtgaccaacaagaaaaggggcggagtctttttactttgcatgatgacgtcattttttacaatttaatgaattggagttttttgctaatttacttaaagcttcggatatgatatatgcaataggcttgggtttattgattatttgtgtacagtccttacaataggttttgccttttttttttttgggggggggggggattattttttaacctcctcatagactggggataattggagactgggggataattagagcaaatactgtattttctctctctcgaccccatccaataggtttgggtttgtggaaggggatgtcagagaaaaaaagtagacacactcaaattatcgatcgaaaatcaatcgataatttgattgggaatattatctactgttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttgttacgcttctgctcaattagcaaaaaatatgagtgatcgaattntcactaaaaaagttaagcctacattttttggcatatttaaaaagcaattaaaaaattttttaaatttaataattttcctgca

SEQ ID NO: 43182 - DNA, 1249 bp, Heterodera glycines
tttcggaaattaaggaaaaaaaaatggaagaaatttggaataattttttgaaagcaaaatttttttccttttaggattgggtcaaaaaaaatttaagacaattttggatttttttttgaagttttgaattttttgacaaatcccaggcttaaaactgggagaagcaaggggctgtggcgggggcctaaaattgggccacattgagatttcttctgttttcgaaaaagtcctggaaataactatttttctttccttacgttctgtagagctcgatctgctcttttcaatggtcttatcccggtctcgatccgtgccgaactcacaaaatttatggagtgaaatgtgaaatatggttttcccaaaaaggcattttttctgaaaaccggattcaaaaatctggggtttggtataaccgttttagaaatagcgtagaaaacagcttcgatatcaagaaaccaagtcaagtccagaaaggaatattttaaaacgattcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctggagggggggcctaaaatt

SEQ ID NO: 43183 - DNA, 1024 bp, Heterodera glycines
acctgtgaacagaggtgggagaaagaccatttaaaacaaggatataaatcagagcccctactggggtaatattattttcgagaatcgttttagttcgaattagaaccggatccgaataaatagatttagttttcaacatacttcaaatgcgataaaatgcacgaaataggggtctactcccccccccccccagaaacaaaaaatgaggactttttaaaatgaaaaataggaaaaattctgaaaagtatacccttttcttaagaaatttcatcaaaaacccaaaaaattgacccaaaaatagtcaaatttttggaaaaatcttaaaatgggctaaaaattcctgaaattttctgatgatcataatctaaccagttccttcccacttttatctttaaaaaagctctcaaagaattttttgatttctggaaataactaattttgcttcatgacgaagccctcacttcctggggagagttcacgcgacgcacagagataaacaacacgtcaagagaattgtccggcaatcccccgcctgtggggtaaatacgacgctgacgtgccgcttcttccaacgggtgacgcatgttggtcgtcttgtccaggtaatatgacgacgcgtttgactcctcgccgctgctcatgttcacaatgccacacttcttcgcctcctcaagcgacatttcgcgtccggtgagcgagtcgcgcacgtggaaataatccggcgggagttggccggaatgaatggccgactccaatgggatttgctcgttggtggccaagttaatgaacacaattcgcgccaagtcgaacgcatacgcacgcgtctcatactcctcgcccatcggtggaccacccgtttcagcagcggcggagggaaattgtatgatttttttgctgccgtcagtggcagcgggcgattccgtttccgcgcgaaacgcaacatcgcgcaacgtcagacgacgacctcggtgctccatttgaccaagccggtccaacatctgtggcatggagagataaaatattt

SEQ ID NO: 43184 - DNA, 644 bp, Heterodera glycines
  misc_feature (615)..(615): n is a, c, g, or t
ttaaattcatttttttttatgactcacttgcaaagcaaatatcagtccgaaacagagttaattaaaaaatattattttgttttttctttcaatagaattaattctggctaaagcagacgtaaatttgtataattttgggcaaaaaattaaattttcaaatatttttttgttttattaaaatccccaaatgtcgggttccctaagtgttggatccccaaatgtcgttcggtccccaaaagtcgggtccccaagttgcaaatccccaaaagtcgcaccacgatttgtataagacagatatattttaattttcatttgtttttcccgttgagcaaattggcaaagcgagtatcgaattgaaatcgattggtggtcaatttggcacttttttactgcttttagtcagcagtggaatttcggcacaatacactttgggaagggggaagatggacaatttcatgcaagtaggtgcttggcaaggaaacaaatattcttttaaattcattttaggttagaaaattttcacttttttcaatgatttaaaaaattaaaatttcttttggatacccttcatcgccccatgtatcggcgctttgattggcacttggctttaccaantgttgtatcggttttcacttgccggaatt

SEQ ID NO: 43185 - DNA, 1091 bp, Heterodera glycines
caactgggcgacgccgactgggcgccagatcaactgggcgccagtccccgtttccctccctaccagagaagggattccgagaccacaaaaatttttgaaaattggagttccgaagcccaaaattttttcgaaacggaattacgtgctatccctaccccctaccatatatgtgataaataaggattttttaggcaaatgcataaaattttgcgtaatagttatgattgtaggcccccttttaagaaattttttttgttgttccaaaagttttctgggtcgctgacaatgaatcctgtatccatttcgaaccctcggacccaaattctaacaatttttgttcgaatttgggtccgggttcgtaatttgtcgaaatggatgtcggcttcgtgataagcgacccaaaaccccttgaaatcatgctttcatgacttttaaaaataaaaacaaaaaaaatttctttgaaaatacacccttcagaattgaaaataaaattctcaaaaattttattgcctcttcgaaaatttttgtgtctatttaaacctattttgcgatttttgtgcctaaagaaagggaatttgaaagtgggtcttggcgcccagtcggcggcgcccagtcgacccggtccgaaaacctcgcccaagccgaaattctgggaccgtccctgccgtcagcccatttttttcatttttactcctcaatttcggtcacccaaaaataaaattcccgcataaaatggccaacaggggcaattcgtaatacaaattgaaaatgatttttaaaggacaaactaaaaaaaatttttttttgtaaaatttccaagttttatttaaaaggaattttttgacaaaattcttgcttttttaaatatatatttttaaaaaattgtacgagtgccattaaaattttaaaacttagaaatttttcaagaaaaaatctttaaaaaatttttcgttgaaaattctatgagaaaaatttttaaaaaactaattgcattggtcccgccactgatcatatccccgcatttatttatcatcaccttttttttgttatatgttgttgtccctcgtggagcttaagggcagaactgaaat

SEQ ID NO: 43186 - DNA, 911 bp, Heterodera glycines
aatgagacacgtgactccattatctaatttgcaccaaagggctgggaatatcgtagggtcatagataccacccagcgattgttgtagtttctccactcgaattctttgctcaaacgttaaaactccaacaatgttgatcacacgcagctcatagattgtcattgttctgcattgtgtatattgaattcgtcgtaaaacccttgctgcatacttttgggcttgatcagggtgtggaactccagtaaggacgacacgtgccgattgaaatatgagtccagccacagtttttgctccatatcggattcgcatgatgattgagtggaaacggcgtggatcatattctgtattaattcaacgttgtgcaatagccaaaaactgttgcttgttcaaggaattaattttaaaaataacagtagtttgaaattttcatctaaattataatggacaacttttaaaattttacgcaacatattttaaaaacaatttaatactgaaaaaattctaaaacataatagtgagaatttcaagcgggaaaaatgttttatgatcaccgcctccaaattcgacgacacatggcaagttcggatgatgcaaacggattccatgttacatgtagtagtgcattcgtacctaaaatgactatttatttccaccaaattgccaaacaaaaaaaaacggtaccgtaattcccaagtagccgcggtaggccgggtctgagtgggcgtcgagaatggagaggtcattgcagcgcaccgggaaatttcgaacaaaaggtcgcaggtgggcggttcgcagttgcgctaagcgcagatgctggacaatctcccggcgcttctccaagtttctgaacaacacgcggagttcatgcgcgctacagtggaacctcttgcatagatggtcgacaagcggaa

SEQ ID NO: 43187 - DNA, 1377 bp, Heterodera glycines
  misc_feature (702)..(702): n is a, c, g, or t
  misc_feature (704)..(704): n is a, c, g, or t
ttttaatttttgttcaaaaatggtttttagtttaataaaatgtttttactcgggaatttttagtagcaattttacataagatgaccatataaaaattaaaatatatgcattcttaaactaaaaccaaaaataaaagttttctaaaattataaaaaataaaactaaaaaagtttgagatttgaattgtggagaaatactattgtgcaccaatttttcacatttaagtttaatccacttagatccaggagtagtctgttcgatgaaggtaaaaagaaaagaagcatttttataataaaagattaataaaatgtaaggaaatgatacaaattttgaaaaaagtattaaatttcaaaccaaaatcaaaatttgcaaaaattctcaatttaaatttaaaattaatgaaacgataaatttcctgtataataatgcaaaaatatttaattttaaatatataaaataaaaaatcattaaataaaaattcaccctattttttaatccttaatatattcgatatataacttaaaaaaatatatgaatttaaaaaaatgtttttaaaaactaaattgaaaatattgtaaatttatttaaaaaccttcgataggctttaaataaaaaagattcaaaatatcacatgcaactacgaaggaatgttccgaaaatttaattaatattaaatttcatcaattaaacaccataattatntnaataaaattaaaattaaaatttacaaagtcatgggtttgtattaaagaaactttatgatgaaaagagcccaaattaacataaaagtttttctgaacgatacaaaaatattcataaaattaaaaaaagaaaaactacagttttcgtttatcccaacagaattatctacaacaaattaaaaccaaataaaaaattaaaagaaatacgactagcatttgagaaaaagaattgtccttaatatctaagtgcgttttaaagtataatttaaaatttatatttcaataaaaatacttaaccagaaaataaaaaattctaaatattcttatgatgaggcaccgataaataaagaaaataatttattaagaaaaacaattaacaaaataaacaaaaataaaagaatcaaaaatcttccagacttcctgatagtgcccttaaggatggattgactcgattaattccatttaccgctatcaaaaaaaaagagattaaaaaaccgtaagtgatctgagcttgatgaatagacgagaaaaaaatggactcatacataacacaaacttcacaagaattttaaaaaactttaaaaattttataaacaatgcagatttaattgctttaaaattaatataatattttggattatatcaattcacttcaatattttttatatcgatttta

SEQ ID NO: 43188 - DNA, 1031 bp, Heterodera glycines
tgcttaagaaaaatattataaaatatttaataatcatttttttgaccaaaataaagttatttggttattttttaggtgttttgctccataaaaacttaaaaaaatttaagtgccttttttcatgcctttttcaggattttcgtgccttttttcaattttttggtacctattatagtgctttttgtgatttttggcacctttttagtcggtctctagtcattaggtaaaagaaaggccaaaattttttaaacaaaaataatttttctcttttaataaatataagttttcaaagaattcttatattttttacaatcctcatgagaattttggagaattttacttaaaatcgcttgaaaatttgaacatctttctaccgttaattaaaaaaaattctttaagtaatttgttaaatcctcataaaatttattaattcttaaaaaaaatttacctcccagaaaaggtggcccgtacttctgtgtgcgtattcttttctccatttggcccttttttggtcacgctaatcatcaaaaaaaaaatttaaatttttttttcaaattaaaaaaagcaattaaattaaaatttaattataatacccacattcggtgtcatgttggccataggcttttaatgattgaacacagcaaatattgtagaataaataaaagctaaaaaaataaattttaatataaatttaacaagcttcaaattattcaattatatataataaaataagtaaaaaatacaaaaaaaaggggggggcgtgtaattgatgagtgcccttttcaattgcttgggaaacattttcctaatcgattctactaatagggaaggaaaagaaaggaaaggaaaggatagttgtgcattaattatatatttaaaaacattagctatcaaaaaaatattttaggaaaatattaaaaaatacctatatttcttttaattcctcaattcatgcccccggtaaagacttccaggtgaaaaaattattgaaaataaatatcaagaggttttcgaggtcacttgatcacata

SEQ ID NO: 43189 - DNA, 477 bp, Heterodera glycines
cggggaaaaattttgaaatttgaatgcaatttgttaacagatgttcaccaaaaactgcctacgattttaaaccatgcacacgactttttttgtttataaaatgggttttttcacggcgcgctttttaaaaaatttttttgaggataggggggtccggaaaaattagtaatttttaatgcgagttgtatacagatttttgtccaaaaatgaccaaaattggcgctttttggctaattttttaagaaaaatagtgcatagtgacataatgccataatatttcaaaaattctcaaaaattccaggattaaataacataatgccataatataatcaaaatattgagaaaatgacaaaggtttgtcaactttatttgacgttttttgaacttttcgaaatggtcgttttcaagaacgtccttgcatgcgaggacgctttttatgttcaagaaagagggcccaatctcaaaggcgtccttgcc

SEQ ID NO: 43190 - DNA, 1293 bp, Heterodera glycines
  misc_feature (1177)..(1177): n is a, c, g, or t
gttttataagaattaaatttttaaaattaaaatagccttataaagaaatttatggattaaaataatatatatgttttttaaaattttttaaagaattgtaatataaatttttctaataatacataaagattatcaaaaatgttgattttgttttactaattatgctcaaatttaataaaaattaatcaaaattttttataatcttaaaaaattataaaagtattttgatgttattatagtcagagtttaaattaagaaaatacaaaacatataatttcgtcattcagaaaataaaaaataattattttaataaataaaagcaaaatttcgtaatacaataaatgccggaatttataccaactaaataaatcgtgatactcttcatgaagatttttaaaaaacaaattgtttttctttcgaaaataaattaaataatttattaaaatattcaaaaaaagcatataataaatctgtctttaaataatttaaaatacccctcaaaatgtgccagattaaaagattacgctatcaaattgaaaagaaaattgacccaacaaatcgtaattttgaagatgaattttgagaatttttcacaaaatgccaaaattgggttttattttctaaaaataaaaacctaaaaaatagttgtcaataactaaaaaactagattaacaaccaccaaaaaaaaacatgttttcgtgcatttcagaccatagggagctccgggaaaaaaataataaaaaactaagaatagtatccctctttaagacgaatgactaaagaaataacaatattattaaaggataggcttatgttcaattttatctacttcaaacgaaaataaatttaaaaatgatattaatagatgatttaaaaattagaaaaataaattaaaatctattcaatggctcttttgctggattctctttaaatccttaataacaattttatttgaatatttttttccatttaacgcctaaatacgatttttaataaagaatttaaatgctaaaataattttttaaattaaacttatccaataaaattataatgtaataaaatgagcaattaatcatttctgttttatcgattcaaaaaaaaggatttgaaactatactctacgaaggtatttataatacaaaaaaatttaaatttaaaacaataatccatttctatnaaaatcataaataatttctaataatatacagataaaaaactgtactataaatttttaaaataaagaaatttaaattaaatggtcatttattttaaaataaatcacagaaaatctca

SEQ ID NO: 43191 - DNA, 904 bp, Heterodera glycines
  misc_feature (21)..(21): n is a, c, g, or t
  misc_feature (51)..(51): n is a, c, g, or t
tcgggtgtgtgatcagcagtncattgttggatagcggcgacgtctttgttncactacggcaaatcactgaggacaccatcaacaccatactcaatcaattcaacaaagtggcgcaaagcataaaacagcaaaatctgactttgtggggtgagccgttcatcatcaccataactacagttgatcgcagtggtctccctgtgaagcggcatatcaaagggggcgcccgacgtcgtttggccaaagtccaccaccaagttaatggcaaatgtctgatcaaggtcgtgcttccgtgacttttttggcaaattaccactttttaagttatagattcgaaacgaggacgaccaaaacagtaacaactattgcctgttctatgctctccaggcaacgatggttgccaaaacgcgtggatggcccagctggaaattttacgattatatgcatagccgacttggtcaacgtggactttttcatcaagacactgtgcagctgatgcgccaaatcaaagcaccattggatttggacgcatacgacgccgacacgtacgtacccctggtcatcagccactggaacaatgctcaacaacagcagcagcaccgttttgcactgttcatttttggaagcaccggacactacaagccaatctacaagtatattgacagcacttacgacacaccattggttttatactttaacaacaatcatttcgatggtgtacacttcctcagcggactctttggcggcaaaaagtattgtctggagtgtgagaagccttacaagaagccgaaggaacacatgcaatcatgtaaagcgcactgcctcatgtgttcgcgagttgggcccgagttttcatgttcctcggaagatgatggattcttcaaacaatgcagtggatgcaacaaaa

SEQ ID NO: 43192 - DNA, 1427 bp, Heterodera glycines
tcatttttctcgggcgcttctgaaataactttgcattcttttgatttaatttttcaaacattgatttgtatttattagctgcgcctattagtgtttaattgggcttaattagtatcttaattacctgcgttctcttcgctgttttctgccacttctctcttctgctgctgctgctcggcccttcgaatgtttccggtcggtgtcagcacaaaactcggctgatgattctgtgccctcagagattggccaatttccgtaaaaattggtcccaaatcgcacacactgtcaatgtatcgctcaacgggcggtgaaattgtcattttgtcgcgtcgttcgctgcgattgtcacccatttcgttttttctgtttttaaaatattttaattacattattatttaaataaaatattctgtttattttacgcacttttcccccgattcactcattgaattgtaaatgttccgattatttgtcacatttaaatttgtcgcgtgcaaaaaattgacgggtccgctgaattccactctcaccgattgctgatctgaccaaatttaaaattgttgtatttctggtaatatttgaatcactttgtgtctctggcgaagtgtgcatttgcgccgggggggaaacggtgcccgaggcacccatcaaattgcgcacttcgtcattcgcttgatgctcggagaaagttgccgactcgttcaaaatgggtcgtatcctttgatttcctaaattaaaaaaattcactagtcattcatacattttttattaaaaataattaggaagcgctttcggggttgggttgcgaaaagtcagtgtttgatcctctcattttggggtgtcggcgtgacagaacccaacacaaatactaattacagtactaatcttaatactaattataatttcctcttattttctttgctttaccctcaacgctcacaacactttggaacatttccgcttgtgaatcactcattggccatatgctttttgcggccaattgtcgtgaatatgcgtggaatttgcacagattgacggagcattggacggactcggcaaaagacgcggcacaaaacgatgggaaagaggaggactaaaaagtatcacttttgaaatttaaacagcaatattttttaccaaatcttgttgtggctttggtgccgtttctggcggcatctttggcatttgctttgtccattgcggcaaacattcatacgccgattgccattcatctccactgcttgatgtcattggtgggggcagaaaatgggtggactgttcttgttgttggttttggaatttagcaaaaatggggcatctaaaagccgaaaaaaaaagataggagaaattaaggatatttaaaatgggcgaaaagattagggggaattaaggaattaaaattttattaattgaaaataaattattta

SEQ ID NO: 43193 - DNA, 1185 bp, Heterodera glycines
  misc_feature (1125)..(1125): n is a, c, g, or t
  misc_feature (1134)..(1134): n is a, c, g, or t
  misc_feature (1140)..(1140): n is a, c, g, or t
gcaaaaatccaacgcggaattaaagtgctggctataagggagactattcccgaaggatttggtctccccataattttgggcgcatcggttcgggggggcttgcccccgaaaaacaaaaaaatcatttttttccaagtgtccgtttggggtaatcaatcaattatggggagcaaaaatccatcgcagaaattaaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtataggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccatcgcagaattaaagtacagactataggggagctattcccgaaggattcggtctccccataaatctgggcgcatcggttcggggggactgccccgaaaacaaaaaaatcgattttttcaagtgntcgtttggngtactncaacaattatggggagcaaaaatccaacgcagaataaaagtacag

SEQ ID NO: 43194 - DNA, 1172 bp, Heterodera glycines
cccccccccccccccctctcccctacgcccaccactccgtcgtgccaatgttgggttcctcctctccccccctcgtctccgtctccccatttactgcccctcattgaccgtacaactcacttttctctccttttaccgacttcatctcctcctattgtaaattcattcacaatcagcacggcctttccttctgagacggaacaacttggaatggtcgaagatcagagttttgtttcaattctgtaagttcacggcaccgaattgtgattggcttgaaagtgtcaattatcacataactgactaatactcattccccgggacaggactcattaattcttctcttaagttacctctcctatatgccgttgtgttgtgttgtcggcttaactgggtgagttgcttagcttcccccccccccacccaccccattgggcaattagttcataattcagaaattgtatggtcgtcgtactcattcggtcagtgcctttttgcttttgttggaatactttaactgaattaatgaattgcttaagctcaaatcgcatcttccagaagctgccctccagcatttatctgctgaccctctctctaatgtcctccgtttttctgctctctcttctgtaattttctgtgccaattccctaataatttgacttttcccgcatttgtcagttctttttgggtggaagaaggctttatcacaggtcaaaacgagcaggtggcatggctaataattgccaataaaattgacaaatcttttggtagcactccatgtttctgtgcaaaagtgccacttttctcggttcgttcccgtacttgcgttttaaatgcttctctctttgtccagcccacttctgcgacttcgccagcgtttggctgatcgttttggtcggctttgagcgacttacgctgctttaccgcgtcagctgtcgccgttcggtggtcaacgccaagcgacacgtcctttttctgctcattctcagcggacttgccaacctttggtcatttttacaccaaaaagtgtccatttacattttgggacactttaattaatctgagccactttttggaaagaaattatattcacttccctcctccctctttaggatagttttttgtgctgaaattaacgagtttggcgaatgcgacattaatgtgagtttttgagt

SEQ ID NO: 43195 - DNA, 961 bp, Heterodera glycines
  misc_feature (19)..(19): n is a, c, g, or t
  misc_feature (931)..(931): n is a, c, g, or t
tgaaagattttaaaataanttgaaaaaagcaaaaatatatttttaaattattctttctaaatttgtatgattttatttaaaatgtgtttaagttatgctttaaatatttttcatttccaaaaattttttttctttgtaaactaaaatttttctaaaatctttcatttttactaaaattaaaatttaattggaatatttaataaaacaatatttatataatttttaaaataattttatttaaaaaatttaattcgaatattaaaaaaataataatattttaatgcttttttttactttgcaaaaatttcctccaatgacgtctcctgcaagtccaacagcagcactgccttgttcagcagatggtcaatgtccatggtggcacggatctccgagccgaagtccttcatcgggatcttctcatgcttggagtacatcagagtgacattgtcgaactcatctgggatggaaaaattaaacatttttagatatattttaaattattttattatatttattttaattattatttattataacataaataaaatgacacgcacagcacacaatggaacagaaacaagttaaaaaaatgttcaaatgcagatcagttatgcactctttttttggcgttacgtgattaaacaagatactggatagataatcagcagatttaacaaaaaaaagccaacattttattggcactattcaccattttcgtaaaaaaataataataaatatgaatgaaatgcgctcatttgttaggttaatttgatcagcgccatatgattgttagctaatagtgaaaaatgacataaaaatattgtttaacaaataacgcaaaataaaacatttttattatcccataatccaaatctaatgaagattaaaaaaaaataaacaattatgtctgagcgtagcactgacattcccntcccctgtcacgcataatcacttaattgac

SEQ ID NO: 43196 - DNA, 1437 bp, Heterodera glycines
  misc_feature (73)..(73): n is a, c, g, or t
  misc_feature (99)..(99): n is a, c, g, or t
  misc_feature (140)..(140): n is a, c, g, or t
ccaaaagtttttgaaaaatgcgcgcaaaaaaatgttaaaatctgatttttttatcccgaatgcactaaaattntatgattgctaatttttcctccccanaattgtttaaaatcgttaatgggagacaaaaatatactatntgatacatttttgatcgaataaattgtaaaaataacgatttgaagcaattttgcaaaatgttcttatttttgacactaaaatcttattttttggccttaatgttcttattttgaaaattttttgatcacatccctggcctatacctataattttttttaaaggtaaaaaaccctcttgagctgtcgttttttgcggcgcgtttttcaaaaacttgggctgggattttttgtttaaaagattttctcgagggtactgatacagacagagtcatccattccatgcatattcatcgtttttttgaaaatgcggagttttccaaatttatttttctttttgactatgtaaatgttatttattttggccttgcaaaattcgctaaattttaattttgactagacattttttacctatttttttcttgaaaattgtttttccaccaatttcattaataagagcaattttccaaattagccaaacttaaatggtcagtacgtatatctactgggggtggaaagggaggtatacgtcggcacaaatttactcatttttttaaaccaatcatttccgatgtaaaagtcccaaaaagccaaacaaaaattaaattatcaaacgaaagaagcaacaattttttggggattttcccttgtaaaaacggaagagccgatctcgagttaaaaagcattttgataaaaaaacaaagcatcatcctataggttgggttaaaataagtagctgtgcaaaatttgaagaaaatctgacccgaggaaaatttttttgacccaggacaaaggtttttctttttctctcatttgggcgtactatttccttgtctctaacatataaaataacacatgaatcatttatctgccaataaacaatttttttaaacttttgactaacttagaaatattcttcagaattttcccttcaaaatgagcataaaatgattttatttgttctagtattgaccaagttataagctaaaaaatttcaatctagcatcaatttttccatttgcccccttttagatcagtgggttgggtgtcaaaggaacacaagttgaggagctgtacaccattgacgatgaacaacatctgtctaacttaaggccagtctccctcctttttttcgcggtttttctttcattttgcgtctttaggcccatttacggtctggtcttcctcttcaaatggcgtcccggcgaagaatcagaaggaactccgatgcccgacgcgcccgtgtactttgcccaacaggtgggcgcttcaaagcttttttccccaatttaaaacaaat

SEQ ID NO: 43197 - DNA, 980 bp, Heterodera glycines
tgaaattgtgatttttgaattccaattttccctgagtcttttgtttactcaaatgtgcgtcactcttcccttgcattggttgcccgtactggatccgctggtatcaattctctgtgtcagtgactaccgtaaggcgctggccaatttcatccggtatacgatatgcaggagacaaaatgccgttgcacaacagcaaattccgatgaatatcctccaaaataacaatcaaaaagcgcaacttcctattgttgcgtcataattgcacaggtgaattctttgtctttatttaagaactaccaaataatatgagaacgattcaagttatgcgcgcaatgttcattggtcagacattaaaattttatccaaattcattgagtttaaacttcttattcagattttgaatttttcctcgtttttttttattaaaataaaataggcaaatatcttttaaataaacaaattttttgagaacactgtttaaaaaagcaaaaaatttattttaattgagaatatagataaattcactatgacttgatgattagtagttatttcttaaattccgagcacatttcttaaatccgtaaagggaaggaaaacaaaaaattaacacatataaattcatgcttggcacaaccaattaatattcttggtaacattcaacagctctaggtttttttaacagaatactattttgaaaatttatcgtataaaaaaaagtcatgtttaaaatttcttaatatgggtaagaattttttgtccataaaattttttattcaatggattttgttaaacattttatgtttaatagattataccgaggagttcaaattctaataagaaaatttaatttaattgcttctgtaaaaattataaagcattaaacatactatgtttttgctatgctcttgcatataatcataaatagggctcggatttttaggcaaagggctatttttttcctgagctccccgggcctaaaa

SEQ ID NO: 43198 - DNA, 1293 bp, Heterodera glycines
  misc_feature (1268)..(1268): n is a, c, g, or t
ttacctttttctttttttctaaattctcggagaaacgtccgtttccgttcgttcacgtatggatatgtatgtacaatgagaattaaaatgatgtttttaattttcttagtagattatatttagaatttgatttggttcattaaaatataaaaataatttcttttgataataaattatttttatttagttttaaattgtatataatttattgaattatatatctttttttgtgcttttttatgttttcaataattttgtcaatttttaaatgtttttcattatttctaaaatttgatttaatctttctgccgacgcttctttggtcatttctgtttttaaatgtaaatctttcttttcccctttaattattatattcattcagtttactcaattcccttttatgttctccattttttcaagattaaattttctttggacataatataaagcaataactttttatagcaaaattaaaaagtaatttttatttattatcaaattgcatgaatttttctcacttttcctttgaagccgtgaattgatatgaattattaaaacatatttaaaataaactataaataacaaaaaagtttataatattctcgttatcggtaattcgcaattttaaaattatttaattttttaatcgaaaattcgatttccattaatataacgtgatttaattaatcttccgtttttaattcgatcgtaattaatttaagttttcgtttcatttatcacctttatatttagttttaattatgtctaatttataaattcccaatttcacgcaatccaaacgtccacctcctccccccccctccctagtttttgtttttctccaattttctgggtttttaaaacttctttatattagttagaataaatggttgaaattgtgaaaattttcgaaataaaattcctaggagctgctaaaatttgttgtattaaaatatttttggtcattataaagcttttgaatttagtttaatgggttttaaatatcagcagcttcacaaaattaatcaaagaaattttttgtttaaactaaaacaaatttaatggtttgtttaatctcaattataatcagaattggagtataataaaaaggattttttccaaaaaattattgatttaattaatttaaatcaaaaaaataattatttttttttgatttcctttattatcatttgtagtcctaagggttaattttattagcctacaatttttttaatattcaaaaaagccagggcccaaaattttcgaanaaccactttttgagtacttattttt

SEQ ID NO: 43199 - DNA, 1077 bp, Heterodera glycines
  misc_feature (991)..(991): n is a, c, g, or t
  misc_feature (1042)..(1042): n is a, c, g, or t
caaaataggacgatatcctgcaaaaattagcctatcagtattacgaaccttttctgctgctaatcgctacctttaattagatagcattcgcaattagattatgagttcgttattcaaattgccctctaacgtcttggagtaaaaactcgcaatattttaaccactaaagaatcaaatagatttgtttttctagccttacgcaaacatttcgaaatatttcgccggcatttgtggcaattcgacactagaaaagcgattttgttggttttagaaccttagcgtcctagtaatgaggtacaattaaatcctaatttatgattaaaattgtgcataaaggtcaataaataattttcctctgggagaccgaaattttttgattgtacaccgtaacccttttaagtccaatgtccaaaataggacgataatccttggcaaaattagcctatcagtatttacgaaccttttctgctgctaatcgctacctttaattagatagcattcgcaattagattatgagttcgttattcaaattgccctctaacttcttggagtaaaaactcgcaatattttaaccactaaagaatcaaatagatttgtttttctagccttacgcaaacatttcgaaatatttcgccggcatttgtggcaattcgacactagaaaagcgattttgttggttttagaaccttagcgtcctagtaatgaggtacaattaaatcctaatttatgattaaaattgtgcataaaggtcaataaataattttcctctgggagaccgaaattttttgattgtacaccgtaacccttttaagtccaatgtccaaaataggacgataatccttggcaaaattagcctatcagtatttacgaaccttttctgctgctaatcgctacctttaattagatagcattcgcaattagattatgagttcgttattcaaattgccctctaacttcttggagtaaaaactcgcaatattttaaccactanagaatcaaatagattttgttttctagccctacgcaaacatttcgaaatatntcgccggcatttgtgtcaattcgacactagaaaag

SEQ ID NO: 43200 - DNA, 1333 bp, Heterodera glycines
  misc_feature (7)..(7): n is a, c, g, or t
tttaacncaattttcttaacaaaatgcattaaaatttcaaaatttcccggcgcgcttatcggcaccgctggaaccccacttcaccttaattttttgaaatttgaaacccaaaaagtgcaaaaatgtagtcattttttagcgaaaagcggctatattttccattttttgctgctttaattaagctacgttaacggcgctgtgctctcatttctgcgccgcttaaagcctcttttcgaaatgggaatcactttgcattttacgattgacttcaaacaaactcgaagtttggatctgcttgcccaacagcttatccccctggtcggcatcgctaacatcaccggaatttacattggccaatggtcagttaaacttgtcgactttggcactgcgtttgcactttctccgcttaagccacccacacggcatctgcgagttactgaagcgcacctcctcaacctttttcatcaattgccccaatctccgatcaatttattttaagggcatggaacatatgataatgtacggcagagccccaggcccaaacatgagggaatggctccaaacgccgcgcggcgatgggcgtccaaaagtgttttatcgcaatattagcacattcgttattggtcactacacgaaggcatgtcggaaatggggaaaagcatttaaaaaatcgactctatgctgctaatgactgattttaatgcacttttgaggactttttggctgccaccagtccggccaattacatcgtctgttttgaacaatattttaatgggtacgacccgcaagactttgaaatggacaatttgcggaccaacgaacgcttatcgctgcgcctggttgagaagaaaaggcagaacaaatattgcatgacgcgggcgccaattgggcgcaaagagcagcagtgggcgcaatgggagcgagaagcatggcgcgaggaggagatgcacaatttgctcgaatttcggctggaagacgcgaacatcggcacggacattcaatgatcagagagatacattgatcataattcatggaaatattgtaagacaaaggctttttcatatggtcgggaataataatttagttcaattcgactcggatgatcacacataaataaatttcgtttcttttaaattttacattttaaaaaaggatttcgttacttttccgttatgcctaaaatatgcgaaaataggttctttttaggctctaaaacttaggaaaaataggcttttgcctaaaaattggagccctactgatcacgaatttgatgtcaaaattaaaaaaactcagattttgtatgtgatttttatctcacgatttaatggatttt

SEQ ID NO: 43201 - DNA, 949 bp, Heterodera glycines
aaaaagagatagacgttttttcaaattttcagagacacactcgcccagaaagaaaatccagaaaaattagggtcgtcgctactattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagaaacaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagaaacaaactcgcccagaaagaaaatccagaaaaattagggtcgtcgctattattccaaaatgtgggtggagttcatttgagtgttgagcagaaaaagagatagacgttttttcaaaattttcagagccaaactcgcccagaaagaaaatccagaaaaattagggtcgtcgctattattccgaaaatgtgggtggagttcatttgagtggtgagcagaaagagagatagacgttttttcaaaattttcagagacaaactcgcccagaaagaaatccagaaaaattagggtcgt

SEQ ID NO: 43202 - DNA, 1101 bp, Heterodera glycines
atgaagaattatggggttaattaaattcttataacagtcaataaaacatttagcgttcaacaaaataaaatttatcgcggcaaaaacctggtaaatctaccgttaacaagtcgatttttggaaaaactaaagccagaaactacggtaatttccggtttttaccgttaccgctaccggagaaaatcgaatttgccgaatattagaatattttccaacttactcttgtctcagtcagttcgacatggtcaatgtggctggtaacctttaaaagattttggtaataaattttttttaggttttttttccaaaaaattacataccctcgttgtaaagtcatagtcttcgggtacttcgaaaaagtccgcatcacaatacaccttaaagccatttaaaatataattttgaaacttttgaaaatgtagaaagaaaaaaacggtggaaatattttttgcataattctcacctccttttctcggatatgagtaagcaatttgattttcaggatgagacctaaacaattagtaaataaatttttgttttcattaaaaagtgcatatcaattaaaattatttatttattcaccagtgatggcgccaacaacggtggcaaatgccaaagtgatgcccaaccccgccagctggtacaatgcctgttcaaacttgtaacgtccggacggcacaattcgggaactataacgtataaaaaaaatttccaatccaatctttggcattcacttacttctccgggaatgagttgttctggtagcatgcaagtgccaatgagctggccaaaacgccaatgattcctcaaataaaatttaaatgaattggcaacgaaaataaatatatttaccgggaaatattattttttatttttattaaattccatttccaacctggcaatgcgtgaagattaaaaactccttaaataagaaaaaggaattcaatattttattattttaaaaattaccgcgcgtgtcagtgatgttgaactttttctccagaaaatgcggcttaaataaagaaaaatttatcgatatttaggcaaaaaaaaaacaacaacaacgtactccaaagtaaataaagccaagaacactgatag

SEQ ID NO: 43203 - DNA, 1041 bp, Heterodera glycines
  misc_feature (963)..(964): n is a, c, g, or t
ttcataaaattcgccattttagctaatctttcgattctaccgtactaatcgtcactaaacacaatattttggcattttctctttccttgaattttccattgatattgaaattaaatttcttaacacacctttaaattgtcgcataaaacaaaaccaaatattttgctttgattattcacaaattttccatttttttaaaaatggatatgagatttataccaaaaaatttttttgtgctaatattttcttaatatttcattttcattttccatctaattttcatattcataaatttgaatttttagcaatgtttatgcaatacatatcaatggatattttatattttaagctaagattctattgtaatattgaaaaagcggaatattactgactaaaaataatttccaatggttaaatttatatttataaattaaattttctaagttgtttttttcatcaattaaaaagtgcaaattttgctgctttctttcaattaattctaccgttttttttttgccttttgtttcgtatatattttcaaatttttaaataaaaaaattagttggcatcatgcccatttttttgttcccaattttcagattgactggaactaccacaactttttcgggctgaccattagggacaattttcatgatggcttggacattttgtacaacgatttgacacggaaaccatccattcgcaaatcgctgatcacacggaaccggcgcaacggaatggtcatccgatcaatgggactcaccgcggaaaatgtaattttgattaattattaaaagccatttaaaataattaaccatcaatcatcattagggagcagatttttatttataaaaaatgccaaaaaatttaaataatatttaagagaaacggccaaagtatttaagaaaattttgtgactaaatttagagtaacaaaaatcaaaaaaattttttctaattgaannaaatcacacaaaaatgcgagaaaaaaaaattttttttccacaccccccccccctgaaaaataaaacaaaaaattttc

SEQ ID NO: 43204 - DNA, 816 bp, Heterodera glycines
ttgctgttgctgaaaaaatgggtcatattttttttttggtacaacttagggacatttcggcgccgccgtatcggacccaaaaatttttcataacagtagttattaatgatctttaaatggatttatttaataatttgaaaaaaatattttgtgaaaatctggcaattatttgcacaatgctcacccgagacaaccgccgtactcaaacagcaggcattggttggtgtgcaggtcgaagaaaaagcgacgcgaatggccctcacatggaccgctgactttgggcagaacgcacgggtctaacgataacaaattttatcatttttttgatcagtcaatcgcagtgctggaatgatcaggctgatcagtttaagccacacgttttgtgtgaattttgatcgggtcacagaattgacagcgttcatcagttttggtttcatgtttctatgttaaaatcagatcaggaagcattgatcacccatttatctgatcagagcattgaaagcgaattttgctttcactgtccatgctaaagtctgctttcagaaagcattggtctccatcatgcactgatcagcccattcctgagttgatttcactattctattttttaaattagattataaaaatattgatcaatgatcatcatgcattaatcaggccgaatcacgattggtttggaacagacatttcactcagattaaatgcaggaatttgtaacaaaattttctgatcaaagctttcgatcacttagaccaatcctatgtgatccaccaatacggatttaagaaaccttttatttaattttaaaattagaaa

SEQ ID NO: 43205 - DNA, 1261 bp, Heterodera glycines
agttaaattaaaaatcgaaaaccgaacaatcttttaatctttttatgaaataatgcatttatttatgtttaattaatttttttattattcgtctaacaaataagcatattcaaattataaataacaaatttaaaatttaattaaaatttgaatatttctctcaccaaattggaaaaatcattgaatgtgtgcttgtttttattttacaatttattttatacagctactcattcgactttttcatctgaaaccctgtttttttgagaacattttgaatcgtaattttaattaaaaaattttatgactctattttttggggcatattttatttgtttataagaaaaagccaagaaaaatagccaatttctaaatatgctgttaatttaaattataaatattaaaaatgaaagatatcttaatgaataatgaatttttcaattttaaatttatgacatttttaaccatttcatttgcatatggtggataaggaatttcaaaaacatttatcactgatatttattttaaagttcatattagttaataacaaatattttatactttatatttactaatgatattcaattagcgtgattcattgggcggtgtaattactttttaagagaaaagttttattaatgtttataaatttgtttttgcaatattactataagatggtgaatacaaaaaatttatgcataaataatagtgtaatcattttatttttatttcttttggtcgcaaataatttacactcttttattcgacgaatattttttcttatattataatttaaagttcactgctgtaatttttttaaattatgccaaattaatgataaaatggacataaagttttgaatggataaaattctgttttattataacgtgacttttcgtttttcataaattatttcattgaattatattaatttttaatttgagtgtatatatactacttaaaataaatttattgacattttgagaaatttaagttcttttttacaaaattcaaattaacgtaattaatcttaaatttagtttatatatttttaactacatttagaaattttcaggattctaggtcgatttcttaggggtgaatttttccaaaatttttttttgtcgattcttaggggtgtatttttcgtttttattgcatttttgttaataaatttcccaaaaatccgcgaaatatgggcgaaaataagggcgaaacgccaaaatagggataaaaatttattttaggcgcgaacacccaaaat

SEQ ID NO: 43206 - DNA, 665 bp, Heterodera glycines
tgtccaaatgtccactgtccagatgtgcggtcacgccccctccccccacttacttcgttcagtgcgtattccatttctttagccgctcggtctgctggcgccattccgcgcgtgcgttccgttcgcacgggcggggcccaatcgttgtcaacagaccaggaatgttggcaaaaaatgccaacaatggccaccaaagtgaaccggcagagaaggcaaatcatttggggacaaaggtgcgaaaagatcagtcgaactgatgtaagacagaaagcgaaatttaaatggcaaaaactaagcggaaaacggcagccaaatctaaaaatatttttaatttaaataaattattccctaaatccgctcattagcacgtatattttcttcaatgagcgaaattacatattgatggaattatcgtccatcgtttcgttcctgtgcctttcccccgaggggcaattatgccgtcgaattggcggcatcggcaaaatgctccttgggatccggcttttgaggtccgccgaattttttttttttgtttttgtatatatgcataaatgtgaaaactgattggggggggggggataatgatggtgaaggattcagagaaagacagaaaaacggacggacggagttggacagtgaaaattgggggggggggggggaattgt

SEQ ID NO: 43207 - DNA, 874 bp, Heterodera glycines
ctccccataattaggtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatt

SEQ ID NO: 43208 - DNA, 829 bp, Heterodera glycines
  misc_feature (776)..(776): n is a, c, g, or t
  misc_feature (815)..(815): n is a, c, g, or t
tatcgccgctaaaatttggtgctcggacatttcctaaatcccgtcattaggaagaagaaaaagataaacatggagaaatattagttattaaattgtaatctaatggattggaattctaaattcattgtgccaatatatggcgatggcaatggcaatggtttgccaagtgccaattagatgtataatcttaattataataacgaaacaaattattttttaattttgctttaataatatacggcattagtttgaaaaattctatcaaattttggaaggaataactaattattaacccattatttcttttattttctttatgattgcaggtttaggaagacaagtcaaaacaacccacattaaattacacaaaaatcaaggagataaggtaatatgacatttgaaatttaagagtgaattgccatgagaacacacatacaataaccaattaccataatttgttttttggttttttttgtaaagtttttgaatactttaaacaattgaattaacgaattagaacaatattcattttgacttttattcaccatttcaaatgactaattttaaaaaataaattcaaaaatgagaaaaaagaacgaaaaataaagctttaagtgatggatgaagagataaaggaatttaaaattaagaaaaaatataaagaattaaattatcaaaaataaacaaagccggagaaaaaaaaatataaaaactaataaatctcttcccaatttatcagtttcttttttcatttagatttacagaattttgagtanatattttttgtagaaataatttactcgaataatttttanaaattcaaaaatgc

SEQ ID NO: 43209 - DNA, 1122 bp, Heterodera glycines
cggtaggggtcaactccgtctggccaactccgtctcgccaactccgtctggccaactccgtcttggggccaactccgtctgagccaactccgtctcgccaactccgtctggccaactccgtcttggggccaactccgtctgagccaactccgtctcgccaactccgtcttgccaactccgtcttagtgtataaggggccaactccgtctcagagagaaaaaatcattttaagctaaagaattttcttaaaatctaaattttattagatcgggatcaccttctttttgaagaaagttttttttaatgtcataaaaacatggttccaagggttttcggagtcgctagtcacaaatctaacatccatttcgactaaattcgaaccacgaacccgtttcgaacaaaaatattttgaaaattttcactttgattcctaaattgaccaaaataagccaaatttagtcaggaatcattgcaacaatagaataaggtcaataagcacagttacgaacataaaagtgaattttcagtctttcgaatgatatcaattttcggttcttcaaggaattgcggcagtggcgtcgtcagttcaatttcattgcgtacttattcgttctagttacaaccataaatgtgtataggcaaagaataaatagtttttacactttttttttagctttcttggtcggaacgtttcccattacagccctaggcatttcatgcggtaggagtgctatggttatcgctgaaataaccttccttatagcgccaggtcgttcaataccggtgtatgattttttgtccgatgacatttcgccctcttgcgatgacatgcgtgtattcttattttttccgatctcccataatttacccctttgtgtggtccctcaagactaatgtactcggccatctgatttgcgcaactacgaagttcgtctgcagacaaatccattctataaacggaaatgatacacataacgttcagtttcgataataatcatcttctcagagttataaatccggcatttagcgcttgtcctgtgcgcgcgaagcggccgaatgtcccacaagaaaattacaaaacgggcgcgaagcgcccatcctgagtacgtaaaacggacgaat

SEQ ID NO: 43210 - DNA, 1495 bp, Heterodera glycines
tgattcggtggatggtggtgcatggccgttcttccttttaggagcgatttgtctggtttattccgataacgagcgcgactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcacccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctaagggggagtgcctggattactggcattcctgctttgatt

SEQ ID NO: 43211 - DNA, 93 bp, Heterodera glycines
cccgatcaacggcctgaacttcgtcgactgcctgaagctgttcaacgaagacccgcagaccgaaggcatcatcatggttggcgaaatcggcgg

SEQ ID NO: 43212 - DNA, 1028 bp, Heterodera glycines
ttaatataacattttatttgattttaccgacattgagaatttctttttttttgtattgtttggcgcatctagaaataaaaattcatttttgactataaatacaacataacaaatcagcgatataaactttttcgttatcttgtctttttcctcctcatgtgttgattaaaacattcaaaatataaactaaagtgaacttatttgttcggaaaaaatcaaacaattaacttaaatggaaagaaaaaaagttgcaagaaataattccgaccaaaatgatcggtcatttcaatgtgcacctcacttgcgccgagtttatgcatcacttttgctgctttgacccatcatttgtggcggggacaacgggctaaataacattgataattcaaattaatcaattacaaaatgcaaaagctgctgttgttgttttttacccaatgctattattgtcaccaacaacaaaaaagtggtcagtgattaattcgcccaaattttcgcctttccgctgaaccgccgccgtctccccaattgggcatcgcttcatcagccaatgttttaaagtgaaattccatatttgtttctttagtgtcagcttttctcctgtccgttcgttcattaattcaaatggttcaataattgtcgctgacggagaaagtttaaaatgaattttgtaagggcaagaaatggtggcacggagaaacgcctaaacaaagcaaaggcatgtattgtatgatcaattttggcaaccctaaaattcaccaaagcggacccccctttacaaatttatgggtttctaactcctatggtcactcccccgcttgctttttaaaaaaagtattgagcacaaaaattccagactaaatgtataccataaagaggcatttcattgaaaagaaaaatatatcttatgaatagagatgtacctggtttatttgcatattgatagttttgcataattacaacctaatgagcaaaacttgtaaagcagttattaaagcgatatttgaaaaaatccatctttcgtgaataaa

SEQ ID NO: 43213 - DNA, 1496 bp, Heterodera glycines
  misc_feature (50)..(50): n is a, c, g, or t
aaaatgcaaatacaaaaaattcgcttttttcatatatttttttgtctttnaattctctgtcactttgcccgtataatttaaaaattcctcacgaacaatgccaacctaaatattatcagttatttttattactcttaaaaatcctgtaatccgtcatgacggtctccaaatatcaaccatttctataaatcataaaatttatctgactaattaagatttaaaaattaatctttgattgatcaccatgcattttttcaaaatatccgcctgattaattttgtcatcttctcaatttagttttttatttttctccctcctattagttaattctttggcatttcagcgccagtattttggtaacaaactcatttaattaagcaaaaatgaagtgctttccataataattaaattttaaaatttaattgcataagaaaaaattttggcgccgaaacgctggtgtgccaaagcttcccatgtccctttttctgactagatctaaaaattatttgaacaataactctaattcggttcttatttttaaatcaaaattttaaaaatggaatatatattttttaatttacatttttatttaataaaatgccgaattcgagtttaggtcccaccctatcaccatcctgttcctcctcctcaaccacccaaatggcgccgccgaatgttcggctcccgtattgtccgcccaaccatggacagttcatctgctgatgtttctgctccggcaagcaaacacagggtgtctgtccaattagtcatatttggggataggattttaaaattaaaaatgttaaaaacaaaatgccaaagttgcgagaaatgccgaaattatacaaatatatgttgttaattagcgcactaattaagtgtaattttgggaattaattagggggatgagttggacccgtcggacaacacactgatgaacactgctgttgtggtgcgcccacgggatcgtcaacatttccggcacagcaatgtgcccccggtgttaaacattcttgatcaggcaaccgatctgtacggtgatctttttcggatggtaatcgatccggaagggattaacggaggcagcggcggtggtgcgcaagtcataacatcagacgaggaggaatacggacgatgatagcagcagctggattttgttttttttactcttgattcactggggattcagtttttggcattaaaaattgcaaaattggcactttattggtgccaatgcatttaaaaatttaaaattaattaagaatatttaaaaaatagtttcgaattttgccaaaaaggaattcctgatcatcctttaattgattgtcttttctcaaatgattatgatttattattattcccatatcttttatctgttcctcattctgattttctgttctcttgtatgatctggatttttttattaaaataaattatcttttgaaaattatttttaaaacaaaaaaataagttaatgaatttttttttaatttttt

SEQ ID NO: 43214 - DNA, 1156 bp, Heterodera glycines
  misc_feature (1100)..(1100): n is a, c, g, or t
cgtacctgagattgggagctttgttactgtaacttaactgttgtcgacaataattgcaaaaaaaaaattaaaatagttctttattattttaattatggttaaagaatttccaaaaaatataagggacaagaaaaaattttgttccgttttttttttgctattattgaccaaatattttccctatcatcatatgtaaacttggactgtcatcattttttcagtaaaatacggcattcttttaccttgtgaatttgctatcactttcaacatttttttttctgaatataaacatttgggcttatttttgtcaaagatttatttattcaaataaaattgcaaattaagaattaaaaataaatcgtgaggcattttcgtcaactttacaaatatttatttaaaaatattttttgctttaattaataaattttatatgtaaaaaaaatgagggggggggggatttggcatgcgtcccttaaagatattgttggcaaatgattgccaaatctgtgctgcgctgaaatgcttcaacagttggggggaggggggcagaatttggcaggatacccttaaacagtaggaagattttgccaaccttcaaaattgctttccttttaaatgctttttcatttatttagcaaatcccattttcatttttgcattttattttgaattgctctctctctctctctcttcccaatgaattttatttatggaattttcggcatgattctcctcgtttttgaatgtgtaatttcagatggtggaaactcagaggtgattttggtttttttttttaagcaaatctccaattttacaactctggtatattttatcttattttcattttttacgcatttgggtttttagtataatttaattaaattttaaaagtcacttttaatcgacagctgaaaagtgatgacgaatttgtcagtttcttgaaaaatgacttaaaaaaatatcaaaacggaattaacaaggatgcaatttaccaaaacacaaattgtttaatttttgaagcgcaccttggcgttttgtgtttgatgaaaaacaattggaactgtgagaaaaaagtcaaaaaaggcaatgaagaaatatgncaaaaatatagcagatatatgctttttttatatgaatatgttatacgagtgtacta

SEQ ID NO: 43215 - DNA, 1113 bp, Heterodera glycines
  misc_feature (7)..(8): n is a, c, g, or t
cctgcannggtctctgttaaaaaacactcaaaattcggttttttcccggccgtgactatcggcaaatcattagtcatagatttctttttctctatttttaattttaaatcaaattttaaacatttaaatattttaatttaaaaaatgcaatggaaaaattatttaaaaataaataaaaataattttccaattttattagctgaaaagagttccggtggatgaatgtgaaaacattggaaaggaaaagaggccaattgcgggcggagaaacgtcgtcaaattccactggcagcggagagaacaaaatttgggcacaatcgccgcaggggaaaattggcaattttaaattaattatttttaaaatcaaaattataaaaataaatgttaatcaagccaatcgatatgaaaatgttttgcagttgttttcgaatgcggcagcagcggaactgaagaaacgaacagttcataaaaacatggaaaagtgtgcgtggtgagacgaaccgaaaatagtctcagtgtcaataaaaataaaaaatatttaaatttaattatacaattcaattcggtctcgaaaaatataattttaataaagacaattattttaaaaaaataaactaaaataaaaactttccacctccgaccaaaaaaaagttacatcgaaacgaaaattttaattttaaatcttgaagctacaaatgaagtggcaagtaagtttacttattgtgctttattcatggaacaaaatctagcatttattttttaaactgaaaagcaataaaatgagaaatgagagatcgttgcgaattaaaaaacgacaaaattatcacaaaaacgacgaatttttgtgtcatcctttccaattagcgtcgttgtccaaaatttgatgcaaaatccatcggaagagtcgttgtcggcgtggcctcagacggaaattggaccgcatctcgtgaccgtattccaccagcatatggtagagggtgcctaatgacaaaagggcacaatttgtgtgaaaattaggaatttcatttttttaaagtgagtttttttcccatcaataaatttttattttgaaaattttctttaaaaacccaccgactgcgacacaacggacacg

SEQ ID NO: 43216 - DNA, 1252 bp, Heterodera glycines
  misc_feature (1147)..(1147): n is a, c, g, or t
  misc_feature (1222)..(1222): n is a, c, g, or t
cccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacgatcgccattttatttcacagaggatttttatatttagaggtcatcccagaanaatggctatctctttttttgataaattttatacacatacaaatgctctcgagcatgataggggagggcggtgcgncatagaccttttatttttgagggaattttt

SEQ ID NO: 43217 - DNA, 1613 bp, Heterodera glycines
  misc_feature (1492)..(1492): n is a, c, g, or t
tgtttatgtaatatttaattattgatttccaaaataatgtaagcttttcgaaatgcttccgcggactttcattctttcgggacattccaataagcactgtatggggggtaatttgtagcaaatgctaataaattggtcaagaaaatttatagatttcttcaaaagtcataaaggtcgaaccaccccccattcttgcgagccttgtcgcaccctcctcagtcgtgtacgcccccccgggactcttcggtttctttttcgaacaccgaatttggatgtcatcattagggatgggattattaggcaaaaggctagttaaagaagagctccccgtggcctgaaatgctcgaaaaacatgtattttttggctgtcgttaaggtacttttcgagttatctctgcctattttttaagaggttgattttaacgcctaaaaagcataaaaaatagagaaagaacctatctaggcgtttgtgcccaaaacttgtttatactagtgcaataagaacgaaaaatccacccctaaggatcgcccacacgatcttcaagaacacagcgctaagtcatgaaggggggagcgaggaagggaatgggcgcatttccccctcttcccctcgcccactcctcactctaaccggggcacacattgcctacctcgtccactttctccccccccccccctccattatatttacatcaattttcctttctatcttttcctgtctaattcttctgtcctctcacttactctctcctcccctttatttcttctttatctgcagaataaaggaattctgtgattaattgtttgaatatgtagctaaaaaagagtggatgaaagagcctaacaggaggaggggaagtgtcgagagtatttttaaatgtttgtgtaaagcggaagtatagacaaaaggtgctgccgcttttgacaaggattaatacaaacaccacaaacgacacgcgattaagtacggctcgaattcagtgccaactttttttgacagagaaattttcttaaattcaaaaaaggggcgtttccatccttgatattaccaaaattcatcgtgagttgacaccccaaaacacactggaaattgagcccaatttacagtgtattttagtgtgtcccgataaccctaaagaaaatatggctgaaaatataacccaaccactaattataattggtttataattgattcagcaacccccgccccttctctccttttattggtttttgtccagggttttctcgcgttggaaggtattttccctattttcattgtttctaagaaaatgcacaattaggtaattgcccatcacattcattcattcattcgccttttcgttactcggcagatgattgagacctttttccctttgttttcatatgaagttgcgtctcccaacagacaatggcattacttgttatgtatttccttttaaatgggactggaactgacctgaattttcccgggttctaagttccggttttttanatgccaatccctttgccggtatggtcgggaaaggaatgaggtctgagtgaaaaattgtggaaatcaaggaatgagaggaaacttaaaattttttcattttttcaaaccatttcttatacct

SEQ ID NO: 43218 - DNA, 1292 bp, Heterodera glycines
cattttatgaacgatggtggagagaaagagatggctgcttttacggtcgtccgccacaatttacgataaattgagaggagatatatggtgggcaaaagaagggaaagagaaacgcacgcacgcggggggagggggtaagagagaaaagagagggagagtgaaatggagagagagaggaagggatgatagagaaggagaaagagagagagagacggtgtaggatgaaaggacggaaaagatgaatagctttttaagcacttggacccatcccaaagatttgacttcttcaagggtttggtatccaaaacaacaccaaaaaacataattttttaattcttagagagtcacattttaaaaaaattttatttgcggatgacgacatggatttatttaatgcaatttagtaaggaaatgtttaacttttcaaaaaattttctcatttttcttgacaatttttgatttaagccccctccctggctaacgggcaggacaaaagaaaactcatcaaaatggccccactgattggtatttgtcctcgcgatctttgcaacgcacaaaatactggcgaatgtacggcaaactttggtcttgacgacggattctaaaacaaaaagaaaaatgtgggattgaaaaatgtttaaaccaaaaatatatacgtgatgagtgttgggtcggcgataagttggtcggcgaatttgatgacagcatcggaataagtggcactgaacagcatacattggcacgatgggttagcggagataatcgcgctaaatcgggaggggggggggaatgaattaattggtggcaaaagggacacaaggactaggcccgtagccagaaaattttttctccagtgtcatttttcaagatttttagcgcttagcgaaaacagaaattgtagcggttttgcatcaaaaaatgctgccattttggtgtaaattttcaaaaaatattaatacaatggggtccggcggtgccgacaggaaagtttttttttgaaattttaatgaagtccgataagaaattgagtaaaaattttcaaaaattttttgggaaattttaaatttttcatttccggggtgggggagagaatttatcctcccactaatggcaccgacttctgtatgcgaatgcttttgtcttggtatccctgctggccgatcattacgtccgcctcatccaaagcaaaagagacgatttttgaggcatcaatgtgttttcttggggaaaatatgaatttattaaatattgctagcggagtctttcttacccgcatcatccaatcgagcatt

SEQ ID NO: 43219 - DNA, 908 bp, Heterodera glycines
ataaacagggctgtaaaaaatatgcacgaaaagtagccaaaatatgcgcataaatatgcagataaagtcgtgaaatatgcacaaaaaacttgaaaattaggagtgaaaatgaatttaaaaaatttatttctcataaatatcgattatttttgcaatttcaaatcaaaaatttctcaagattttcagtagtgaagctcactgttgacctactcgcgcacccattcaaatttattatttaatttttggataatcaaattttttcctaagggatatttaaatcggaaaatatttggcgaaaatggcaaaatatgcaaaaaatcggaaattatgcacaaaaaatggcaaaatatacacgaaatatgcacaaaaagccaaaatatgcaaatatgcacaaaaatcccgaaatatgcaaataaaagtcccaaattttataagcaaataccaaaaagaaggtgttggacatagaatccaggaaaaaaatgcatttgcataaaatttacagccctgcttataaaacattccgctgtaaacaacggatggaataatttaaaaaaagatcctttgaaaattgtaaaaagataaaagaatttaatatccataatttcactgtcatttattaaaattaaaataatttaaaaaattatagctttgctagtatatgacaatgctcgcttaattaaaatggaagttttgagtttaattgttgaattcaattaatttacctgtttcattttggtgtatgattattttttattaataaaatatatttttccattattaaaggatatttttctatttatttaatggcacttttaagtaggcaaaattttccttaaaatttttcaatcttgtgcgatacttcgtgagcagtaaaatgcttcgttgtcgcacttgccaaaattattttt

SEQ ID NO: 43220 - DNA, 764 bp, Heterodera glycines
cggaaatgttgacactttgaatgtgtggaggagcaagtcaaggcttttttgcaagtcaaaaaagcaaaaaggatatgcaaataaattttaaccattgagaaataaaattgtttttctgtaaatgttaaacaccggcgatatattgaacaaacactaattctaattaattaataattacgattattgggatgagtggagaaggatatgtatgcttgttgtctcgataaaacggcttgttttcgttggtcttttcaacttgaattatgggcatagacaatctttgtatgacagtaataacacggcaaattttgatggattgcgcgttaagtccgaaggtttgctaatcgtccataagtttactgatcaaataaaacgataaaattttattaatgcccgcgcatttccgcaacaaattaatggtaagggcatactggtcaagaatgagttcgagaatgccgaaagggcaaatttgagaagatagggcgggaagattaaactttggattgaaaattgaatcgagaaaatttaaatgaaactcgaatattcagtcatcctattgtccctaattgggtaggacaactaaattagcagacaattaattctatttcttaatatcatttacgaataatgaaatgctaagagtattgagttttatttgctctctccttgacccatcatatgcaaatgggtgaagaatactcacatatattatttgttgggctgactgactaatgagtgagtgacggggaagggggggggggggg

SEQ ID NO: 43221 - DNA, 941 bp, Heterodera glycines
catttcgataactgggactcaacccaccaacaattcactcactggggatcaactcaccaacatttcaatcacacgggactcaacccaccaacattccaatcactgggactcaacccaccagcatttcaatcaacgggactcaatccaccagcatttcaatcactgggactcaacccaccaacattccaatcaacgggactcaatccaccagcatttcaatcactgggactcaatccaccaacatttcaatcactgggactcaacccaccaacatttcaatcactgggactcaacccaccagcatttcaatcaacgggactcaatccaccagcattcaatcactgggactcaattcttctgcatttcaattactgggactcaattctccgacatttcaatcactgggactcaacccaccaacattccaatcactgggactcaacccaccagcatttcaatcaatgggactcaacccaccagcattcaatcactgggactcaacccaccagcatttcaatcactgggactcaatccaccagcatttcaatcaacgggactcaatccaccaacattccaatcaatgggactcaatccaccaacatttcaatcactgggactcaacccaccaacatttcaatcactgggactcaacccaccagcatttcaatcaacgggactcaatccaccagcattcaatcactgggactcaattcttctgcatttcaattactgggactcaacccaccaacattccaatcaacgggactcaatccaccagcatttcaatcactgggactcaatccaccaacatttcaatcactgggactcaacccaccaacatttcaatcactgggactcaacccaccaacatttcaatcacttgggactcaacccaccaacattccattcacggggactcaatcccccaacatttcaatcac

SEQ ID NO: 43222 - DNA, 1000 bp, Heterodera glycines
ctatcagcgccgccggaccccataattcctattttttcttaaaaaattaggcccaaaatcgcaaaattggtaatacgccaagcatcattcaaaacctggaattaatatataagattttatgaaattttttttgacttataacttgttgaatattaaaccaaataaagcaattttgtgctcattttgaagggaaaattctgaagaatttataagtttagtttgatttgacatttttgcgtttaaaacccattaattggctaaaaaataaattaaatttcaacaaggtaaaaaatttttcccacaggtacaattttttttaaattttgcacaaccccatattttgaccccccccccccccctctatcgaatccctgtttattttttcgagtaatatttttaactcgagatcggctcttctctttttagaagggaaaatcccaaaaaagattttaagttagcaaagttttggcgttctatttgctgaattaaaaataaacttatttacacttggagcccaaaattgacttgccgtgatcaaaaaaccacaaaaatccttaaatttctcaaaagtccacaaaaatccgcaaatcctcattttccaaaaaatcctctttgaccctctaaaagaccacaaaatgaggaaaaatcctcagatatcacatctctgggttaaactttatgagagccaaccatcgcattttgcggtcgcgtccctggtaagaaattgttttgtgttaccagttttttttttgttgttaaaaatgaagagctaacaacagagctttctttacacaaatgtaagtaattgaccattgaccaaaattgccatttagccatttgtgacccattaatgtttagaatatcattgtgtgagtatttcacccacctcattcccttccttttttcaactctctctattgattcaaaattttagcgaaaaaatatttgtttacgtaattattaccaaatatctctcctgtcttcgtcatcagcgaatttg

SEQ ID NO: 43223 - DNA, 1265 bp, Heterodera glycines
ttgattatgccggaccatttttcgggaaagatttcctgattgtcgtcgactcattttcgaaataccccgagtttttcgaaatgacgaccaaatccgcggccgcgacaattgatcatttgcgttatctcttcactcgtcatggaattcctgagacgctggtatcggataatgggacgcaattcgccagcacagaatttgccaaattcatggccaacaatggaatcatacacctattctcggcaccgtacaatccaatgtcaaacggacaggtggaacgatttatggacactttcaagagggcttttaagaaaataaaagggagggaacggcaaataaggaagtgatcgaaacttttctgatcacttaccagacgactcctaatgattcgctctcggaatcaaaatcaccagctgaaatgcttctcggacgcaagccgcgtaccacgctggatctgctcaagcctcctccaccaaggccaacggagagagatgagaaaatggagcgaaatttcaaccgaagatttggcactcgtactcaaaattttggacctcatgaaaaagtttgggcccggcaccgtctatcgcaaaattggaaggcggaaccatttttaaaagcgccggagtgatctacaaagtgcgatttggcgatggaacagctgggcgcttccacgcaaatcaactccgcaggcgtcagacatcaactgatcagtgcccattaaatgtttttaatgatgcatttaatttgccaattccacgggaaaatttggaagacgggcaggaccctcaaaatatgcctgaccctattggggaaccggacaatgttgtggaacaacaaattgtagaagagcagcagaacattccgcaaaatcgccgcagtcgatcgccaccgccacaacaggtgcgacgtcgttctgatcgccaccgaaggccacctgtgcgattttcacccggatgagaagacttaaaaagggaggtgttcgggtggtaacacccaaggaccaaaaggaagacattttttgttcttttgttattttcttttgatgtctcactctctctctgttccatagtctctaatcgctgtctctgttcttctcgtactctgacctattgattaaatgtccatccttccccatgatgcattcattcatggtctcaatatatttttgttgttctctcttctccaaatattgtgcttctccgtccaatttaatttatttatttgttatttaattttcttcaaataaatttgtttgttaaattgttttt

SEQ ID NO: 43224 - DNA, 1169 bp, Heterodera glycines
tgaaatttaaaccgcaaaatatttcgggttcataaaaggcacgacgattttttcgaaactcgttcagttcaatttcatgtccgaatttaaaggtcgaaacaatattttcaaccgtgtgtccggtgtaagaagcccccggacaccccaagcccttaattatttctataaattttttaatagcattttcgcagtctatcagacttttcgtccccagacatatcatttttccggattcccataataatgccgtggctttgataggagttgtacatttgataaccgcggcattgaattttctagggttatacttaaattcgcattcggtgatcgtcagagagtttagtttaattccggtaccgagattagcgaaagcaattatatttacgattatcggtttttgcattttttgatacaatgtaccaatcaaatggtcctttcactccctttatataccccttctataaatagcaaccaaaaataaaattaaattgaaaaaatgaactgtccacataaaattaagtgttgtcattactgcccctgtcattacgagatttgtaagagatgtaaaagccacagtcttttgcatttcggtacatcattttttgataatttctggctatgccccaaatgcgcgaaacatgttccctatgaaaatataaataggtcaaataaataagatgcattaaaaatgtttcgcggtccgttcactctaattctctcgggggctactgggagtggtaagacccgttggctattacagtttttaaaacatcataagaatctaattgaaccatcgcctaagaaaattctttattgttatggtgagatgaatgatagtattttaggattaatcggggagggcgttgagacttttaacgggattccggacatgaataagattaaagaacaggaaaaaccccttttgttaatacttgacgatttaatgcttaatatgcagaatactttcctcgatctactctttaccaggggctcccataattggaacgtaagcgtaatttttgtaacccagagtctctatggtcgggacattaaaacggcaagagccaacgcacattatctggttttaatgcgcaacccttctggccaattacaagtgagaacattggggtcgcaactgttcccaaaaagactgaattatttcatggatg

SEQ ID NO: 43225 - DNA, 1238 bp, Heterodera glycines
ttactttccatttcacctcatttccgccaaaagtgtaagtggcacacgcccttcttttggttatttttatttttgaataaataaataaataaattgcttaaataaattattttttataattaattcgaacaaaacatttattaactttacgcaattttccaatcacgtcacacaaataataaagaatgcatatttacgtatcgcgttctttatttcgggttattaaatcaaaatcttctaggatttggattattttgtacaaaacaccgttattggaatatgctcctgaggtttggaatccatctcttctaaaaaatattaaaaaaattgaaaaatgtcaaaaatatttcaccaaaagagttctttttaaataaatgcagccttccacccattccataccaacaaagattagaataccttcaactcgccgacacttgaaagcaggcgaaagctgtctaatctgttcacggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaagcttattgaaataaactcattaaatcaatttaaaaataaaattaaaactatttcattcctgtaaatagaccggaaaaattaaagtcgattttttaatccattcaaactaaaagtgatttggtcgctatttatttatttgtattgatttcatattatattttattttggcggtgatctcgttttaattgttttgcactttcttgaggacatttttaattaatgttttgtcctcaatgtaagcggattttcccttttgtggactcttttttctttactgacaataaacaacaataaatcatcgtcttggtagcaaaaaaacaacaacgtaacaccaaatcggccaagcaaatggcgtgctgaaagcttaaattaaaaaaaaatgcatagggcaatgaatagcgctggaaaatagtaagcttattgttagcctaagcctaggcacaagtaagctaaataattgtacgttttgcaattttttaattttttgcctgacacattgaccgatcccttttctacctgaggaaatcgtgtgcccccaaatgaacgctcatccgtcttgaaaggtcatcaatttggacagatgaggccagcgcaagcca

SEQ ID NO: 43226 - DNA, 1072 bp, Heterodera glycines
acacggccgtcgtcgtcaccttcatcgaagcccaaaagcgaaggtgagggcatccacgtctgcattagtgggaccagcatacggtgggccgcccaccgactatgacgacgacgacgatgccgaagaatttgggggcaacgacgttgacaatgacgacacttctgctcgctgatgatgtcgacgacttcttcagcgtggtcggtgtctgggagcgggccgactcccggtcgcgtgccacgcagaccgagaccatccaagtgcgcttccacaactgggagcggaggcgcggcgccccgacctactgctcgcacgctgcatcgcccgtctgatggcgcgcgtgctggacgggcgtgcggagccgctccgcgtcgggctgtccgtacaaccgcccggctgggacagctgcttccacgtaccaatgcgcccgccacagcagaacagtgcgcacgcgctggcggccgcccttgaggcgttcgcaaagcagtacgacgagctcgacctgttctccgccgacgtctgcttcaaagtgtcggcggtgtgggccttgcccggtgagcatcccccacccctgtccctcaacaaagtatgacccctccccccaccgtttagccgcgcgcgtggagggcgcatgtgccgaggacgagcagcgcgcacgtggcactgtccgctgccaatcctttgtgccggttgtgaacggggcgggcggcgaccgctggtgcatggcacgggccatcgtgctggggttggcccagcggcgcatctgcgtactggagcggcgcaacgtggtccacttccgcgccttctgtctggcgcagcgtggcgaagcgggcgcgcccgaagcacgccgtctgctggaggacgcagcggtgccgctggaccgcccaacgtacggggctgccgaggcgcaacgagtacagcgctggctggacgccagcctaggcgcccaccaagtgcggctggtcatcttcgcccgcgagctggcctaccgcgtggcgtgtaagggcgcgcgcccggcacgctttaacctgtgcttggtggtacaggacggccactacgggaaaatacagtgccc

SEQ ID NO: 43227 - DNA, 982 bp, Heterodera glycines
  misc_feature (952)..(952): n is a, c, g, or t
tttgcatatgagggggatgggttgaattaaaaaaaacaacctgaaatttactaaatcacattaacttcaactatgaaaacaaatgttcattgaagaaacatatatataaaaaatatcttctaatattccaatgtaatataaaattaaaaaaaagtaaaaaataattaatattattgaaaaagtttatttattttactcaatttttgctaaattctgggccccaattaaatcttttctcagattttcaagttttgcaacaatacactgatcaagagagttatattttcaaataatatgacaaaaaaaatatataaattaaaaaattttaatcttttaaatttataacatgattaaggagaaaatgccaatttatcacagaacaagatttatagaagcaaaacaaaatttaataaacaaattttgtaatcatatgcaaaaaaaaaatcagctaaagctgttcaaaaaatctcataatatttataaagagattctgatgtaatggcacacttattacaatttttattctaaaatttaaaaggaattataaattaacaaaaataaatttgattattatgaaaaagcattttgcaaatcggataaataaaaattgataaaatcatatgaaataaaagttttcaaaaacatattagaattcaatttcaattttatagaaaaacatctatttatttttaactataaatggtaatatggtgtaataaagaaaaacttatttaaaaataactttcggattgaaatagcagaaagaaagaatcggaatatgctaagaaatgttaaagaatttggaacattgagaaaatattccgtggtgagacaagtgacaaaaatagcaaagattgaaatatttaaatttaattaatattttttattttatttgataaataataagtcataatttagcttaacttatttaattaactaaacttggcattanaggtagtaagttctacgtatctctaccata

SEQ ID NO: 43228 - DNA, 767 bp, Heterodera glycines
  misc_feature (624)..(624): n is a, c, g, or t
  misc_feature (635)..(635): n is a, c, g, or t
  misc_feature (725)..(725): n is a, c, g, or t
cttttacaggacattggaaaccgtgatccgcttgaatatcttcggcctgtgcttaccatttgcacttttaaattgaattaagcattttttaaaaaaacgaattcactgacgaaatcgtccactgtcgaatttgtttgaaattaaataggcgtttaaatatttagtttttttgtgatgaaaataattaaatcatatcattttatggtgcttaagcccattttttgaataaaacaatttctcagctattaaaataaaactacacaaagaaaattatatataaaaaaatgagactgaaatataaatagccactgacgaaaatattcactgccgaattggaacactgacgaaaaaaatggaaaactgtgaaataaataaaaatcgttcactgacgaaaatgtttactgacgaaaaagtatagcgccattaggaagaatgaaaacaaaaaattaaattttcaataattaattatatgaatttaaataaagtattttcaaattacattgattttccaaaaaataatatattttttaattcgaatttttttgttttaaattcttgcgaatttgaatccattgataaatgggttaagtgatggtacaaattgccagcatttgtccacgatgngactgagttgngctgtgcccagctatttcttcgacctgtgccgtccccgcgctgtccgaaaagtccgcctcttcgaaattgtctccgtaatattccgcganttgctctttgaacgcgtccataactttgaagccctctctcat

SEQ ID NO: 43229 - DNA, 220 bp, Heterodera glycines
agcagcaacggcggcatcgccgagccttcggcgtagtgcagccagtagcggtaggcaatgcgctcggcgccttcggccggcatcggtgacggcgagagctggcgctgggtgtcgtagcggtcggcaaggtagtcaaggatcgcgccggactcggccagcaccagctcaccgtcctgcagcaccggcgacttgccgagtggatgcacgttgcgcagctccg

SEQ ID NO: 43230 - DNA, 1710 bp, Heterodera glycines
atttcgcctttcgcattattcgcattttttgggcgtttcccatttcgcttttcccatttcgctttttgggcgcgaaatgcgatttttacacccctaagaattggattaaattcccataaaatttttcaaaattttacctataaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttcaaaaattttcccggcggcgcctgccggcggcgccgccccctcttcccaaaaagtttttttggaaaaagcgcgcctcaaaaaaacgttttattgatttttaaatttggaataaaattttaaaaaatgatttttgctttatgattttaactattaaaaagttgtagaaaaaatttcgcttttcgcatttcgcttttcgcattttcgcatattttggcttttcgcatttcgcttttttttcatttcgcatttttcagtttcgcaaatttcgcttttcgcatttcgctttttatttttcaatttggcctatctgaactggtgctcacccaggttggaatttgtcatttcctgcaataaatgtttttatataaaggtttaaaaaatttgatcgggtttagaaacgttcaacaaatgcatagataaattttttgaatattatacaatcgtgctttttgctctctatcaatttattataaaaaaattcaattcccttcgaaattgaagccagaatgcttatttgaagctacgcaaatataaattaatatttgctataagaactgactatttagtcaacagaaaataaataaatcataaaattagaacaaaaaatgattttattttagaatgcacactgaagatgcataataagctaatatattcgaatttattttgaaataactgttcaacaaatgattagttgtttctaagaaataatgataggaagcttatctgaaatgtgtgctcacccaggttagaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattcacaccccttcgaaattgaaggcagaatgctcatttgaagctacgcaaatataaattaatatttgctataagaatcgactatttagtcaacagaaaacaaataaatcataaaatttgaacaaaaaatgattttattttagaatgcacactgaagatacataataagctaatatattcgaatttattttgaaataactgttcaacagattattagttgtttctaagaaataatgataggaagcttatctgaaatgtgtgctcacccagattggaatttgtcatttcctgcaataaatgttttcatataaaggtttaaaaattcgatcgggtttagaaacgttcaacaaatgcatagataaaattttttgaatattatacattcgtgctttttgctctctatca

SEQ ID NO: 43231 - DNA, 1222 bp, Heterodera glycines
ttcaagttgtagttcgaattcgggtccggggttcggaattgggcaaatccgagtcagattcgtgatcagcaccctcgaaaacccctgtatacctatttttagctcaaaataaaaaagttaaattagggacccccattcttcaggattgccgttcgaagaaaattcattttaaatagattgaagaaataatgatcagtgtgtttgcggctcagacaattgcgcccaattttttcaagtcctgatagcctaaacagcattgtataatttccgatctctagacacaacaatatccaatatacagcgtactcaaagaacaatgatttaacggaaattatatttaatgaatgggatatcaacgtcttcgttttcctcattctgggtcaacgcctcaagaacgatcgctcggcgatggtccggcactttgccacgagacacttcctcgaaaaccgcaataagactgaagtttgacaattaaacagaaacaaaaagccaattaaaactcactccatgttcttgcgctcggcaactttttctgcgggctgaaagaacgcatacaaaagggagacgccggaagaaatcattgaaacggtgaggccactcttactctaaacgaacagaaaaaaatgcaaaaagttaaacggtggaagcaatgaccacctcaacccaatcaatcagttgccccaatgtcatcggtccgtcaacttcgaaacggtcccaaagagtgaagtcaatgtcgaggtactgaaaagcggagaaaataacgaatgacggaaatagcccaaacagaatcaaaactcaccttcttcttctgcgctttgcccggctcgctgaacgcaatgaaaggcgtagccaagttgataaatgcatttttgatgtgttcgatctgagccgtcgagcgccttccatccgcctcaatggttttgtagagttcgatgcagacgagccctgagacgagcgcagttgtggtggccaacgccgggatgattttgcccgcaatttgttttgtctgaatgcgaaatcattcgggataaatccgtcgagaaatcaatccactttcatccgatcagccttttcgatgtcgtaattctcggctcgcaaattggaggcactcgtcacgaagtcgacgtggtggttggagtcgtcgtccttctcaaagtcaatgggcgtcatgcggcgaatttatgcaacttcagcctggccaatttcacgttcagatcgttca

SEQ ID NO: 43232 - DNA, 950 bp, Heterodera glycines
  misc_feature (909)..(909): n is a, c, g, or t
  misc_feature (937)..(937): n is a, c, g, or t
tccggaacggattagcatccggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatncggggtacgagatagaaaattgtcctanaaagagatagcca

SEQ ID NO: 43233 - DNA, 1060 bp, Heterodera glycines
  misc_feature (9)..(11): n is a, c, g, or t
ttcgggttnnntagagcagttttcgcccttagttttgaccggacactatcaatcgggcttgtattttgtcacatgtttgatcaattctcggcataatttgtttggtatgccactaattgttagccaattaagtgccccccccatatttggcctgatcatttggtcacagactgtcccttacagatttgatcaacaacaaaaaatgggaaaagcaaacgcaccgacactcgggaagcagccttggagcaggtccccggccagcacaatgtacagaatgcaacttaatttgttggatacttaggttgtggcacatcggtggggcaaaaagataggtaaaagaattgataaattttaaaaaagtgccaaaaatgggggaagtttttttaaatgtcctattaatattcatttgcttttcgtctgcttacgtgctcgcaagttcggtcagctgcgcgatgagtacaaatttgccaagccccggtcgcaccgcctcggccacttcccgataactgaatttttagggacttcagtgtcgtttctgggcaactctgttctcttaggtaaaaatagactctcgaacatctccagcagggatggcattccgaggcacaaaatttttggaaatcggaattctgtgccatcccctgatctccagtgccttctgctactgcccaagcgttcacctccgtctcacttttcgtcgcctcttcattttctgctgcgatgagtgatcagtgccgtcagtcgggcagtcctcgtaaaggcactcgatcagaatcagaccctggcaaaatgataagcaaatgaacggtagaatatttggaactgggaccgatggagaaaagtgccaggttttggcattaggtaagaaaaaaaactaggccggtcggtgtccatgcaaaagtgatcaaaatcatgacgctaccggacgacagatgaacaaaaaagtactaacagtgcggtagcaaatccaggcaacgccggtcagcgcgagaatggcacaccatccgccaattttgacggcaaacggcagcccgacgatgaacatgcctggaagacagtt

SEQ ID NO: 43234 - DNA, 1197 bp, Heterodera glycines
ttaaaagaggtacaatagtgattaaaagaggaagaaccttcattagaagaggtacaaaagtgatgagaagaggcacaaccgtgattaaaagaggaagaacagtgattagaagaggtacaaaaatcattaaaagaggtacaatagtgattaaaagaggaagaacagtgattagaagaggttcaacagtgattataagaggtacaatagtgattaaaagaggaagaacagtgattagaagaggtacaaaagtgatgagaagaggcacaacatggtttaaaattaaataaataatgaaaagtttttataaaatcgattgcattttaatttaaaatttttttataataaaatactctttttattcattaaatataattttgaaaattaataattgaatatttattttgaaatgaaattcattttttataaattcaaaaaataaataatgaaattaaataaattaattaaataatttataaaaatcttgaaattaattaaaacattaaaaataaccaaaaaatacaaagaaaaataatgtacaccgcccgggtccgaacttcgcctatatgaaattctatcaattaaaaaaataattcatttaaacttataaaatttattcattaaaaaaaaattaatttaaatataatttttatttattaacccaaaaaatattttaaatgaataaaaattgaaaaacacgaaaaaaatggtagaaaaataatgtacaccgcccggcttcgaacttcgccccccccctcaaaatgatgcctcagaatccccaatcacacagggattctgagggcttaacgatgtaaaaagtaaaatctgatcacgtattcgtgatcagcggcccaaataacccctaaagacatatttttggaagatttttgtgagaaaaatttttccactcaaaaaccatgtgctcccccctttggtcccgaatcacaaaatcacttttatttttgtatcttttttttttaaaatgtgataaaaataccaaataaaatttatataatagagcaaaaaattgcggatttttgtagttttttacttttacagaatgacttttcagaagcgagttctgaaattttttctgaaaaatcttaaattttcagaatttctggaaatactttttttctttttttagaaagaaatcccaaataaaatccataaaaattctcctgaatttttctctatttt

SEQ ID NO: 43235 - DNA, 939 bp, Heterodera glycines
tttttaaattttaatgtgcggctttacggccttacttctaactttcaaagaaaaatgatttataaaaatcgatattaaattattgttattaatgaaaatgtatttatttttatgatattttacaaggtaattaaaattgtaaaatttttaattattcaaacattaaatttttcaatattttaacaattatatgaaaataatttaatattaaatgtaaaaatgctttaataacttattttcttatctgatatattttttaacgtataaataaatatataaatttaaaagtgaataggagcgaattaaatatggctgattataaaaatgggtttttttatttgatgaaaattttgcctttaattataatttaaatttattaagttgatatgtgtgttcgctaataataataatttacagtcttctttaactgtaaaaggaaatgatatacaaaaatcgatataaattttcttttttaaatatattttaaatgaatgatacaacaaaatattaataaaaaatttcatttttatataataatataatatatatatatatattaaattgttaatggttttttgcaattgaaggttcttcagtgcataggcaaataatataattcattttttctcgttttattaagtataattataaaatagcttcaattttattaatttgattctctcgtactgaaaatttttttgtcttaaggtaagtgttcgatgatctgacactgcttaaaacgcatttatatatataaagaattgttttgctttaagagatgaattttcttgtgaaaatgctgccgaaatatggatgaaaacataaggaaacactgataaaaaccaaaatataaaaaagtttaaaatccataataaatagaaaaccaagcttaacatacatgaaattacgacatttttgaccccgtaattaaggttacgg

SEQ ID NO: 43236 - DNA, 1104 bp, Heterodera glycines
  misc_feature (996)..(997): n is a, c, g, or t
aaacatagtttttcgagctctatcgactggtattttttcggaaaaatttcggtttttccggggaaatagaaaaattttttggcctcagcgggacatttgagtcccgggcccataacttgtcagggcttggatttagccaaaaatcgtcttagaacatttttgtagagaattttaagctctatcgaacggtgtgctatatgcccggaaaatttcaaaaattttcgagctaggccccctagaaattttcagaatttttttttgggttgaaaatgggggtgaaattttttttctgggttattttggggtgctgagtacgattatgatgtctattttaagtttcataatttttggaattttttaaaattcgaaaattttttaaatttttttggtccttggaaatttggattaaaatttgaaaattcataactcggtgatggtttcatcgatttaactataataaagccttaaaaatagcaaaaaatcgggagaattttatgggatttatttggttttataatgttcaaaagaaaaaaagttattccagaatttctggaaatttttgatttttcagaaaaaaattcataactcggttctgaaaagtcatactgtaaaagtaaaatactgcaaaaatccgcaatttcttgctctattatataaattttattttatatttttatcacatttttaaaaaaagatacaaaaataaaagtgattttgggattcgggaccaaaggggggagcacatgatttttgagtgggaaaatttttccatcaaaaaccatccaaaaacatgtctttaggggttatttgggccgctgatcacgaatatgtgatcagattttacttttgacatagtcaagacctcagaatccctgtgtgattggggattctgaggcatcattttttgggggggggcgaagttcggatccggacggtgtacattatttttctatttatttttgagttatttttcaatgcttttaattaatttgaagnnatggttgtaattttaaattttttttaataaataatttcattattattttttatctgtaaaaaatatatcatttcaaatttcttaatattcattgcattcgattttta

SEQ ID NO: 43237 - DNA, 1034 bp, Heterodera glycines
aggcaaaaaattttttctatttccggaaaaaaaccgaaatttttccaaaatcccaccaatcgatagagctcgaaaacggttgcttgaaagtggtctcgtttttcccgggaaaaatcggcaaaaaatcataaaatcaaaaacccaaaaccttttaggggggcctagctcgagaaattttgaaaattttcgaattttttaaatttgaaaaaatcgggcttacaaaactctacaataagtccgctggccaccccccgctcagttcaaacgctaatgagttattcgcccggtactgaagtggacaaagttggtactgaaaagttgccaatttctgcagcccttcctattataggtagaggcctggaattttttttgaaaattagacaacacttcaacttaggttcctaccagcggaaactttttgatttatgtttcggaagaaaagttatgggccccgaactgcacgaaaaaacaggaaatcggtcccctaaaaaatcctatgctcacccctttggtcccgaatcccaaaatcggttttatttttgtaacaattcgtaagaaagtgataaaaatgttaaataaaatttatattataaagaaaaaaattgcggatttttgtagtattttaattttcaaaaatttcttttcagaagggggttatgaatttttttctgaaaaatcgaaaattttcagaaattctggaataactttttttctttttaagatagaaatcccaaataaatcccataaaattctcctgatttttctctatttttataatataattgcatgaaaatttatccacccttcgatttgttatgaattttcgaaaattaacccaaaatcccgaaggccaaaaaaattataagagatgcaacagtgattagaagaggtgcaacagtgattagaagaggtgcaacagtgattagaagaggtacaacagtgattaggagaggtacaaaaattgttggaatggtacaacaagtggttaaaaagggtacaatcatggtattaaaattaaataattaaggaaatcg

SEQ ID NO: 43238 - DNA, 1758 bp, Heterodera glycines
gaattttgccccagagccggtaaaaggttaattttggtttcaaatgggcccaattagcggtgattagtttaaaagtaaataattttggaggagttttgtcgaggataggagcaaaatagaaaatgccactaagcccaattttgtgattaccccccccccctcggctcattgccctctcccctttactttccactgcctaaaatcagttaattaactcatttttggtggttacatctttaaatgtttcttttgatgacttttccgaagcaatttccgcaaataaaagatgaatcgtcagcaaaaagatgaagatgagtggaactgatcggcttttgaattggtcgaagctttgaggaaaacattttgaggtggcaaaacaaagcatttgggtaattagtgaatgtgtggcgaaagtgccattgattaattaagccaaagaaaatggcaaaacgaatgaaataatcagcaattaatcttcacctatcaaattggtggtcactttgacaaacgaatgattcattctcccgaaaaggagaagccgaagaagaaacattttcttctgactcaccccccaatcagtgcaagttgtcctttattctcgcccatttcccgtaatcaaaaagtgggtgatggaagtgattcatcctttaagcaaataaattccgggcaataaaatgtgagaaatgcggcggggggggggggggaaccgaaacgggccagttaaaatgtgcaaaaattctgactttttggcagtgttcatgtttcaacttttttataagttgttcaatcgcttagaaataacttatcaaaagcttctaaacatgtagagctttcgaatgataccaaatttataaaatttggcccgcctgaaaaaaagttatgatgtattaagcttggctcagacgcaactgacccctaccgaatagtgggggggggggggagtccgacggcatcaataggtaatttttaatacgatttgttaatagattttgtccgataaatgaccaatttaggtgagtttttaatcaaatttaaagaaaaataggaacaataattctgttattagcaaaaattgatttttttttttcttcaaaactttgctaacgaacaaattatcggataaaatcattttctatcgctgaagaaagctgtttaggcatctgggattgaaaaaattttaaacacgaatatgtttctggattttgaacagtttacaaagagagcgatgtttttatcaaattgaacctttaataatatgttggtcataaaattgcaatagagttaagggtatttcttcccctcaagaaaacaaaaacaaaaaaggtataccaaagtagatttttctccaattgagacatatagcctcgaacaagcctacttatcagcttattgtcattaatttcaattttgggagttttataatttattgaaaatagattctaattttttctttcttttgacatttcggtccgcaaatgtcgcactacgcatttttcagtctcccaacactgattgattacctggctttttaatggcattaaccacggccccctcgttctgtgcatagacaaggaacacatagcggtggaggcttcaaaaccagtcttcatttttaacaaaacaaataaatgaatgaaaatatggcactccttattttaattgtttgtgccaacccgtccctttgggtgccggtcccatttaatcaatgagttgctctccctgcgcgacatcaatgcccggcacattgacaaccaacca

SEQ ID NO: 43239 - DNA, 987 bp, Heterodera glycines
  misc_feature (979)..(979): n is a, c, g, or t
cccaaaattaaaaaaaaacccggggcctttaaaaaatggggccaatgtaaattatcccttttcccaataattttttaaacaatgtaaattgattgaataaaaaatattctgaagagaaaattactttttaatttttggtttagtttaaaacttagtaattaaaatatttagaaaatttctattatttttttaattcaaaatttcagatttccgacatttttgggaatagaaattccgatttcctaaaatttttgggggccgcctcgtaatgccatccccgttaagtatgtataaacatttattttttaaaaataacctttttgacattttgtttcttgaaaaattcgtgttccaagcaataacaaattgaaaataagaaatttaaacatttttaattttcttttttagtaataataaaataatataaagactgagctaaaaattctttaatttatatatcagaattaataaaaagccaacaatatccttgtttctatttacttccgccatttttgccaacaatttttcacgtgaagtaatgaaaatgataaaataaggcagggttctcatgtctaaattttgaaaataattaggagggattgcaatttaaataataaaaaccaataaatatgtagataaaaaattaatctaatcgccaataaatagagagagaccgacttttgaggcatgccttttttctgcgcactagttccgatatattaagcataaataacactttttccacttggtttgagacttctacgttgattcgtgccttaaatgccttttttggcattttgccgttttggtgccttttttggcgtttttttccgaaaattcaattaaaaatgcaataaaatcgggaaaatacacccctaagaatcaaaatttcaatcaatcaatcaatcatttatacgcaaaagcgtgacgccgaaaaataaagaaataatgaaataataatatcaaaacaatcattggntcactttt

SEQ ID NO: 43240 - DNA, 1123 bp, Heterodera glycines
acggacccatccgcggcaccgcacacccaccggatttgattttcacgtcctcctcaccaccacaatcccagcacattatttcccaccaaaaacagcaaatcacattaaaagcagttgaccacgccgcagggcatggaaatggaagagaaagggagggaaagggtgggcaggataatgggtgggtgacctgattttccgatcaccttgaaaatgggtgggcggatcccctgatcagtcgggaacagcagcaagcaattttcatcactttcactctctgccaattctcgacatgattgacgacgcgacacataattttgcgtttcagaaaaaagagtcaaatccatcgaaaggaaatcagagagaaagtgacaaaataaaagcaaatggcactttaattgacgagaagggagggggggggggggatttgcaaatttaaatgccaaagagaattttcaaaatttatgtccagcagcaaagaaacaaacaaacggacaatgaatgagagagagtgaaaatgaatcatttttttgtgttataagagaattctcttttgtgtgtggaaaagtaataatacaaaatccattggattaaatccgaagttgcacaagaaatgatcagtggagggagggcaccatttggacacattaaaacttacaataacccaatcggggaagaccttcctttttgagccaaaatcaaaatcctagagacaaggggtccataatctacaaaagtgaccctgaattacagataaataaaccgttcatacactaaaatggtgggaggggaagggggagtcggtcgcagattttgatggctttttttgcttttcaaacccgcttttttcaaaaaaattttggtagggcttaagtgatcagcagtgatcagaattacatttttggggtctgtccgcttgaacactatgtcttgtgcaattttttccattcagtgtttacaaatgaacgcattccttcccccccccccctccaaatcaggaaattcggtccgaaaagcgcaaagcaactccaaaaccggtagcaacggtcatcatcattctcacaatctgtcggaggtcggaggtcacccctcctggacaaagtacttcttgaactcctcccacttt

SEQ ID NO: 43241 - DNA, 1258 bp, Heterodera glycines
aggcaaactacagggaaaaaacctaaaaaaaattcgctcccaattttcagtgaatacaagcggcgagctgaacaagggcggtgtacgtcatgacgaactgcttcccttggccaaacatgtcaaggaacagtgccactctttgacactgattggtgggtagaggcccaaaattggaaaaaaattatttgaaccccgctacgacttgcccttttccgccttttctcgaaattttcttataaaaattttgtgagattacggaatcgggaatcccgcattgcggttgtccacagagttggagctgtccatgggaatgagtgccgactgactatcaattgggtgagtgtgccaattcatctggcttttccgatcacttctcagcactgatcaaacagttgttcaatcaacttttaagcgatcaaatatggcagtacaaatgtgcgcatcggttcgaccatttttggtgcacgaaattatgccaaaaaattggacaccgaagagagcaaataaattttcaacaaatttacgcaatttatgtcatgacaaccgtacaacgaatggcttaggctaggcctagctttctttttaaattttttattgtacgaaatatcattttgtacgagtattacctgttttttcattccaattttttgtgtttatgtatttgaagaatttcgactccgatttttatgatggttaaatgctttttagtttcaaaaaacaaagacgagtctgatttgttttaatttcctatttttattttgtctaattttcggccataatgggccaaaaattcataagttaagaccaaaagagggattttagtttcaaccggaatttctataaaaatgttcgtgtgtaacctatctttgtctattctgattaataagaaattgaaatattcatattactttgcctcccttacagctttataatgaaagcgtcgttgtctattttggatttgccgttgcaattctgtaatttcactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattcggcctttcctataagcacaatgtgtttgatgggctctacaaaatattgcttgtgcaaaagcaattattttcttggaggctgtaattttctgtagtcatttgatatgcatctgctatttttcta

SEQ ID NO: 43242 - DNA, 864 bp, Heterodera glycines
ctgaaatttctgaaaatttccgaattttatcaaatttcggaaatcggaattccatgccatccctggtgtggccccacatttttggcaaatcactgttttttgtttccaaattgtttagcattttcttcgtgccaatgccatttcttccgtcagttacgaaattcatttttctgttcgcgtgccgtcaatgcaaatggtgccgtttgaattggtgaacgaatggacaaatgaaaagctgacattggccaaagcaaatgaaaatgaattggacaaaagttggataatgaaacgatgcaaaattattggggagacagcggcggtcaattgggaagacggaaattgggacaacaattgtaacaatgtgttcttttggcttgaaggtgacactaattgcattgggtgagcaattaaaaaaggcatttgtgtaataattagggctatcatttacatggaaatccatatttttttcctggactgtgagaggtctgaaacgtacgaaaaacatgttttttaacttggtttgaaactgctaggatggatttctatatccatatttttccatatttcgcgatttatgtccatataattgaccccccaagaaattttgttttcaagtgatgaaaatatgtttccaaggattttctgcttagttgatcactaattcgtctcccattttgaccaactccgaactccgaaaaccggacccgaactcgaacaaaaagtcaaaaactcaaatttcgtaattttgtttaaatacatgaaaacgaaataaagtcatagtgcttcaataaaaagtcatttaaaccattttgagactaaaaatggaaaatcgaaaattttgaaatttttttcgagaaaaaatga

SEQ ID NO: 43243 - DNA, 1010 bp, Heterodera glycines
ttaaagtgaattcagttaaaaatggaattttcaatttaaattatggcaattaaaacgaagaaaatattccaaaaataaaaaaatgaggccattctgtgcgctttgttagaataagcacggagtattcattctcaaaatgcctttgagacaccttttgcccattttttctgatgaatgaatggccctttcgctgcgttttttccttttttcgttaccctctcacatttcttctcattgctttacaaaaaataattggctttggcaaatttatttcacggaaaaggaaacgaagcacacacacaaatatgttatttcgcactttttcggcaaaacgatttacttaaaatggcaaaaggggaaaaattgaacaatttgagaggctaccaccggaaatttcgacagtggacatttggacaaaaacggacaattggacagtggtcattaagacagtgaatgactcatttttcttattcaaatggctagaaatgaaaagaatttttttttaattattaattttcttatcaactgtccaattgttccgttctgtccaaatgtctggtcacgatttgactctgacaaatgatgaacgaactcccgaaattccattaatatgttgattttaaagtttgttttgggggattccatttgaagcggtggagaggaaaaaaaaggtgcgaacatcgacaaaataccgtagtaaaaatgaattgcaaaaaaatgaaatggtaggagagatttatattttaagtgaagggagtgagtgtaaactgatgaggatggattgtgagaaactgagaatgggaaatattttcaaagaaaaataattggtgagacaatggcaaaggcccaatgcctttccgctcaccaaacagtgcataaataatttattggaatggcacgagaaaagactcggccgaagccctttcttggcactcattttggtggcattggcacttaaaatttgaacaaaaattttctctttttttcgattttaacataaatgggtcact

SEQ ID NO: 43244 - DNA, 458 bp, Heterodera glycines
atttttttatttcataaatattttttcagaaagtgctctaaagcgcaccaaattttatttacaagtcaattttagcactctgatgctttagtatcaaaaaggaagatggagaaaaaatttttttaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtctgttagcgtttgattgttctagtcaatttttcaaattttttgtgaaatatttgtagtgctctgaagggcgggggggggggcggggccgaaggccc

SEQ ID NO: 43245 - DNA, 263 bp, Heterodera glycines
gtccggattggccagtcgccgcagcggcgccagcaggtcagtaggaagcaggccacgcgcgccatcggcggcagcggcatcgccggcgagtgcgtgcagcaaggcgccggccgcggccgcgtcgaacgcggccaggccctgcgcgcgcaggctggcaatgatgccggtgagcaggtcgcccattccgcccaccgccatgccggggttgcccgcagcgatcagccttggcgtctgcccgggtgccgccacgatgctgcccgcgc

SEQ ID NO: 43246 - DNA, 82 bp, Heterodera glycines
cgcaccgcgcgcaggaccagcaccaggctggtgatcagcacgccggcgaccagcagcagggtcagcgcgaacagcacgctca

SEQ ID NO: 43247 - DNA, 1075 bp, Heterodera glycines
aaattaccgccttttaagtagcgccgttttttcttaataaattttctacagacaagacatttttggatttcgcttaaactaaaaaaagatgtagccaaaaaacttgggctggcaccgaaacgtgggcgccgaaatgacccttccactatttttgttactgatcagcccattaacacccacttattttataccttctttttgttgttgttgttcgcctcctgctactaccccgctttttctgttgctgctctccgcgcttaattatctgctgctgatcagattctgctgctgctggcggcacagtttgccaatcgccccggcggcacgcttactggcgtcacaaaatgcgtgacggtgtcccaaacagtgccgggatggaaaagcgaatgtgtgcagtgggctttgtgccagaatttcctgtattttcttccatttcctgtagaattaattaattattgattaatactaattagtagggatggtaaaaatatggatataaaatcgcgaaatatggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagataaatttccaaattttttgactcggtaaggcgctttgataaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaaaaaaatttaaatttattcaatattctcgagaaattttggcgaaaaaatgattttttgaaaaatttttcgggttttgggctcaaaaaggagaatttagctgctgggggccgttctaatagaggtttttaaagaaatgccaaaatatggacataaaatatgaccaaaa

SEQ ID NO: 43248 - DNA, 1087 bp, Heterodera glycines
  misc_feature (26)..(26): n is a, c, g, or t
  misc_feature (62)..(62): n is a, c, g, or t
cccccccccccccccccttaaaaatntcaaagatttgcaaaaaaaaaaaccagaaaatttcntagtaagaaaatttcaagaaaaaaaattaataaataattttttttaatgatttatttgtcccgccgtggctcctatttttaggtaaacctaattttatccattttgaaaaaaaacataaatttttctagaatacataatatcggaccctttggtgggcgagaattgcgacaaaatacataaaaacaaaatttaaatttttctataatttttcaataagaaaatgcattggattttgaaaaccaacaccagcacaagcacacacctcatcaatggtcaacgaatgggagatgaagttgaactgttccacgtcggtggagcggcattttgtgcagaaatggcgccgcagaatgccatcggcggccaactgatcaacatcgtcgtcatcgaacagaaatgcgtcgacatggacctgaattgaaagtgggcgtggataaaatgaaaaaataaaatttcaaggaaacgtagaaaaaattcaaaaaaattttctctttttttaattcaaaatttatgcaactcatttggctctaaaaaattttaggcttattgttagatagaaaattcctaaagaaaatctaaaatttttctaaaaaattcgcaagttttgagcctaaaaatttttataagcaaaaaaattttcagcaaatctttttaaattaaatttatagaaagttgaagtcgctttttaagtacacaagaaaattccttgaaaaaaatttcgatctcgagaaaaatctcatcttttttggtctcgagtctcggaaataattcctagaaacgaaggagatgagatgacccactattgctgacgactgaccgtgttttgcgcggtgcagtcggcaaacgcaccggcaacgggccaaacagtttgcggttggtgccgtttcagtgctgctaatgggctggcttgaactggcattgtcgtcgttgttggtgccatcgaatttggcacttttgccgcttctgttgtggctaatggtgaggggcaatgttgctgctgctgctgttttagctgattttcgtcaac

SEQ ID NO: 43249 - DNA, 981 bp, Heterodera glycines
gtttaatccaattatttttaaattagcttgccggttgatcaatgaccgcggacgtgcacgcactgatcgggacccgcgcatttgcacctgtccgaactgcttgcagatctgagtgccaagctgaaggtgccattcttttcgctgatcgacccgttggcacaccatttcctaaacccgtccgatggcaatctgatcaaagcaaatgccgatgcggatggcaacagcgctgaagcagggcaacaaacaacagcaggtgtttattttttaaaagttttttgtcttaattttccaaaagtgatcacaaaaccgctccaaaattcacagggttatttctcaatatttcctgctgatcaatcgatagggagggattttctgctgatcactttttttcatgactatttcaattggcctttttccttaaatatccgtttgcctctaagtacagtaaaggcttttgatgaatacagtatcacaaactttaaaacccattattttcgtctctctgtttaaagagcaagagattgtgcacattgaaatgttcccgcacacgcaactgtttgaagcgatcattgatctgatcaaatattggcgatggagccgtgtgattgttgtctaccgacagcccgaaagtgagacaaaaaggggcacagatcaccaatcaattatttattattactattatagaccaatgtagaaaatttttgaaaaaataatggttttcaacaggagtgggggccagggctgggcgaagctcggctttgcactcgaagccgaagccgaaggcgaagcccaatttttattcgaagccgaagtccgaagctcgaagcccaaaaaacccgaagagttcgaagccgaagtttcgcccagccctggtgggggcagatttacattctcgtgctatgtgaaaattctccccctttttatggaaggtgatacagttatctgaaaggaaccttattatgaacgagtcagaatccaaat

SEQ ID NO: 43250 - DNA, 1010 bp, Heterodera glycines
ttaataattttcctccccggaaggtactccctggccttcttcgcgccctggtggtggcctttccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactcgccccgaaaacaaaaaaatcgattttttcaagtgtccgtttggggtactcaaacaattatgagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 43251 - DNA, 1270 bp, Heterodera glycines
attgagaaaatatgaatgtatttctgcgacgccttatatacttaattcggccataatgggccaaaaattcataagttaagcccaaaagagggattttagtttcagccgaaatgtctataaaaatgttcgtgtgtaacctatctttgtctattcggataagtaagaaattgaaatattcgtatttctttgcctcccttaaagctttataatgaaagcgtcgttgtatattactggattagccgttgcaattctgtaattccactttggaatccaaaggaatttgaatcgcttgtacaaaatagtcagtgccgaaattagtagatcgtataatcttttagagaaaaatatcataacaagcagtaacaaatgcgcaatggtgttcccccccccccctcttttctcattctccccaatttaccctcctcaaaaaagtcgacgttcttcagcaactgaagcgctttctccgccgtattggtggacccggtcagctccattagtccggcaattagcttttgtctgtccttttctccaatgccggcgcttctcagcatctgaatggctggctttgttggcgttttgttattttcaaattcaaattgcctctggcacattcacaatggaattgttgtccttttcctcgtacatggcgaacagtgtgggcgacagaatcgacttggggttgacggggccgcccttgtcgggtgcaagtggcatgaagcgggggctgaacatgcggtaattctgagaagcggaagcattccgcgcaacggtcgcttttgttggcatcgaatctaacaatttcatgccttcgtggatcagtcccaatttgcttctctgatgggtgatgtgaggaaagattagtggattgattattcaagggagaaacgcaaagagaggaactggggcgatgaatcatcgataataatcaaaaaatgcagaggcaattttggatggtgatcgaaatcagaatagaaaatagatcaacggcacaaacagacaagacaaaccttttcctttggactcagagaaggctcttcccggtccaacacgatgtcatacctaaaagaatgccaaattaacgattccccccccctcccccaaattttccgtgcatacattctcttctcaaaaacttttgtgccgggaaatttcttgcgtcgttccgtttcctccgccagtcgtgccaacaatccgtgcacttttgtccatttgttttccgccttttctcctctttcgcccatcattttaatcagcaaattggacacttttt

SEQ ID NO: 43252 - DNA, 1041 bp, Heterodera glycines
aggtcaaatcttttctcttttctccaacacccatgttttcgaaatactattaacaaatttaaaaaagccattatggaaaagtttcgaagaaaaaaaaaaataatttgttatatatctaaaataataaattagcgattggcgatttatttaaatttttatttattatttattaaacggaaaaatattaactattttcatttaaatcaaattaattatttaattttctttttatttctgatcactttctttgtcttaaggtgttctttggcaacgaaacagtgacaggcagtttgaagatcaaattgaagcaagagaccgttctgaatgctatccatttgcattttaaaggtaattattaaattcattagaaaaaataaatacagttttcggtatttaaaatataatttctttttaaatatttaaacattttcaggtgtagccaaatggattggcacgggacgaaaggaggacaaggagggccaaaccgagaaggtactttacaaattaaactaattattaatgaataattttctaaaatatttcggcacaatttattttaaaaaatataaaaataaatgaaaaataaaaaattgatatttttaaaaagtattttaatcaaattattaaaaatcacataaactcaagtaaaaaagctaaaaaaaagaactttaaacttatttttatttttctatttatttgtttataattctattcatttttaattatgtattaaaactttaaaaaatttccatttaaatttacaaaatatttttaaaaattattttcactaattttttcagatttattttgacaaaaattttgttttgctggaacgtccgcctggccatcccgggcctggccacttcaaatttgttgcccattttgcctattcattgccatttgagtgcccattgcccagcgggtgcgagacaagctacgagagtgggtcggcacacattcgttactttgcgcgtgccattctcgagaccgagcagcgggtcagtgccgtgacgtttttggcatttttgcgatttgtctttt

SEQ ID NO: 43253 - DNA, 454 bp, Heterodera glycines
cattgcttaagcgggtccgtcgttgaacaatgtcgaggacaaacaacaccaacaacaacatgaacaacaacggcacgggcaccagcagcagaaaatcagcatggtgcaaagcttggaggaggggatggacctgtgcgtgtgccaccaggactacaaccactgtgtgcagaacaacatcaacggggagattccggaagtgttgcccaccgccgacttggccatgctggactttatgcggcattttgttgaggaccaacaccggtggggcagcggaggacggttgagggcggatggcgtgccaacaactacccagacgccggaaattgtgcaagcaatgggctttgaggtgaatttgggaaaatgggacaaaatgccaaaaatggggagcggacaaaattccaaaaagtcggggggggggggggcaaaatggcgtaagtgggggagggaaaaatgt

SEQ ID NO: 43254 - DNA, 1234 bp, Heterodera glycines
cgattcgtcaactcgacgattcgttaacccagacaaaatgtgacgattcgtcaactcagccaaatgtcaacgattcgtcaactcgacgattcgtcaacccagccaaaatgtgacgattcgtcaactcagccaaatgtcaacgattcgtcaactcgatgattcgtcaacccagccaaaatgtgacgattcgtcaacccagccaaaatgtgacgattcgtcaactcagccaaatgtcaacgattcgtcaactcgacgattcgtcaacccagccaaaatgtgacgattcgtcaactcaatcaatattacttaaaaaatggaacttaaagcaattattgaatatttcatcggaaggatcgtgattttatgtgttcttgtttctaaattagcctaaaagaatgctataattgtgctaagcgccattaaaagctcttgaaactgctttttaaaactatttttggatgagttgacgaatcgttgacatttggctgagttgacgaatcgtaacattttggctgggttgacgaatcgtcgagttgacgaatcgttggcgcgccgtttaagcgctcaatcaactcgtcttgtccaactgccctctaccattttaaaaacttttgctgcgaaaaggcatttatggcgttttgtagatatgcattgttttgttggcttttcgtcatttaacttttctttgttgttgttttttttctgtaaaagtgagaggtaatttactaattgatcattctgatcagatatgcgttaatacctaaattaacatcaaaccgacattttggcgacttcaaaagacaattccgtaggtttgttggagatgttcctaaaagccagcattgagaggctgctaaatgacccaagcacgaggcgcaaagagcacgtcgcattgaaaaaagcatgtgaagaagcaatcggtaagaaatggcattcgaattggaaatggcgattaattgtaatgttttagagcaactcgattcacggttaaatggcattgacatagaggagggcgcatcagacgttttgccgaacaacaacaacaaatttctcgctgaccattattttcttccctttgaattggtgagtgagtcaatcaaattttaattcattttttgctagatattttataatcaattattggaggaacaatgtttttaggcctgtcagagtcggtcacaaaaattgtggtgaacgctttggaatcgtagaagtcttttactgttctttcatc

SEQ ID NO: 43255 - DNA, 855 bp, Heterodera glycines
gaaggtgctgcagctggagcagcgggcgttttgactgttgttgttggcttaacggggcttgtgacaggcggtggtggtgccgccgaaatttttgtttcttcaaaaggaggcggtgactcctcaagtcgttcgtcttcatttatattatacaaaggaggagagtcctggaggcgttttccactcgcgtcaaacattggcgttgatggcgtatctcttttctctctcttcagcggcggcggagaatcaagaagctttgttcggttcctgttcgcttccacctcacggggtgttggcaacagttttgctccgctgcgatttcgcaatgttaccgccaaaaagtctctgagctgttcaaccctgctatgcgatgccttaggtaccggtactcggatcacccgctgtctgtcctcatcggtcgctctgaggtcggtgaagtgaatgtcaatccactgcgcatccaatgtgccaatggttgaccatgagtaggggtaactgatactgtgcagtccgcacacccacgagccgttaaaatgcaaaggctttgggagtcggacacgaaatttgttgggctgattgtccggataatccgacacattgctgggcaaaaacacaaagaaactgttcgacatgattgtttatttttcaacaaaatgaaaaatgcatatgctttttatacaagctgagactcactaatccattcccgattgggatatcctataaatttgacaagcatctcggtggtcccgtccgaccgttttctcttcctgtaaaccttctcgatgcggtagcttgtctctgcatcctttcttacgcgcgccaactcctgctcatagaagctgcccttgaatttctccc

SEQ ID NO: 43256 - DNA, 881 bp, Heterodera glycines
  misc_feature (5)..(5): n is a, c, g, or t
  misc_feature (18)..(18): n is a, c, g, or t
ttaanagtacaggctatnagggaagctattcccgaaggattcttgtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcccgaaggattcggtctccccataaatctgggcgcatcggttcggggggactgccccgaaaacaaaaaaatcgattttttcaagtgtccgttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggaaggattcggtctccccataaatctgggcgcatcggttcggggggactgccccgaaaacaaaaaaatcgattttttcaagtgtccgttggggtactcaaacaattatggggagcaaaaatccaacgcagaattaaagtacagactatagggaagctattcccgaaggattcggtctccccataaatctgggcgcatcggatcggggggactgccccgaaaacaaaaaaatcgattttttcaagtgtccgtttggggtactcaaacaattatggggagcaaaaatccaacgcagaattaaagtacagactatagggaagctattcccgaaggatt

SEQ ID NO: 43257 - DNA, 1082 bp, Heterodera glycines
gaaccgaacattcacaaattaaggggcgggggatccttttaagcatccgcagtcaagaaataagcacatttaattcctaagatccgacccctccaaataaggacaaagtcttagaaataaggacaaatgaaagccctatgattttcaaaggacatcattaacaaaaggtgaacaaacattttgttaaaaaccagcagagtccaaataataaatccaacttatgtcaacaaaaatccttattatataaagcggaattgcgacatcaaaaaccgaaaagaaaatcattttaaattcatgcttaattaatctataagaaattagctaaaattatgcttaaaatgtttgttgtcgcccaaattgcaccgctgactttggcactgttgctcatcacccttttgatggcttctgatcgatgtgccgtggcactcaccgcggggcttggcaatggtgtgaatgtgcagcccagctactacaacagtggcaaagtgtcgcttggcctttcccagttgaaaacgttggcaacgaaagttaaaactgtgcggattgaggtggagccgttcattcccatttcgttggccaagcaatggatcagtgaggcggccaaaaacggcttttccatcattgtcacttatcataaggcgacagtgttgggctccaacgatgcaagtaagcagaaaaaatgccaaaagcatggaaaatgtccaagaaaatgccgaaaatgatatcgcgggtcgaaaattggatttttcagaaatctcggcctcgcttttgaattgttcggtcatttattagcaagacaaaaacaaaacaaaaagttaaattaaaatttttttaaatttagttagattattttttaaatttttaaattaaaataaaataaaatgaatttttaataaatcatatataaataaatatttaacctaaaaatcttaaaaataaattattatattatttatcattattttaagatgagttgcagcaagccgctaattggtggaagactaattataaatcattagcgcagtccggcaaatttgtgctcaatctgatgaacgagtggggtgaccacacgatcacatcaa

SEQ ID NO: 43258 - DNA, 1022 bp, Heterodera glycines
  misc_feature (43)..(43): n is a, c, g, or t
  misc_feature (103)..(103): n is a, c, g, or t
  misc_feature (975)..(975): n is a, c, g, or t
tatataaaaattttaaatgtccttggatttcatgaattttccncactatgtccttgaaaatcggcatacccgtcctggaaacggaggatggacgatgggagcnctggtctagaataactcaaaaaatccttgtttttttgaacatttttggccatccttttttgaaagtttaacttttttttgaaattttgcaggcaaatagaaaacacttgaagctatcgaatgataccaagaattaaaaatttagttgctttagagcaaagttaaaagcaaaattttttattttcatggttttttaaacaaagtacattatgatgttttttaaataacgacatagcaccgtggtgattagtgatatgatggaccgattgatttgcacaaatttcttattgtggatatttgctgcataaattttgttgcttttttgtcacgtaatgttttaattttttttaattattaaacgatgagtagagaagagaaccaagtttttatggacgaaaatactccatttactaaaacccgaaaaatttatcagttggaaaaaaatagaaaaaaacttttcatgtttttagggggttatgaaaaattacaattatgactacatagagcgcgcatttttagtcacgaaaattttttgcgtaaaatttttaatattagaaaaaaaaagattgtttttctcagcaggatcacattttcttaaggcaattgtacaaaagcattaattatttcattaaaaaaaattatattagcattttttgcttcatcgttggtgttaaggtggcatattttgccacataatcaatctgtatcaatctcaaagtgagtgagagaaatggagtgagaaagagagagagagagagaaaaggaaaagagagagtgaagagagagagactgagagaaagagagagagagaccgagagaattgtgaaaaattgccaatttaagcgcagcggagaggcaaaataatcacaattntctaatcataaaaattcaaaccccatcaattctcatcaccaccataa

SEQ ID NO: 43259 - DNA, 1158 bp, Heterodera glycines
  misc_feature (73)..(73): n is a, c, g, or t
ctgcgagttgcaatcaagctcaatgaagtgggtggcgttggcatcgtacacgctgtagtcgacatcgcccatntttctttatcacatggaggacaacctgtttgggaggaaataattttttaatttcaagaaaaagtaaagaagtgttttgagttccgaaactttatttacgagcattgaaaaagaaaaattgatttttttccgttaaaataaaatttgggtcctcccccaatcgggggccccaacccccgacatgtgctccccgatagttcccggcccaccgacattgaaaaaatgttttcataacttcaaaaacaaaaaatttgcttatttattcaaaaaatgagttcgaaaaaatttagaaaaattttttttaattagaaaatttagctcttaataaaatcatttaaaaacgacataaaaagcattgatgaattaaataaaatcaaaataaaatttcgttgatttaacctattttcagtcccaaaaaacgaggtggaataataaaatcaagttgaagttttgccatttgaaagcgatttctaaaaccaaaaagcggattttttatgatgaattttttgaaaatgtttatttttttgaaaaataaaaaatttaaattcaaaattgtcgtttcatggcctttctagcgccataattccgatgttcacagaggcttaaatcccagacatcccaaatcacccctgccacacgtaacgtaccacttctgtttctctgcatctcaacggcaacacttgacagttgttaggcgcggtgatcaccccgctggttgccgcgccgacttcttttgcttcgcacaggttgactccctgtaaatgcgattcgaatccgctccacaacacacaatgtttttatttatttattttcttacagttattcaaattggccattttgaaaatgaaaattttcaaagactcgtcacttttttctagtgcttcaatatgcttacaattaacatttacttaaaaaaaatttcttccaatcaagagcatttgaatgataccaacatactataatgatattgggaaaaacctttaaaactttttcaaaaacagccagttttcattttctgcaaatatgtaagtaaataaaatattggtgttttcaccaaaaaaattaccaaaatccatttgaaaattt

SEQ ID NO: 43260 - DNA, 936 bp, Heterodera glycines
taaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaaacatcagagtgcctaaactaacatgtaaataaaatttggtaagttcagaaccctttctgaaaaaatatttaagaattattaagcaagaataaataaaattttaaaaatttgatcgtccataaatattttgtaatggatcaggggctcaccaaattttgcagggatacgtatgggaacactacaaatgcttattaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggttcgcttctgatcactactcgaaaaatgagtgactgaattttcactaaaaagtcaagcctaaactttttggcctgtttaaaaaggaattaaaaatttttaaaaattttattcatctccctttttgatagaaaaagcataagagttcgaaattttcaattttttgtactctaagctactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtaatgtaagctactcaaaccggttcagaattcaataaaaataaaaggacacggtgcgaaaatggggtatgaaaagtttattgggg

SEQ ID NO: 43261 - DNA, 976 bp, Heterodera glycines
  misc_feature (61)..(61): n is a, c, g, or t
  misc_feature (100)..(100): n is a, c, g, or t
ctagaaaaaatggtctaagtaaaaatcgtaattacgctcaaaaagcttctcaaacaatttnagcgcttccaattccttctacaatcgcctttatacatcncattatgagcgctaaaattatcagagtgccgaaaatcgcatttgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaaatttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagcgccgaaaatcgcatgtgatctaagcctagaaaaaatggtctaagtaaaaatcgtaattacgctcaaaaagcttctcaaacaatttta

SEQ ID NO: 43262 - DNA, 622 bp, Heterodera glycines
ggaaataaccaaaaaaagaaaatactttttcgagggcattatggttaattaattttaatggtcttctgcttttttaactccttttattcgcattaaattttgatattaatcccttatatatttggatatattttattttttaaacttactcgtatatttttggttatttttattttttaaaatcaattatttgtttcacttaaattgtagttcatattgttaaatttatttttttaattcactaaattatccgcaaatatcggtccgcaaaagtcggtccgcaaaagtcggtccgcaaatgtcgcactacgaattaaatgcttgattatattccgtagtgcgacatttgcggaccgacttttgcggaccgacttttgcggaccgatatttgcggataatttagtgaattaaaaaaataaatttaacaatatgaactacaatttaagtgaaacaaataattgattttaaaaaataaaaataaccaaaaatatacgagtaagtttaaaaaataaaatatatccaaatatataagggattaatatcaaaatttaatgcgaataaaaggagttaaaaaagcagaagaccattaaaattaattaaccataatgccctcaaaaagtat

SEQ ID NO: 43263 - DNA, 1218 bp, Heterodera glycines
gagtaccttcggtgcagaaaaattattaatttttaaaatttttttattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtatggttctcagcagtttccctgcaaaatttggtgagcttctgatcagtctagaacgttgggtgat

SEQ ID NO: 43264 - DNA, 821 bp, Heterodera glycines
cattcaattataaatttaaataataattagtcattagaataaatcttcggtaccgaaatgacccgccccttcagatcaccactcattcggacttttcgcacttcgactcaccacgatcattattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaacccta

SEQ ID NO: 43265 - DNA, 872 bp, Heterodera glycines
aactcattttccatctcctttttagcttcgaagagttggcccggcccatctgagcggccttcccattgaccaagtgttgcaaatcgtccgccactatttgctatgggccagtgccatgctcatctacccaatttgcaccactaatatgtacgccaacgcaccgcaacagccgcacaatttcagaacgtacttcggcaccaattaattagccaactatagtattgtttataatcgaggataatttttgtcgaaaattggccgaataatctcggaaatttatgttctcgaccatttcgagaacttctctagacgcttttagtttttttgttaaatttattcaaacataaccaacatagtagtattctattgatgtcatttagtacagttttgacgccatttttattttagaggcacagtttggtgaccgtttcggctccgattgctgtcccatggccgatgtgttggaggcgttctcgccaccgtgctcgcttggctcctttcttcaggacatgaccatctacgcgggacgtccctctctgcacatgtgtaattaaaatgcgaaaattcgacatgtcgcaaaattgttgcttttaaaattctattgcactacaaaattgccaaatttcactatttaccattaattttcaaatttccagctttaatggtgtcttgctggtccaactgcacaccttctttctgctgccccttccatccatcgacgccaacgacagttacaaagccaaccagcagcaacacaaccacagtcaaagggaacgggggaggagggacagcggaacctcaaatgatgatgccgaagaagtcgaggaggggggagaggaggacgatacagaaacagcagcagaacaaccaca

SEQ ID NO: 43266 - DNA, 917 bp, Heterodera glycines
ctcattcagagagtatatactaaaagttccgaagtcccgccccgcgccgcttagaggaaattatacccaaagtaccatatcataccgtcgggcccatataaaaattcttgaaattttcacgaccttgaaaaaatatatattatttctcagctcattcagagagtatcgtactaaaagttccgaagttaagcttgtgctgcttagaggaaattatacccaaagtaccatatcatactcgtcgtgcacatataaaaattcttgaatttttcatgaccttgaaaaaatatatattatttctcagctcattcagagagtatgtactaaaagttccgaagttaagctagtgctgcttagaggaaattatacccaaagtaccatatcatactgtcgtgcacatatgaaaattcttgaatttttcatgaccttgaaaaaatatatattatttctcagctcattcagagagtatatactaaaagttccgaagttaagcttgtgctgcttagaggaaattatacccaaagtaccatatcatacactcgtgcccatataaaaattcttgaaattttcatgaccttgaaaaaatatatattatttctcagctcattcagagagtatgtactaaaagttccgaagttaagctagtgctgcttagaggaaattatacccaaagtaccatatcatacactcgtgcccatatgaaaattcttgaatttttcatgaccttgaaaaaatatatattatttctcagctcattcagagagtatatactaaaagttccgaagttaagcttgtgctgcttagaggaaattatacccaaagtaccatatcatacactcgtgcccatataacaattcttgaaattttcatgaccttgaaaaatatatattatttctcagctcattcagagagtatgtact

SEQ ID NO: 43267 - DNA, 1271 bp, Heterodera glycines
  misc_feature (17)..(17): n is a, c, g, or t
  misc_feature (1198)..(1199): n is a, c, g, or t
  misc_feature (1232)..(1232): n is a, c, g, or t
aggggggaccagaaaancagaggacggaggggaacccgacgccaattgagcgggggagtgggatcatcaaacggagatttcactttataggcagcccctctcgccatttgcaaataatacgggcgatggaagtcacaaaccagttcctgttgagatgaacgggacacgaccggaacacttcccttctgtccagccgaatggccaccaccaattgcacgtccttttcctgagaggccgctgacgaaggtggcacattgcgaagctgaattccgccgattcggatggaataaatggcatttgaagggattggcggggagattgtgctggtggatggagagggagagcatcccccgacggaagggtcgtggaaagggacgaccgaggaagaagcggggggcgtagggccacaaatgaacaggggcagtgggggcggcctgtcacggcgcaggtggggccggggcgctcttctggagcttcgcggctggtggaactgtttttccgtagcttggcattccctttgccttccctcgccctcctcccctttttctgtggccatcgttccgtcttcctcaaatccttcttcaatttgtgttgccccatcctttctttcactgttcttctgttgaagaattcgaacagtacaacattctgaattcgcattaacaaaaaaacaaaacgaatgtttcgtatttttgatgccatacctttcgaacgaaaaggccaatcgcatttcacgttcagagtttcattctcccgcgcaagcgataagagataaacagtctccacttccattccaggcctatatttttcttcccccgttatctcaggccgatccgttgtgtctcctgccatttcaggcatatcctttccttctcctgcaatttcgggcttaggcccattagctgctccgctttctcttttatctccgacgaatgtttcgtcgtccgcttcttcgaagagtccttcgaaagtgaaaatgttctcctctctcacatcttccatgtcatttcgattttccttcttgtcctctctttgtttttcttctcttttctgtgtccggtgattaattatttcattctttgccatttcatttttcgaaattgcagtggaaggggcagcattaattgggcgaagatgaactcttaatttgcaaagtatcaattggacacggcccgacagaacccattgaccttaagannagattggcactttgacatcaaaacggcactctntcgcattgttccagacgccatttggacgatgatggcatt

SEQ ID NO: 43268 - DNA, 54 bp, Heterodera glycines
cggcgcgctgaccaccttctcgctggccaacgacgtctccaagtacttcgcgat

SEQ ID NO: 43269 - DNA, 1274 bp, Heterodera glycines
ttttgtcactccgtcctcgaatggtcggctttttttcttcattatttcacattttcccattatccattttaatttcggcttttcaattaccccccccccccattaattaccccaaattttgtgccgtccgtccctcactttcccacaaactcagaaagtgctcaattggcaacatcaacagatacattcatctcatcggccaactacaaaacaacaaacaatcagctcatttgccatttattcattcgttcctttcatttgattattcgacccattcgtcgtcgtttttccttttttctcacattaattgattgtttctctcaatttgctttgcttaaaaggggagtaattttgagaaattacaccctcaattggaaaattttttgtgcatatttcacgatttttagtgcatattttacgattttatgtgcatattttatgcgcatattttacgattttatgttatgcgcatattttacgattttatgtgcatatttttggcatccctatttatcacataaaattttatcaaaagtggtttaaaaagttaaaaaaatacaagtataattgtttgccttttatcccaagaaatgccattcttaagggtatattttcttgaaaattcactaattgcttgagactttcctcagtataaaaaaataaataaaatcagtagggttcagtttacggtagaaacttgaaagagtactcacccccgcgggggcgaaggtcgcgggagtctgagtcacgggagcaggggggaggcaggccaaaaaacctgtcccgtccccgggggatgggtcggggtctgaacactaatttagagcatggaaaagcctggaaaaaaaggcactataataggcaccaaaaaattaaataagtcatgaaaaggcacgaaaaagggagcaaaaacacaaacaaatctttggattcttcacattatttacacacattaggccaacaattaatcacaaatcatttgaaatgataacacagagatacaacacattgataatggtgatcaaccaacaacagacaattatggtcgcttaaacgataaccgggcgacaaatactgtacatacagtgagatacaataatacaatctgtacagttgggatcatatatgggaatagggtcagttgaatgtatcctcctcctccttcctcttcggcggttgtcttctgcatcctctcccatccatcggtcgtttgtcgtctcatttcatcgcgtgcttctgcgtccattcacgggcatttcggttgtactgctcgc

SEQ ID NO: 43270 - DNA, 1295 bp, Heterodera glycines
  misc_feature (1223)..(1223): n is a, c, g, or t
tggcaataacctcatttaaaagccttcctcgaaacaagataaaaaactgattggtaaaaataccaccccatacttctgtaaaaagtcaactggacgaacggctgggccctgcttccgtctggctacagtctcgagagctaatctggcaaaagcctcattttaaagccacctcgaaactaaaaaattatttgggctcctatgacaatggcgggatcaaattcgggttcagcgcagccaataccccattcagcagattctcagttggatacgatcaataataaaaaactgattggtaaaaataccaccccaaacttctgtaaaaagtcaactggacgaacggctgggccctgcttccgtctggctacagtctcgatagctaatttggcaaaagcctcattttaaagccacctcgaaactaaaaaattatttgggctcctatgacaacggcggcatcaaattcgggttcagcgcagccaataccccattcagcagattctcagttggatacgatcaataataaaaaaattagtaaaaataccacgccaaacttctgtaaaaagtcaactggacgaacggctgggccctgcttccgtctggctacagtctcgagagataatttggcaaaagcttcattttaaagcctacctcgaagcaggataaaaaactgattggtaaaaataccaccccaaacttttgtaaaaagtcaactggacgaacggctgggccctgcttccgtctggctacagtctcgagagctaatttggcaaaagcctcattttaaagcaacctcgaaactaaaaaattatttgggctcctatgacaatggcgggatcaaattcgggttcagcgcagccaataccccattcagcagattctcagttggatacgatcaataataaaaaactgattggtaaaaataccaccacaaacttctgtaaaaagtcaactggatgaacggctgggccctgcttccgtctggctacagtctcgagagctaatttggcaaaagcctcattttaaagactacctcgaaacaggtacaataaaattcctaaaaattattttgctcctatgacaacggcggcatcaaattcgggttcagcgcagccaaaaaccccattcagcagattctcagttggatacgatcaataacagtataaaaactgattgggtaaaataccacccccaacttctgtaaatagtcaactggacgaacggctggngcctgcttccgtctggctacagtctcgagagctaatttggcaaaagcctcatcttaaagcctacctcgaaac

SEQ ID NO: 43271 - DNA, 496 bp, Heterodera glycines
atttagcaaaattctttcgaaaatttgagtgagatcttctttttgatgttcttttaaaactcaaattattaattgattgtcaaacattatgcccatatatcaaaatgccaaaaatttaacagattctggcgattttcccaaaaagcctcaaaaatccacaaaattctcaaaaaaaaaccacaaaaagcctcaaagcctcattttgaaaatttagctttgacctatcaaaaaccacaaaatgcggctaaagcctcagatctgcgagccttttaatgtatggactttgttcaatcatggtctcttcgactcccggacaatcggacagaggacaatcggacagtaaaatgcactaaaagataagaaaatgccgtcgccgaaggggaccgattgtgccggtatcaagaaaaaaggaaaataggcaaataaaaaagtgcgaatgcagtctaaaattgtttcgttctaaattaacttggattggtattttgtaagcgacgtt

SEQ ID NO: 43272 - DNA, 827 bp, Heterodera glycines
  misc_feature (7)..(7): n is a, c, g, or t
  misc_feature (16)..(16): n is a, c, g, or t
atcacantcggatgcngggagaaaagccttcaatgcattggcattggccttaaagataaaacaattaaataaaattaaatttttagtaataattcaacataaaattcattttgatcaattccattagtgttccatggatattaattaattaatttcttttccaatatgtaatttttgcaaaagaaaattccaaaaaaaaaaaaaactgacccttcacacaattcattccttctgctgcaccacattgctcatgatactgaaaaaagattggaaatttcgagcttcatctgtagggcgaggatttagatttactccccaaatatttaaataaatatttgagaaaaaatgtccaaatatttatattacatgttactaaagacctttttttttgctatttggactaaaaaaaacttttccagattattttaaaatttcagcgccggatatcaaaaatttgcccaaaaatgattaaattatgccattttgagggtctaaaattcaattataaggttgagaaatggaagaattcggccctcctccctggctacgggcggggtccggacaatttgtcagtggacaatccgtcagtggtcaatccgtcagtggacaatccgtcagtgaaggacaacccgtcagtaatggacaatccgtcagtggataatccgtcagtggacaattcgtcagcaaatttttttagagctatgatcaaaaatttttcaaaaatgattgttaaatttaataaatacaatttcttatagattcttaagatatctaagtacttttaattcaattaattgaccatctcgagaaataatcatttacttctt

SEQ ID NO: 43273 - DNA, 876 bp, Heterodera glycines
tcccctattttcaaattttctgttcaattttattcatttttttctcgaaatactttcttccgttttacttgttttctcttttattttttggaattttctaattgtttcacttttttctgatcattttcattttaaaaaactcccttatgtatgtactaatttgtttaaaatttttaaaattatatttggtaaaattacctgtgaaatccccttatttgaaaaactttttgagattttttgtaaaaacaagtttatagggatattttcttaagttgctgaccacgattttgacatttgttcacaatacgtaatttaatgccaattcttaatgttttcgaccgcagaaattttttaacaacctttaacaatttatgatgaacacaattgctccttgtgatcttcagcatacttacaaatgtatgtttgtgtcattaaaaacggtgggggccgattgggccctgctgattgtgcccggtccgattgggcccgatccgtttggccccggtcccattgggccccgatccgtttggcccccggtcccattgggccccagttcgttgggccccggtcggattgggccccggtacgattgggccctgttgattgggccccggtcggattgggctccgttacgattgggcccggtccgattgggccccgatccgtttggccccggtcccattgggccccgatccgtttggcccccggtcccattgggccccagttcgttgggccctggtccgattgggccctgttgattgggccccggtcggattgggctccgttacgattgggcccggtccgattgggccccgatccgtttggccccggtcccattgggccccgatccgtttggcccccggtcccattgggccc

SEQ ID NO: 43274 - DNA, 821 bp, Heterodera glycines
cttggatcgacaacagcaaatccatggacgaaaaactggtggccagaaagggggacgtacagggtggaagagaatgtgggcgatgactaaaagaatttcgatcgcgataaatttctcgagtattcgacatttttttttaaacatcaacccattcttttctattatacggtagtagaaaaaatcgaccaattctcagaagtccacgggaaaaaaccagttttttaatatgtgcatacatcgaaaaaggggggtgggtcaaccgaaatttttgcgaaggggtctggggggggggggggggcaggggccaattttgcgaaggggtccagcaatgtaaattgacgacctttttttggtatgtttcgtttcgtttccgttttcgaaaattatttttttggttttcgcacacccctggtccccatcaacaggaccacacattcacacacaatacacacctccttcgtgtcgtccatcaacagggcgtattggcgtgagatcagcgcgttctgttgctgctggtcagcggaggtgatcatcgccgccatggacgacggcacgccgctgccgttgttgcagctgacgctgctgctgttctgcgagccggacgagcagcgcgattcggtggccggcgacacatggaaatccgggtttttgccatgctttccgtccgtttggcagtcgtacaggtacagctgaagtcgcagacaatcacgtactgtaaaaaaaattgaatttgttagttcaaattgtggaatggcatttatgcctccgaaagaccatttaagaatttgttatcttttgaaaaaaaaatcgctcgaaaaatt

SEQ ID NO: 43275 - DNA, 978 bp, Heterodera glycines
  misc_feature (777)..(777): n is a, c, g, or t
  misc_feature (783)..(783): n is a, c, g, or t
  misc_feature (789)..(789): n is a, c, g, or t
  misc_feature (920)..(920): n is a, c, g, or t
ataaagcaacaaaatgaagccaaatcagtattgggacacatattttttaaactttaaactccttgtcaagaaataataaatagattaggtaattttttgagaaaatttttaatttattaggtgtgtgttttttgaaatttttgggtcgattttttagaggcgtatttttcttttttattgtatttttgctaataaattttccaaaaaatgttaaaataagttttttcaaaattgctttttgacaaaattaattttttaacctattttgacgcaaaatcttttacaaattgcacttaaatcttcaaaattttcctctacggcgtctatccgcactttcggtcacgccaaatctttttaatatgcttttaaattgcttataaaattattgaattttttaaataaaaatttgaaaattattttaaaaaaattaaaattttgaaaattacggattacggaaaattacggggttttttgacccccgtcatgacggattacggaattccgtaattgagaaaatcgccgtaattacggatttccataattgaaaatccagttacgcccagccctggttgggttgcgtctgtcctttttcggcactttaaaacaattgcaaaatttgaaaataaatgacaataaaatggtaatgagatgatttattattcccttttccaagtttaaacagtttaaatataatatgtatttgctatggaaatgaccttcactaatcgatcagctaacagcgaattaatggacaataaatgaaattaaataatgaanatttgnggttgnggggagaaaaaggaaagggaaaaacaaaagccataaatgggaaagaaagaaacacccggcgatccggaagaacaaataatggtaattaggacaggtaaatacgatcattgctaatgagaaaagtgaatagngcatcgctttgcttttgtatttgtcctcctttgatttattttcgtacaaaaatttctg

SEQ ID NO: 43276 - DNA, 867 bp, Heterodera glycines
attcttaggggtgtaaaagtcgcttttcgcgccaaaaagcgaaatgcgaaaagcgaaatgcgaaacgcaaaaaaatgcgaataatgcgaaatgcgaaaagcgaaacctcggcccatccctgttgcaaacgtgttttttccggtaataaaaatacaattgtaaatatcatctaaaacgcgtgttttccgattattaaattccaattgtaaaatacaactgaaaacacgtgttttcaggtaattaaattacaattggaaaataccacatgaaaatacggtgctgagttgttataaaaaccatcaaatggaaattttcaacaaaaaactacccataacttatgtcaatgccaaccaaattaaatcttggtatcaatcgatagccctacatttctctattagctgacctaaattttaaaaaatttggtcaagtttgagcaaagttatgaccaaaagtacatcatgaaccaggtcttcaaacttttttttttggcctgccttttttgaaaccagcgaaattttttgaaatttgcaggctaatagaggacacatagggctatcgaataatagcaagaaaataaaaatttctaactaaaactttttaatttaaaataaaattattttgatcatcaaaaattctactcaaaacattcttagaacgaacaaaattaagtgatcttgctatcattcgctaggactatgtttcctctattaacctgcaaaatttcaaaaaatttagttaagtttcaaaaagtcatgaccaaaaaggtttgaaaacctgttcctggtgtactattgatcataattttgctcaaacttgacaaaattttttaaaatttaggtcagctaatagagaactcttagggctatc

SEQ ID NO: 43277 - DNA, 1350 bp, Heterodera glycines
  misc_feature (24)..(24): n is a, c, g, or t
  misc_feature (29)..(29): n is a, c, g, or t
acagtagttaatgccacaaaaatntaaanaattatatcactgacgcattttttggaggcctttaaacttcaaaaatttttttataccaccaactcaatcgttcgccgttttttgtgtaaattaattgtcgcgttgctaattggacaccgcaaccaattatgtcgccagctccaaatttgggctgcttcaccgcttttgtgtttgccgcgccaaccgtgcggaaaatgccagcgctgtcatatgcatatgtgccaacacatcggccaacacattcgtccaatggcatcaatttagtggcaagcccgacacacaaattccttttacggattaataagaaaaattaaattgaacgaatacaaaatggataaaaatgccgatacctgcccagataaaaaaaaatcccaagtatataaaatacacaaattcaaaatggataaaaaaataccgatactcgagagataaaaaatcccaaccattaaaatacatattaaacaattcatttagaaattttcccttttagcagaattttaggattttgttgaatagataatttaggtgaattttttttaaatttacgacattttaccataaattagcagcatagatttttggaataaaattacataaaaaggccatgaaatgatgccgcgatatggcatattaaaagtatatctcataccatcaaaacatatgtatctataaatttattataaatttttgcacttaccggccttgctgtatttttacttcaaaataaaggaagccactataatttgacaccatggatttggcacgcaccgaaaagccgccaaaatcgtctattgtattaattaaaaatatttttttattaattattcacttatgtactttgattttttgcaagacaaagaacttttaagcaaatggggtttatcaagtgaagctttgggatgacaatcgctgtaatttccaattatttttggcccaaaactgaaaccattaaaaaatgaaggttaatttgttctttgatccatcgatgatattacaaatttgtcactgattgagctgtgatggtcattggtctgagtgtctattttgttgggcgctaagaatttaattattattattattaattaattaattaattaaatggatcaattcaagtaggggattaagcccagaccctcgggataaaagtcggggatcggggaggaaatcccaaataaattttatcggggatggctggagaaattttaaaaatgtcgggaaaaaacaccctcgtcgggagtaaatttttttaaatcaaagccttacaaattcatttaaatacataatgattcagtttggagtgcaaaagaaggaattcaattc

SEQ ID NO: 43278 - DNA, 988 bp, Heterodera glycines
  misc_feature (15)..(15): n is a, c, g, or t
ggaggatgagtaggnaagtggctaggggagaaaggaatgtacaaatgagagagggtaggggtaggagagagagagagagagagagaggggggggagagaaaaagcggatggaaaataaatagaatacgttggtaatgatcagtgatcacctgtttcagttgggcttggatggaacgcgcgtgtttgcgcgcatacaaatacagcttggaatagaggaaaagcatcagagtggccggaaggaagaaagagagcagcgaggagaacacagcgtaagacggggacagagaaagttggcattgcgaccgcctggcaaagaaagaaacaaatggaaaccgaacggatattctttttctaatcttttctttcactctttctctaattctaatactatttctctctgtccctttttttctttaaattttattgccttccaatttctccctctttctgttgctgtttttcgccgtcttcgccattgttcacggcgccaaaggcaatttgagcagtgccaacgaaagcggaaaggagccaaatggcacaaatggcccagcaaatagcacggcgattaatgaaccttcaggggatggatgaccttccgaattaataccaaaaattcccttagtttttgttcagcatttcctttaaattataaattcggaaacattttcgtcccaattgccaatttgcaaaaaattttcccgatggcatttcctttcgtgtttaaaacaaacaaatagcaaaaaaaggaaagcattgaattgggcgggggagagaatatttgatgaccatttgagaagcggaaaaggggaaagaaaggcgaaggaaatggcaaacgaaaaatgaaaaaaagtgccaaccgatggaattcgcaaaaaaaagtcgtaaagtgtttcgaatgccaattccccccccccccctttctcacctggcatatcgcattggtctgctgatatgcacaaatctgtccaatgcaattgcaccctgaaaa

SEQ ID NO: 43279 - DNA, 975 bp, Heterodera glycines
  misc_feature (958)..(958): n is a, c, g, or t
  misc_feature (963)..(964): n is a, c, g, or t
tttattttgatggttttttgactaacgtcatagcacccacacgtttctattttaaaataaaaataagccggtacttagaataaatattaaagataaaaccaacagaattattatcgctatagacagcgcaaagcttcgattttgaggtaagagcttttaatcgctaaattttatcaaaaaaattagtaatcgaaagtcaattttttcgtttttgttttgaagcgcctttaaaaatttcgatgaaattaattagcgaatgcaacaattaaatgttttgattcgtttttgccaaagatccgtttgaattgtgaacggaatgccttttgatggtcagtgctgcaaataaaataaaataaaataaataaattaaattaaattaaaattttattttatttttttttaaatctaacatataaagaaatggcgcattactgctaaaagcaatcgtgacaagaaggttggtcggaaacttcacatagaactcaatgccaagcagatcaaaatttaagtgtggcaaaataatccgtgacagatttcccttaaaagaaaatggaaataaataaatcattttgaaaaagaaaatgtgttgaattattaatggcccattttaaaatagttttaatttggcgaaaaattattttaaattcaaagttcaccaatataatttagaaaatttaaagttttattaaaataatgcttgtcttttcatgctaaaatgcccaaatttttcaaaagtcaaagattttcttaaaaaaagtaccgtacctaattaatagccatttgaaattctagtggtttttttacacaaaaacaattaattcattttcgttaaaaggaatttgtgtgtccaaaaatatacatataataaatcgcaaaatatgtgcacaaaatatgcactatgcgaagtatgcacaaatatgcaaatacgcatatgggaaatacgtccctagaagcaccnaaacnnaatttaaaaaa

SEQ ID NO: 43280 - DNA, 994 bp, Heterodera glycines
  misc_feature (914)..(914): n is a, c, g, or t
  misc_feature (922)..(922): n is a, c, g, or t
  misc_feature (926)..(926): n is a, c, g, or t
actttttgttgaaagtgcgtttgattgcactcaagagttccaaaaaaatgatgccgtagaaagggagtgaccacaattctcgggaaaacaaaaattgtgccgttttggcgacattaatttactagccgatgtttattcattttttgctcgcttttagatcagcttatatgggtgaagggaaatgccacaaattgctggtgttaaatgcatgccgaatttgcctgattattagaatggtgagtgaccatcgcttataatgacaaaagtggaggaagagatttttttaatcaaaaatagcattttttcaaattttgcatttattaataaaaaaacgtattttttttaaatgcataaacttttgaaaaagcatttttctgaaaacgttcattttttcggggtttattttgtgaataatttgtcacttttaattcaatgatcatatggttttcatttttattgaatttttattaaaaaatttgtgaaaagcgccaaaattgaataaattttggatttcaaaattttttttggttttttgactaataaaattatcttaaaacagtctaggaaaatagagaaaaattatgaatggtatatacaaaattggtctgaccttttttgcttggcaccttcaccggattttagcccaattaaaaacagccagcgctcaattacagtttctgccaacctctacctttaaaaattcttacaaaaatgccaaaaaaaaacttacaacaaactttttggaagtgccaaaatttgaagctgcaaaatttttttcaatttttacaagctttgggtgagggggagctgctcatttatttatttatttattctcatcattcattttcatttctcaacaggtggccgccgccgccgccccccaaaagcggcaaaataatttacttggccacgcncgctttgnccgncgcgaatctttcgcgcgcacctttcaaataatgcattttgaatggatgtatttttatggggggggcat

SEQ ID NO: 43281 - DNA, 958 bp, Heterodera glycines
actaattttccgagctgtttaggtgccctgtcgtcttgtgcttcatgggtggcagtgtgctgctcttcaggccaagattggtttaaaatgcttaccactttttaaaaatggtgacaaattaaattatatttttgtatagcagaggaattcgtctgctaaaataaatattatcgtatccatccctttctgtccctcacgcattgccatatttccgatccttccaacacttctcctctttatttcttattgattttttatcgttaccatatttttaatgtgctttcacccccctattaaaatgtacgagatgaaggtccaggcgcagaagaaaaagaacccgaaggttgtgttccgcgactcattcaaccttatgccttgtgcgctcggacagctggtgcctgcctatggattggatgtggaagaaaagccgttcttcccgcatatggtcaatcgcccggacaactacggacgacaaatctacccgacaccggacgactatctggcacaaggaatgatgccagaaaagcggcgacaattcgaccaatggtacgaacaacaccgccaagcaccatttttgcttgacgaggcattggccagctactgtaaaaacgacgtcgacattctcacggcagcgctcgtcgctttccgccgtgaattttttgagataacaaagaggcaggctgtaaatgagacagacgaccaagaaagcaacgccggcattgacgttttgcgggagtgcatgactatcgcaagcgcctgcatgaaacactttcgcagcaaccacctccctgctgctgcaatacgagagcagcgatgatcaactcttcaaatcgtacatccgcgaattcatggcgcaaaaaatacaagcaaccggctttgacgcaaacatcaaaggcaacgccgacctcgaggagcaattcgtccgggaatgctacgaaaaatatggcatcacgatcga

SEQ ID NO: 43282 - DNA, 1215 bp, Heterodera glycines
  misc_feature (46)..(46): n is a, c, g, or t
  misc_feature (60)..(60): n is a, c, g, or t
  misc_feature (65)..(65): n is a, c, g, or t
gtttgtgactagaaaaatagcagatgcatatcaaatgactacaganaattacagcctccnaaganaataattgcttgcacaaagcaatattttgtagagcccatcaaacacattgtgcttataggaaaggcagaattgaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatatacaacgacgctttcattataaagctttaagggaggaaaagtaatacgaatatttcaatttcatacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcactgctatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaataaagtatagaaggcgtcgcagaaatacattcatactttct

SEQ ID NO: 43283 - DNA, 422 bp, Heterodera glycines
cactttttcaccaaaattcccgttcaatcttttgaaatataaatttagaaggtgttattccaaaaaagccaaaaaaaatctgtagattttttaaaattgctatttttagtggggaggggagactttttgagtgcacaatgaacccgtacagataatatgcgaattagtggaccaatgaatggtgtaaatcgatgagaaaatgaacggacgttgggggcggggggattatcatctctcatcatcgattattatttttgagtgagactttttacttccaaaatttgcgaatctgtatacctaattcctacagatcataatcgtatttaacagatcgttaataatttacatttaatgaattttaataattttttttctttaattattactagagatcggaccggtcggtttttttcggttttttc

SEQ ID NO: 43284 - DNA, 1259 bp, Heterodera glycines
  misc_feature (3)..(3): n is a, c, g, or t
  misc_feature (44)..(44): n is a, c, g, or t
  misc_feature (1149)..(1149): n is a, c, g, or t
ttntatgctgttctttagctttcggggcacattattagaatacnataattaaatgaacttttaacttttaccaaaataattattatacggcaaacacagtaattttgtttggcatttaatttgccattcttttctttggctcgtcattttctgccgaaccctctcgccgactgattggcaagtcgtgccaatagagaagctctcttatccgcccaaggggtttgtgtttctgttgggataaatcgctgtgtccctccaagggggggaaagcggaagacaaacggagcggtggcgcggaagggaggcgaactctgatgcagttgccgaaggggaaactgaattggggggggggagggaatggcacgcggacacggccaatggcaccctttgtttgccttgacaattttgccatttgcttttcatgcccatccgcccaccttctgctgcgttgttccaaatgggcttgtccaaatatcattcaaagacatcagcgcttcgttttgtttagctggtgcccacaacaaagtgccgtcggaatgcactgccaaattggctaatgccattgtcgcaaatgccccgaaaatgacgcacaaacaagaaatatttgcgttaaaaagttgcaccattctcattaaaaatgcacctaataaattggctaaattttgaaaattattagtttgccatttattaaagaatttaaacgcttaacccaaaaaacctttttaataatccgtgagatttgcaaatggcggggggggggggagcaaaagtaactatttttatgaaacaattggacaaaagacacccaagggattaattggaatgaaatcatcgcatggcacagaaagtgcgattgctggcgataaccgacggattgccacaacaattccccggccaattgaccgaacaaaggcaattcggagaatgaagcaaaaataatgaagcgaaggaaggattaagcccaaaaaggaagaaaaaatttgcataaattttgtgcaataatacaacagtttatttgttttgttttgttttttgcattgacccaaagaatgattctttgaaaaacttaaaacaccaatttttctgaatttctgagtgtgtaacaatggaattccgccttttctgattggccatcgatgccaattggcncaaatttgttgtgcttagtatgtggaaaataatgaaatcggaaaggagggaatggccaattcgcgaatgtttttgtgaatgaatgtaccccaacattttattattttaca

SEQ ID NO: 43285 - DNA, 869 bp, Heterodera glycines
tttataagccaatttacgcataattggcgccgtcaaccgccccaaacgtcatattggctttaatgatgtatacaataattggaatgatccatttctccgtggctttctctgttgttccctgatgagatgggctgacgccaaaatgatgatgcgatggatgatgatcggtggtgaacagagcagaagatggcaattggaatatgattgaggggaggggtgaagggttcattaaatcggcggaataataatggtacgaaaatttgagaatgccggtgccaataaaccagtcgttgatgagaaacagagacacattagacaatatgtgataattgttgtttgttcattctgcctgcggcagctgctgctgctgaacattcaaattgatgtggccgatggaagacggcccatgcaggaggaggcaccgcacaaacaggcttttccggaaaaagaaccgtcagtgccagccaagaagccgtaactgtacgagagctcctcacctttttgatgaagaaaaagaattgaaaatgctttaaaaatttgcattttttgtagctagagccccatatcatgtcgggatccagtcggggtttcccgaccaagttggtcccgagattaatgtcgggatcaaaacccaggcaaaatttggattgaatccagcaggtgtcgagaattaaatccggtcaaatctggcctaagatgttttgcttttgctgcaaaatcagtagaaagttcaaattgattttattccaaattaattagtggattattgctcgagattttcgctctctgtgttcgaaaaatgtccactctctcgaacaaacataactaagagaatgaagaagaaatggatgaggggggggggggggggg

SEQ ID NO: 43286 - DNA, 750 bp, Heterodera glycines
attctgcgtggattttgctccccataattgttggagtacccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaa

SEQ ID NO: 43287 - DNA, 941 bp, Heterodera glycines
aagagataaccatttttctgagaattaattcacattttctgcagctctaggttaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctatccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagataaccatttttctgagaattaattcacaatttctgcagctcttaggg

SEQ ID NO: 43288 - DNA, 1210 bp, Heterodera glycines
ccccggcttttcaactcgttttccacccatcgaatggcttcttaagatttgtttagttgcccgttttgaccgattacggccgcagcgaacgaaagtcatcgctgggagttgcgcaaatggccctgcacgaactgcagccgagcaccgagccgctgctcgtctggttcaaactgttcccaagttcgagtctaaccggaggggcgcaaccgcccctcgggggagaaccgtcccgcaaaaacagcgaagggtcagcaaattgagcgaagggcccaccgaccagcagcagaccagcgaatgtcttaacacaccaaatgcgatcggtacattccccccccctttcctcccctcccctttcccccaattgttcccatttctcatttttggcatttctcaccccaaagacaatatcgctcgcttgtccaattccaagtcttacccttttatcacttcgcattttgctatctcactttttatttcccattcaaagcatcgtaaatgattttttatcactgtccaattgaatttggcatcatttcaattgctaatgtttaattgcctaatcatggcggatgcccaatcattcaccgtgggtgcacccagtccaggaggttggccatcagctgtgccatcgccctttctcccttctccgccacatgccattccgcgttcgccgtgttcaccgcttcttcatccgtcgctgtttttgcgccctctttttgctttattagcacaattttcatctgcttccgttcgtccttcctcaattcgcttttcttcaccaaatcttcgggtcccttcagcaaaatgatggcatccgttcggtcttttctgaattcgctttttatttttggctttttctccgccttcactttccgatcagttctttggccgtgtcactgctcttctgtcctatgcccacaatgaccaaattatgcagcttttcaagcttggctatttcccaaagtgtccgtccgatttcgtcagtttctgtgttcagttcggtttccaccacggaatggccacttgcggaaaccatttggacaattgacgggtgtccgtggtgccaattgggccaaaaagtgccttaaggggagagcggcattttcaaacaattgctgaccaactattatcagcgtaattgaaaagtatcacggcaccacgctgaatgatcgcaaacggaggacgagaaatatctgtagaaacaacggaa

SEQ ID NO: 43289 - DNA, 996 bp, Heterodera glycines
atttgggagagattatatcgattttagtgcgctaggttcgatgaaacttttaaaatataagcctaacttttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctatttaaaaagcaattaaaaattttaaaaatatttattcatctcccttttgatagaaaaagcatcagagagccttaattaacctgtaaataaaatttggtgcgtttcagagcacgttctaaaaaatacttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttactgcgctaggttcgatgaaactttttaaaatataagcctaaactttttggcctatttaaaaagcaattaaaacttttaaaaatatttattcatctcccttttgatagaaaaaacatcagagagccttaattaacttttaaataaaatttggtgcgtttcagagcacgttctaaaaaatacttatgaattaattttgcaaaaaataaataaataatgaaccacagttaattattttcctgagcctaaaattttaaaaacagcgaagcgagtggcattttttcaggttaagttagtcctttacaa

SEQ ID NO: 43290 - DNA, 1888 bp, Heterodera glycines
  misc_feature (72)..(72): n is a, c, g, or t
  misc_feature (1748)..(1748): n is a, c, g, or t
  misc_feature (1818)..(1818): n is a, c, g, or t
  misc_feature (1833)..(1833): n is a, c, g, or t
atgatgaccatcatggaagcgcagctgatcaatttccagctgggagattcatttttgaatgccaaaaagacnttaaattcaaatacctaattaatggtttattaatttgttaatcaccgttatgttgttggaatcagccataattcatacgatcgaaaaggtgctttttgttgaaaattaaatttcagcgataggatagaaagggtaagaacgtcaatgttcttgaactgttaatgaggtgcttgactctaatggaaactgttggcgtcaaaaaaagcagtaaatatcgaaaatgtatccagacaaaatcctaccgccatttcttgtaaattgtatcaaattctcacttttttaaataattcttaaaacgaactgttaatgaggtgtttggtgttagacttttcaaactgtaacgtcaaaaaaaggaagcaaatataaaaaatgtgttcagaaaaaatcttaccgcactattcactctttatttgtatccaattataatctttttttttattaatgaggtgcgtgactctaatggaaactgtggcgtcaaaaaaagcagtaaatatcgaaaatgtactcaaacaaaatcttgtactttttttgttagatcttaaactatagcaggcccatgttagttgtattgggataaaacccgcagggcttacattcttccttggatggcaaagacgtccttgaaattggaccctctcacttgaaaatttaaaaatttccttgatgcattaaaaggtttttttggaaaaaaacgcgtcgcaaaaaaaaaagagcatatggtcattttcggcaaagtacggttctctttgtattcaaataacttttaattatttcaaatgtttgttgctccgcagacttacaaaagcaaaaactaattaattgacaaaatttaaattttttgtaatataatccatatttatttaaagaaatcatttaacatcattttaatgtttttgatttacccaccttcgtagttaataaagattgttttcaatttttttccctggtctatgagcatcttaatagccttacttaattatgtagcaactttaattaataccgaatcgactacattggtgtatacaaagaccaaacgtattgaatgaatttcagagtattttttctctgaaggtttgggacaccgtactgattaggaccgccgattcatttgttaaaattgcacttttcgagaagtgccttttttgtgacgtcatcattttttcacttttcgcgcaacgacctagcaccacagagagccaagggcaaatttttggactcatttttggcataaatttctaattttttagataaaatatacaaaaaaattgcaaaatatgaaaagtgagggaagcaaacaaaaataataataataataataatcatttgaacgctacctaacatcatgtaaatattagcgtcaacatttaaattttctcttttttatgaattactgaattaattgctttagtaaagtttataatttttagactaatatcaataaacatattttttaataattttcatcatttcctttcatttaactcattttagcaaaattttcaacaaaaaacaaacaaataataagcatatacatttacgtgtaaatattaacaaatcgattagctaagctagagaattgctttttaacattcaatgttcattttataataaaatattacatttatttttatacaatattataataatttaaaaaaagtaaatttgaaacatattanatttgtgggataatttcttttttttgatgattattaatttcccatcaattgatctacctattcctaatangttaatgattattanaaatattttttcattagtctcagatgaaaatcagtgtaattataattggactgac

SEQ ID NO: 43291 - DNA, 951 bp, Heterodera glycines
ctgcccgggacgcgtccactgtaaaagtaagttcttggccaatcagtccaacatcgagccttaaaaaagcaattaattattagcctccattaaatattttaatttcttgtttatttattacacccacccataaacattgaccagcgaagcatcgaacacttggcaagggaacggcgaccccttaatgtgttccccctcgtacagaatgccaatcagccaattgcctgtagttcaaattagttaaagctattaataaactcaattaattaatacccaccgattctgtccggtgtaaatgtgctggtgaaggcattttcgcgccgaataacctcacacttttgcttaagcccagcgggggaagtggcaaaaattgacacttcgcccggggcgacgccggaggaaccgcccttcgtattgacctgcaaaaattataaataattataattaattatcgggatttttcttttgattgttttcacaagaaaattgtgatttttgaaaaagttgtttacttattttctttagctttacaatttttgtaatattaaattggatatgtttattatagagtgaacgggacaccgggaccgggaccgggccgggaattcccggtcatccgaaggtcccggtcccggttcccggtcccgggttttgaaaagctcaggtcccggtcccggtcccggtagggcaaccgggaaccgggaaaaacaagcactggtaagaatgggggtctgagtgaaaaattagtgaagaaaattggagtcaaagggaaaaatattaaataataattaatatattctttcaaagaaacaatagcaattgtgcaaatggcctagtggctagtcaattcccggtcccgtggcactctagtttattattttaattattatttacaaaattgcccaccacaacttcaaccagtgagttcacagagcacggctcattcagtcc

SEQ ID NO: 43292 - DNA, 996 bp, Heterodera glycines
  misc_feature (86)..(86): n is a, c, g, or t
  misc_feature (90)..(90): n is a, c, g, or t
tcgtgatcagcgcccaaataccccctaatgacagttttggaagatttgggtgaaaaaattttccactcgaaaaccatgtgcacccncctntggtcccgaattccaaaatcacttttatttttataactttttacaaaaaaatgataaaaagatgaaatgaaatttattaaatagagaaaaaaattgcggatttttgggctatttttattttacaaaatatcttttcagaaccgaatagtgaatttttttctgaaaattcgaaaatttccagaatttctggaataacttttttcatattattgatagaaaactcaaataaaatgcataaaattctccgatattttctccattttttgagcctctaaacactaaaatagacctgatctaaactgagttatgaattttcaaactttaacccaaaatcccgaggacaaaaaaagtgaccgattttcaaaaaattttaaaaaattccaaaaaatctgaaacgagaaacaaacatcatattcatgctcagcacctcaaaataccccggaaaaaatttttcacccactttctctaccacaaaaaaatttttgaaaatttctagggggcctagctcgaaaaattttgagaattttcgaacatgtagtacaccattcgatagcatttaaaatgctctacaaaaatgttctaagacaatttttcgctaaaatcaacccctgacgagttatgggactgggactgaaatgtcccgctcaggccaaaaattttttctatttccgggaaaaaatcgaaattttttcaaaaatatcaccaatcgatagagctcgaaaaacggttgcttgaaagtggtctccgtttttctgggaaaaatcggcaaaaaatcctaaaattcaaaaacccgaaaaccgttttttaggcctaactcgaaaaattttgaaaattttcgaaattttaaaatttcaaaaaatcgagctttcaaagctctacaataaagtcgctggccaccccccgctc

SEQ ID NO: 43293 - DNA, 991 bp, Heterodera glycines
tttaatcccttactttttggataatttaaaaataaaaatagcaacaacaaaaaaacggtgggtggtcttttgccgcccagggtcctggacattttttcccgaaatttgcagaagaaaaattaccaaaatgcagggaccaatcatcgaattgggctgcatttgccaattttcgagaacaataaaaaagtaaatcaaaatttttttaaagaattttcaataaaccaaaatttttctcaaaaaagtcaaaataaattttcaaagctaaaaaaacaaattttttcaaatttttttttgtcgcaattgctttaataaattaaaaaaagattttctgagggattcagaattaaaaatgacaaattctaagaaaaaattttccttaatttttgcgacatccgttttcagccaaaattcaagtttaaagaaatcactaaatttatccttaagacatagaaaacccaaatatacgatgatcaattaattccatgctaaaaataacattttctatgagcacgtcaataattattccataattcaaattgatcgatcacttctcagcaaatcattcattcacttctgtctgctgatcactcgggccgggatttgcgtcgagaagcctaaaaattgaaaacgcaataaatttggattttctgaaaaatcattcgcttacccgtccccaactttgtcctcgttataaatttgaatgtcaatttgattccactgatcataaaatcgccagccaatcgcttcttcttcccattttgtccatttgctttcgtctcgcacaattggacaacggacaagcagaaaacgatggctattgtcagttcttttcaatgccaattgttcccgagtcaattcgttggtcagcacaaagggcacaacggagtcagcaaaaggcggcggaaagcgaatggtgacaatgaaattgacgggagatgaagccgagggaaaagcctaaaacatggaaaaattgattaaaaatacgaaatga

SEQ ID NO: 43294 - DNA, 572 bp, Heterodera glycines
ctctccctcttctcctctccccctttctctctctccctcgctctctctctctctttttctctttctctctctcgtactccgcactctcagtccgctttcccttcccttacactctctctgacttattccctttctgtgtctcagaatcgcacattttggccaatgctcaggagcaaattcagcacttggaattttcgctggtcaccggcggcaaaggaatggagagggaattggccagccatcggttggacgacaatgtcgccacggaactgaaacttgtgctggccgccggcctctacccgcagttcggcgtcgtggacccgaccaacaatttccgagtgcgacgagtagcgaacaggggcgtatctagaaatatttttcggggggggggggggacccgacctgaagaccttttttttttttctatttaaccaataactttttttccacagctgggtaacaactgcactttttcactaaaaatgaccctattttggccgttttacggcaaaaaacttgtaaaaatagtggcaaatgtaggtccggcggtgccgataggcgccgccggaaaa

SEQ ID NO: 43295 - DNA, 654 bp, Heterodera glycines
tatgctgtttatgctcaagacaaacatagatgaaagaaaaaaactttaaaattttttttttgaaaaatgttcgaatccgggttcggggttcagaatcggtcaaaaataaggtcggattcgtgctcagcacagtaaaatagccctagaaaaatttttccatgatttttaaagaaaaaaaaaacgggaccagtaaactccatgattgccgtattaccggcttaggcgccggctttgagattaattttaggatgatgtaattaattctgaatacttcataacctttctgaaatattaaagaggtgttgatgactccttaattgagcctatatattgtgatttacaacagtatttcctctccttttttcttaattaagctgacaaatgttttcaattgttggaaaaaaggtcttcaacactacctcgtgcaattttctttcgaaggcattttacgctcatatgagcaaagatgaaataatgtggcattggcctgcgcagagtaaattttggttgtttttttcaattttgaatgtttgtctaaatgttacaaattctcagaatttgaccaacatttcatcgattacttgaacaagccggacattgacgggtgggaaatccgaaaaggtacaaaacaaattttgaataaattacacattt

SEQ ID NO: 43296 - DNA, 1439 bp, Heterodera glycines
ttaatagaacccggaaatttcaaattggcggatcctgttgcaggattggaattcaaaattttttccaggacaggatccggcaggattaatcctgcaaatcctgcatttaaaatctgcaggatcctgcgcaggattgcggattttaggaaatttcaaaaaattctgtattaataaaaaagtctttcaaagtataaaaaagtattcaaatatatttttaaaccaaaaaatgatgaagatgaaacattaataacgtttttttgcttacactccaagcaatcgactgaatcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcacgaaaatagtaaaaaaaaattttattaacgctttttaggtagcaaaacacataaaaaattcaattgtataaacttttttctaataaggataagtttttaaacgaaaaatttttattaagaaaaaaatttttgaaaaaagaaagtttctgaatatttggcattctatttttaaaaattttcaaaaaatcaatgcaggatcctgctgaatcctgcataaaaatcaaatttgcgggtcctgttgtaggattggaattcaaaattttttacaggacaggatccggcaggattaatcctgcaaatcctgtattttccaaaatatgcaggattgcggactgggatcctgcaaaatcctgcgcaggatcctgtcctgcgccggtctctaataataagtatttatttaaattcaaatcttttttggtaattgtctaaatgctgcgattttatatattttagtttcgttagactttgtactttcgaatgataataaaaagatagggtttgttcgaacatgaacaaagtcgtggtgagtcgttgcacaaaaaagctcagtgtgggcgttccacaaaaaactcacaaatcagtgattgattggttattttccggaagcctatcgcaccactttcggggcaccaaaagtgcctgatccggaacccggaccggcccggttaaggttcagtttttcaagggctatctcccaggccgggtccggttcttgatccattcacttggagcccgtcatgggtcgggcacatctgccggtggaccctcagcctcgctgccgaccctgtcgatggccaacccaagcaagcttgccggtaacaccggcttttttgtacagctcgatgagctctacaaaacggtatctatcaatcgcgtcaggctatgtctactacaaatggagaaaatttgcgagaagtgagaagaaatgaaaaattaaaaaattgaaaacgacttgcg

SEQ ID NO: 43297 - DNA, 1143 bp, Heterodera glycines
gttatttgaaaaatttacaatatttaaaaaatattctggactctcctggaaattttctataatgtgccaattcttaagaaaaacataaaaatcataaaaattaaaatctttgaataataattattatatatacatatatatatatattttttttaatatgtataattaacttcgaaattacatattttaaattaatgacttataaatgaatttaaaataaaagtggaaaaacctataaataaggtttatcaaaattgaatacaaaaatatacatttttaattatgcaattttataaaaaattccatcttttaagcgcgatcccgaaccagaagaggaccactacaagttatatgcagaaaaataattattattctaaagttattatttaagtcaaaacacatatttataatttaaagcaaaattcttatatttcaaaataaaataaatttttttattcattataatccaaataaaaacatataataataataataatataattcttttctatttatttaacttcattttctaatttaatgaaccacataatgaataaatttaatttaaaaaaaaatttaatgaaaaaaaattaattttgcatctaattacattttgaattttattaaaatatatagaaaaaatttttaagaatataattttatgtaaatatatgatattaatttttttaaatttattatttgtttgaaaaaatttattcaggcgaaaaatacaaactatttaaataaaaattaatcatttttcattgcatatgaatttttttttcaattaattttttttcaaattgttttttttattgcattaaaataatatatcaaaattatgtatataaatgttttaacgcaaactgcttgggatggagcttaagcagcggttgcctgcgcaactgtgaaagaatgggccgttgggagataggattttgagaccaaatcgttgtccgattaaacaatcgactaattgacacgcgagtatatagccggttaaataaccggctaattggccagttggctgtgcttgacctgatccaacggcgtcaattggtcctcgacttttgtgggcagcgatcagttggtgacggcgatcggtgaacaccggacctggtgatgctcggacagaggcgaaga

SEQ ID NO: 43298 - DNA, 1536 bp, Heterodera glycines
  misc_feature (777)..(777): n is a, c, g, or t
  misc_feature (1529)..(1529): n is a, c, g, or t
ttcgataattttgcttcctcccttcagcagcagttcaatctcttttgcccccccccccgtcaaattcttcgatcacttttgcccgccgttccttttcccctcagcccattgatcggccgaccccctcccttttccctccttcgatcacttctcttccctcctttacactctcaaatcgctccccctccccctcttaggtcgcttttccaattcaacaaagcccgatcgcgttcaatagcagcctattctcccactctttgatcatttttccctctcattccccgctgtgccgttctctctcacttacacttcgtcgggcgctctctccccttttcccattctctcaccaattcactaccccttcccccgtccccatgctttctctctctctctctctctgctgattccagctgatcactcgcccctcccccgcgctctgatcatttatttggccattcccccgccaaattctaatcacttatccatttcagcacataaccatcaccaccacaacaagcatcaccgtcaacaacaacagcagcaccagcatgattgcccctctgtttctgatcacgtgatcggtgtgccgagcgtgtctacttccgcctcttccgccacagtgccgccgcccagccgcgacaaatttgccgtcgcttcgccgcgtgtggcgattgtcagcagcacagcggcacactctcacagcagccagtgcccagaactcgccgggcgcctcctcaaccgcgtcgtaatcagccgccaccgcagcgacaccgcccncctccaccgctcattgtcaagcagtaccagcagcagcaacaccaccaccacaagcatcatcaccaccaccattctcctgctgctgctgtcgctacaataggcagtcccactccgccgctgatcgctgtacggtcgtacgtcgccggcggcaccgctgccgccgcctcttctccgccacagagcagcccaatgcgctctctgtcaagtgcctcaggcggtaagcgagggatgtaagcatttgaagaggaggaatgagcgtgaaaatctcacccattgattcaagaaatttctcggttttttgccatttttaacctgctcgtttttagtggtggcatttttatattggaaaatgctaacccgccctaaacgaaaggaactaagggatttcttaggggagtatccgttttgaaaataggcattccttggggggggggctgatgttcacatttgtgccctcgtacatgtcttttcttaaacggcacagggctttacgtcagtgcgcctggaaaaatcattctgttcggcgaacatgcggtggtttatggacggacagccattgcgggttcaatcgatctacgcacttatctgtgagtgttttggcctaacaaacacctgctaattgaatagggagaggactgcccataggcattacgcgccgaattgcctggggcaatttgaaagagcaaagccaactcactgtataaggctatcaccgccgttcgattgtgcttttggtcctaattttctcaaantatataa

SEQ ID NO: 43299 - DNA, 1400 bp, Heterodera glycines
agttgaaaggaacacaaaagtgttgaaggaggcgctgtgcaaattggtgtcaatctgacaattaaaaacaattttaaaatttgattttaaattcaattttccatttgattggccccatttcttacaaaataaagtttataggcggtaatgatcggaatggatcccttcgatgggtccgctttatcaagtggggccaattggacaacagtgatcaagcgatgcgcagaaaacgcaaaagaaacgacaaaagcaaatgcaattactggcttacaagcacgacgccaaaactaaaaaaaatgaaattaaatcacaaattaatacataccgtaactctaatatgaatagattttggtcaaaaatgatcattttgaggaggacttttggtaaagaaaaaacctaagagcacagatattgttagaaaagacagtgctagatttcgacagtaatttaaaaattatgaaagtttaattgtttttgatttttgtttgttcaaatggcgagaagtttcattatactcgaaaactttgctaaaaaatgccttttgcgtatcagtcagttttgtttcatgtttctcgagttgattccttctcgtgatttgagtcctcgaaattttttagcgaatagacataaatttcatctaaatatttcacttcaaatccggtataaaatccgtactggctttttgtcggaccggcacccaaacgcttgaacatcggttgagtgcgatggcaatgtgcagcatgtaaattgggtagttgaagaaatagatcagaaatgtgccgacgttgtaaaatgccgacggcgaagtgccaaaccatgaggaagtggggccaaaaatgggcagccgatagtacacaacgtcgatgatgtaatggccaatttccttaattaatgtaaaaaatgtataatatttttaattttagttttaccaaaatgccaattacgctcaaaaagcggaagaatggcgaagaaaactccttttttgtgaccaacacaaaaatgacgcgtaaatacataggaattgagacgatttcataaatggaatagccgacaaaggaaagagttgaaatcatttgggaaaagtcagcttaatacattaattcgtgaaccaattaaatgtggctaatttcttattcagttagtagtttgtcagaatgactttaaattagggttaagccccgaccccgagctccccggtccccgaccccgatccccgacatttttgggcctattctccaccccggcccccgaccttttgccccccgactccccgacactaattcggggaattggggactccgagcgttgtagagatttataaagttatctacaacgattgggggaaaggttgataatttatgaaattttgaacaatttttcttaataaaattaattaaaaa

SEQ ID NO: 43300 - DNA, 1208 bp, Heterodera glycines
  misc_feature (198)..(198): n is a, c, g, or t
cttgaagtgatcaaaattactataaaatgcactgtttctttaaaattacagaaattttttgctgttcgaaattgaacacctaaattctcatcgtacataagtcgtagagaaatacggtttttcgtattttgtcacaaattttttatatctttgccattttcctgctgtttgtgccaatctttcgggtccccgtttgcncaacactcaaaggcaaaaaaatgaaataatgaaagtcagaaggtttagacactaagccaaataagcatatgaataaatgtttaaaatgaaataaataatttattttttctaaaaaaatctccttctccaccaatttccttctattttctcacccagacccccattttagtcccgccgggaccagggactggcaaaaccggaaattcccaacccggttccgctccccctcagctctactattaacacgaaaatcccaaaaaaggcaaaaaaacataataaaattcaacgtagaagcttcaaaccaagtggaaaatgtgttatttatgcttaatatatcggaactagtgcgcaaaaaaaggcatatgactcaaaacttcggtctctagttatgagaaactcgccgaagcaattcccatttactaatctttttgtaatacagtacgaacagaaatatacagtaagccagtattaataaattcaaatttattgcaaaaaatgaaaagcaaagtacaaaaatatattgtattttggtgagataattgctaatttgaggggagggaggagaagaaacattcgttttgtgctcactctcctcctgcttcacattgcttttacatatgaaataaattggatgaattaattacccgtctaattggcattaaattttgggtttgttatccgtctgagcttttcctcttcatttgtttccttattcaccggcggcggcactgtctgatcgattagcacccgttcattgtcactcattggcacctccgttcgatcagtgccaacagtcctcccctttagccccacttctcattgtgaaatgctttatgtcgtcactgatcagctcatcactgtcatcttcttcgtcgtctccgatacaatccgtttgttgttgttgctgatcagctgcggttgttctcctgctactgctgatcaggctgcttctgcttcttctgctgatcacttcccctctgccggtgccgtcactctccggcgccattgtc

SEQ ID NO: 43301 - DNA, 1104 bp, Heterodera glycines
  misc_feature (39)..(39): n is a, c, g, or t
  misc_feature (204)..(204): n is a, c, g, or t
tgactttggcggacagcttggccttatgatgggtgttcnagtgatcacaatcatggaaggtggcattctaatcagtgagctgctggttttgttttttgtgccaaaaatggtccacttggctgagtcgattgttgaacattgtcgttggcactgatcgggtgccgtcgggcgatggcccaatgttgccttctggcgacacggacnccaatgtttgcatttaatttttaataaataaataaatatgttgaaaaatgtttatttaataataataaatatgatttgattcctaaaatattttaatatatttaattgagaagttttatttcattttttaaaattaatatttgatttatttaattaatttctctatttttaacacaaaagaaataattttaacctttagttttcctataagaaaattgtaaatattttcaagtgtttaagggctaagaaaaggcgtgttttggtccacaaaggctctgttatccgttgggcagccgaatcagaatgttgcaatgctggaaaattaggacttggcacaaccaactcaaatggcgagggcaacaaatattactcgactattgatgattaaggccaccggactgattgatcagtttgatcagtgatcggatgatattcgaatgttgggggattattagagaaggggacactatcacaaatgatgcataaatttgaatgatttatttatataatgtctcaaaaattgtcaaagttaatcacccttctgctgcaggagggaatcgtcggccggcggttcacccccagggacgggcgaaaacttcgcgtttttgggcttcgttaaaaaaatcacgaaatgtgaaagaaatatgtacaaaacctcaaaaatatctaccaaaatatgtaaataaaaatcgtaacttttgttcaaaaaaagcgtttgtatgaatatggaaaaaaattatttacatgaaattccagccccactacgtaatcaatcaaaataaataaataaacatacaaaccagggctggccgtgattgaatttccaatcacggaaatccgtgaggcgtgatcacggggctttaaaacatatccgagacccgagaaccgcgatcacggcac

SEQ ID NO: 43302 - DNA, 1047 bp, Heterodera glycines
  misc_feature (183)..(183): n is a, c, g, or t
cccatcatcagcaattccatcggggaatagaaaaccgaaatcgatgaaaatcaatgatcaagatcagtgagaagtgtcggcgaagtgcgacggcgcaaattgtccaaagcatcggcattatgaagacccaaatgacgaatgtttgtcgcaaaaagtggccaaatttgacggataaaaacatcncaaatcggttggacatccgtatcaattgcatacacaaacactttcaatttggtgcctcttctgtcccaaattggcttgttggagcggagaaatttgatcacggaatggtcaatgtagctgaaaagggggaacaatgaagaagatgaccaaccatattaagtaattggtttctgtataagtttgatttactcaatccgaaggaaacgaaaacggattttgtttggcagcgaatggtccgacaacggaaaatccacaaaactgccatcgatctgtacagacagtttcgcttttggtcctttgtccttgcgaattacgacacttctccaaattgtcaattcgctttttctgtcgaaatgtttgtccaccaaaacatcgaaacggtcggaaagcaatgccattttgaggccaagttgagcatggtcaaatgatgggagaatgtccatccaaacgtcgctacaaagccaactgaaacatggaaaaaatggatgggggaaaatgaaaatttgtaattttaaatgaaaatccgtaatttttcaaaatatttgctgaccgtcggttcattttgtggttcaataagcacaggtctcaccaattttttcaattttatttgtgtgtcacaaagggcaaaaaaaactgtgttaacttaaagcatagacaattaggaaaaatgagagagcaaaaagaacacaaaatttagagaaggtatatgaaaagtgaaaaacagtaatttcacattaaaaactttgaaattaccgaaaaggagaaaaaatggcaattttatactaaaatattagcgtacatttgagtaccgataaaatgccaatgatttggtgagatttaagcgggccaggacgtttcgcgtgg

SEQ ID NO: 43303 - DNA, 423 bp, Heterodera glycines
atccccaacctttttgttttgtcttaaaatatttttcatgacatccgtgcctcctcccgaaaactcatccccgaaactttattttcctaccattgatccccttttttctacttttgatccctcaatttttgagtgtcatttccctccattccgtccccaacttttttttttgccgtgccggcgccgaatgatttgagagaacagcacttcctcccccccccccccccccgctcatacatcataaaattcataatccatccaataaattgtgagtgttcgtctcctcccccttcccatcatcatcatcatcatctttgtaccatcatccgtcatcatcttcaaagcacaagcacacactcagattcattaattttcacatggttttttatccaaaagcaattccccccccccccccccccaaat

SEQ ID NO: 43304 - DNA, 190 bp, Heterodera glycines
ccgggtgaggtatattttcaatttgtacatgcgagttagaaatatttggcaataatttaatataaaattggtttaaaccgaataaaaattaaataaaattgaaatataaaattttacctaaaatattttttatttgaataagatatgaaaattatattcaaagatagaaacacatagaaaaattaaaact

SEQ ID NO: 43305 - DNA, 1000 bp, Heterodera glycines
gggtttggtatacccgttttagaaatagcgtagaaaacagcttcgatatcagaaaccaagtcaagtccagaaaggaatattttataacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaagagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggag

SEQ ID NO: 43306 - DNA, 1114 bp, Heterodera glycines
  misc_feature (83)..(83): n is a, c, g, or t
  misc_feature (1069)..(1069): n is a, c, g, or t
atttgaatgaaataaaataaattttacctcaagtttttgggcatgagttaataattttataaatatgcaatcgattggacacntaaaatgcaatagagtagcgtataaaatttgcaattttgccagttgcactcacgctcgcataccatctcgcgtatgagcggctggcagtggtgcacccggagattcgactgtttcgtgacgactcagttgaactccggggctcgatgaacgggccgtcgtgcggactcggcggattcgtcgcgctgatgtcgctggccctcgggcgtccaccattgcaatacgcactgagtggaatcctcggtgaccatggccaaggcaccgaggtcggcggcactgaggagaagttgttgggagcgaggcgcgccggtgtcaaccacgtgcttctcccccacgacaatgctggagaagtctgggccatccgtgaagcgcttccggctgaagatctgccgaccacgtacgaatacgccggtcacgtggacgaagcgatgcccattcttttccagctagccattttttttttgcgtaaaacattaaaaattttagtgtcaatttttttttgcatccgatcgcttaacatatgattagaaaattttccctaaatgacatgaatataataaaagttggttggcaaaaaaaaaaaacaattttcaaaaaaacagaaattttgaaacgctttgattttgcgggaccagcaaaatcgattggggactgggacccaccaaccaattcatcaattttttccgaggaccgaaaaatttatttggtgtcaaaacgccagaaatgatctaatgaaataattattaaatacaaatttctgatctgtcctgcgctataaacattgaaataaaaggcagcatatatcatcgatcatttaacgaactcattcatcccaattcttttgttgtcacagttccaacttcggacgctcattttgggtagaatttgcggcccgctttggcgtagtctgaaatttacaaagaataaataaaatgaatccaattaaagtgccgaatgtcaaatcgatggtccactaaattcagactanatgcacatgaatgattatattttttaaaattttatttggcgccct

SEQ ID NO: 43307 - DNA, 1318 bp, Heterodera glycines
tttttaaaacacagattatctttaaatcattaaaaatctggtcgcaaattttttaatataagagaattaggtaaatgacaatgccaaattgtgtctgaagatagagttgtcttttttatgtcaattttacgacttttgttgtatgaaaatttgacaattttacgcagaatttaggggaaatatttagtaaagcgaaatagcaggaaggaacaaaagcgattggacacatttttgtaattatgaagatgaaaaaagggtggagaaacatgactgatcggcagaagcagcagtgcttttttcggagtgtgcaaattagcgcgtctggggcgaaaacgcgtaaaaaattttgctcaaagtatagagctcgcccggcacggaacgggatcctgcgcgggattttgcgggatcccagtccgcatcaatcccgcagccgagtctacaattttacatacaaaattttttttttgaattttggaatccagaaatttttattcatcagaaacacttacaccttttttaattgactctcaatttttatttactttagaaaatttggttattcgatttttaatggcttcttcttcatctgctgcttatcccatgctgaccttcacgcaaaaacgggcgggcgatggtgagttattggcacataaaacaaaaaatatttgtcgccgggcggtccgaaattttggaattttcgaccctttgaatttcatacgaatttttttttctcccacttttattcatttttaattttttttctccccgaatttagacaaactttgggtgttctactggctcagcgatgagtcaaaattcggcatcgccagcttccccgacacagtgtacgaaatggacgcggtcagagagatgagagacattttggggtaagttgaatatttttgttttgccttcgaattgactgttcactgatttcttttgtttatatttttgtttgcctaccccaaacggccctcaaaacttggaaaatacgttatgagaccagaccgctttacgataccgaaaattttaaaaatttcttttatcggaccgaaagagtaaaacggaaaattttttatttatattgaccaggcttaatttgtgcaatctctttccccggaataggacaatgttcatggagggccggaccgagatcaagcaggtcaacgacgagtacgccagcgtttgctacgccttcaaccactccctggagttgccacgcgtggacgacgcgacggcacggcgccaacgcattggccaacttttcaatttttttgtcgacgaagcgctggagaagaagcacacggaggtacaaatt

SEQ ID NO: 43308 - DNA, 1189 bp, Heterodera glycines
attttgcaaaatctttgattttgtctttgatttttcatcaactacctgattttaaaaataaaaacttgacttcaagacattcaatagctcattcgaaagctcattttttaataacattttccttcacttttagactttctcaatgtgaaattgaatattggaaaaggaataaatctgttaacttttatttggagttagaatggcatctcaacaaccacaacaaagcgtgacaaattactccttgcaatttcggattaatgcccaatatatgaatgaacagttcagagactccgtaaggtgttgtctgaatggtaagtgattgttcgttctgttctgagtggttttttcatttcttatcaaaacaaaaggttctcatgaggattctttgccttttcctcactttgcattcgctgaattcctcgctgattcggcagttttatcaggtcaaatccgaaaactaaatgggaaagtgccctcgctttaggcattcgtcgtgaacttcaatccgcggcatggatgcccaaaaacaatgacctttactccctcagtcaaactgtggatttggccgattttcatgccgagcattacccaattttaaggtcccgcaaacactcttttagatttatttaatgtttttacatttagtgcttttcgtgattttatgttggaggacgtgcgaaagtggctaatgcgtgtgacgggagtgagtcttgacgaccgattggcactcaccgggtcgcgttattcgtcgggcgactgtctccttcctcacgatgacaaactcgaggttttttccccttttttcacttcgtattcgcttttatatagggccgtgcgtttgcctttgtgctttaccttacccccggctgggaagaatcagacgggggacagctttgtctgttcgactccgacccggcgaaaaattacccgggcgaaatcgttaaacgaatccaaccgcgggagaacactttcagtctgttcccagtgcagcacaactcgtggcattctgtgtcagaggtgctcagtgaacagaaacagcgcctttcccttaacggatggttccattacgctccggggacggcgaatgttgcacagacagggccaaattgcgctgtggaagagccgatttgtcgggtggagccatcgatgaatatcacggcaagtcggacaaatacaaacaccttcaggc

SEQ ID NO: 43309 - DNA, 1009 bp, Heterodera glycines
caaaaaagagatacccatttttctggcatagagaataaatttaaaaatccctgtagaatagaatggccatgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcacaaaaaagagataaccatttttctggcatagagaataaatttaaaaattccctgtagaatagaatggccattgctctccgcgcccctctgcccatgctgggaacatttgtatggt

SEQ ID NO: 43310 - DNA, 1026 bp, Heterodera glycines
aaattttattcacctccattattgatagaaaaagcatcagagtgcctaaactaacatgtaaataaaatttcggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccggttggggtactcaaacatttatggggagcaaaaacccaacgcacaactaaactacaggatatagggaagatattccccagagattgagtctcaccatatatctggacgcatcggtgccgcgggaacgccccgagaactagaaatcgatattttcgagtgtcgcgtttgcggtactcaaacgcttatgatgagaaaaaatcccacgcaaaattaaagcacaggctgtacgaacgctattccctaaggattcgatctccccataaatctgagcccgtcggttcgcgaggactgccccgaagacaaa

SEQ ID NO: 43311 - DNA, 1262 bp, Heterodera glycines
caaagaaaaagtaaaaaggacgacaaaaactgaaaagcaattggaaatgcatccaagggggggggagtcgggttgggcatttgaatttggcgcataaatgaataattgatgggaaatgccaaggcaaaagcggaacggaaaattggcatggatttgaagaaaagttgagcaaaaacagttaagctactcgatgagaaatatcaaccgggtatgacattaaatgccaaaattggaattttccattgagtttgggcggcgattggatgagagaatgggcggcggacggagtgacagcgatgacggcaattccaattaagcccaaattgccaaaactttcggagacggcaagacgaagtgatgacaccagcgacaaatgaacatggggaaaatgaggaatggcaaagaagaagcagaaaagccgaaaaggaattgtgggcctgggtttgcacggcactccctcccccgaacttcggccttttttggccgtcctcagaccgaacagagccgacttaagacttttttatttgtatttttgattgacatatcactgacataattagtttgcttaattagtttgctccaatgtctcaattatcacttcaaatgccctccaattccttccccaatttcgctctttccttccctttgtatccatcgatgagatgaccttgtgccgatattgttttgatcgggcggataactgcccatccgatcaaatgatgaggcgagtctgtctcttcgcttctcttcctcttcttcttcattcgttcttcccttcctttgcccttttcctccccctctttgatcataaatgtgaatttcttcttttgcacgtcctttatttttaatttatcttaaattgctccttctttccttccctcccctctttctttccttctttgtttctttcacttgtctctccgtttattacccctctttttcttttctcactctctctctctccctctctctctctctctccctctctctcttctctctctcttctctctctctctgtctctctctcttctctctctctgtctctctcttctctctctctctgtttctctcttctctctctctccctctctctcttctctctctctctgtttctctcttctctctctcttctctctctcttctctctctctctctctctgtctctctctctctctctctcttctctctctgtttctctcttctctctctctccctctctctcttctctctctcgctctctctttctctctctctctctctct

SEQ ID NO: 43312 - DNA, 680 bp, Heterodera glycines
  misc_feature (654)..(654): n is a, c, g, or t
tttgccgagctgacatttttggcgacatgttcaaaaaaaaattcaaaaatttttcactaaacaaatcagtcgaaaaataatcccacagtttctttaatcacgcagtctctaattatcccctgtattctgaggaggttgaaaaataatcccccatgggctataattagagcatatacggtattaatcgagataaatgcaatactgaagaaaaattagtcattttttgagaatattaaactgggataaaactttggggccacacatttaaatttaaaaaaaataacataaataaagagcgggatgaatattcaaatacagccctttagctatttgagagtcataaaggcaaccatttgggccaaaagatcattgaatgggtccatatgacgattttttcagtcctcaggccaaaggaatttgcactgatttgaatctgtggccccaaaacggaaaagtaccaaatttttattcggttgcagcaattaattgttatacgaaatttattgtttttttaaatttgctattcaaggaattgccaatgtgccatcatcgttgaccagtggtcggggtcagcagaaacagtattattacgattacggtggtttggacaacagcagcaacagttacggtggaaatgggaaaagtggacccaantaataacaacaaccaaaacaacaaca

SEQ ID NO: 43313 - DNA, 989 bp, Heterodera glycines
cccccccccgaaatgaaaatttttaaaaattttccagcaaataatggaaaattttttcgaattccccccccccccaaacgaaaatttaaaaattttatagacaattttcgtaacaaatagcactcaaattttccgtaaaacggccaaaattgggtcctttttagtgaaaaagtggagtttttacccagcagcgggaattttttttaagcagccgccgccgactaccaaacagtagaaaagtctacaagtggaaaattgcagttatttgcagatcgtaaacaacttttatcaattttattcagcaaaaaaaattatggataaatttgcaaaaaaaaaaaaggtcttcggaccggacccctccctttccccccccccccccgaaaatttttcctggctacgggcttgattgtatgcgaatttgagtcgaatttcgcattcttgaatgtcagttataatacaatttttagctttataatgaagtgtcggctctgtacgcgacctccgaccaaatgattgttggtgaggaacctgcgccggctcaagcaggcgctgctgcggaggatgccgccaacaaatcggcaaaacgcgcagcacttgccgctcagaaacgacagttggccctggatagggtatattcttagacgaacgttattatttggagatgttagaatggaaattttattaaagaaaaccccgaacaattattagacagccattatagtcctcatttttaagtagataaataaacctctaattctaagaaagtcagaaatgaaaatttaaatttttcgaacggcgggtggggagcaactgcttcccgtcactatgcccaaatttaataatccgttaaagaaaaaataactaaaaattatcaaaacatttttcttttccattagatgaaaaaactgcagtcgtcgttcaagtctcaacaccctgacttggcagaaggctcttcaaccgccagtggaggcagtggcacaccaaaaact

SEQ ID NO: 43314 - DNA, 1263 bp, Heterodera glycines
ttttcatttaaaattgctttattttcattggtatttaggtcccacggcatggatggctcgaaaacgcactttacgtgtgcctttattttgaaccgggccatgatacgctgaacaaccaattcacgacgatgcgtcaaataatcgatcatttttttgccaatcgatgggttctctgagggggcgcaatttattcggacaaaataaaatcgcacatttacagatccttcatttgcatgtcgattttcaaggtttccaacaaagaaaaagaccatttcctatttgtttgtttaatttattttaattttcagtcaatttgttccaaaaatgggggcgctttaaggctgccaatgcggcgatcgccagcacttgggacgcttctcgtgcgaatgccttcgccgaaatgcatttctccacaattcgaagtgccacttttcctacctccggattgctttctttggaaatgttcgacgattatgacaaaatgctaagggcaatgagcgaggcaatcaaatggcttatccttcaccttccaaaaggtcgtttcgtttataatcaaaaatctttatatatatgtataagttttcagatgaatttatgtcgagaaataaaagatttaatctttttgctattgctgaagattctggagaaattctaaccgttttgaaacagttgtcgcaatttgaatataaattccgaaaagttttcaccctttttcactaaatgtcattttttaaagaaaaaattaaggcaataacccatttgaggaacaatcgtcaagattgtattaacgcacttcatgtacgaatttcggacaacttctcgcagattattgcctttttgcgcaactctttgtctgtcaaatcagaccgaaggaccggttggtttacttatacttactgaccctgacaaatggtttcactccctctattcatttttaattaaatgcaaacagaattaattattgtttctatgagggatggcatggttaaggaatgtcgcactttggtttggcttattttcggtttttgtctgatttaaggaatttttcccttttttggttggggtacgtaatcgccgtttatcccgtgggttggccgttccataatccttggatttttgacgtccttggtgacctttgttcctccatgttgcttatctcaaggccgtgtcatcagttggcttgagtcggtgaagtgttccgtggttggcctcgtctcgtccctttgctcttccgacggcgattgcaccgccgccgcctccgtt

SEQ ID NO: 43315 - DNA, 1291 bp, Heterodera glycines
ccccaatttccctccttccaaagatgttctacttctgccagcgtgagaacccgttcttcgaccccaactcggacaatgcgatgattctgatgcaaaaccagggcattgggccggcccaattggacaccgttcttaagtgggggggggacaccaaatccgtgccaaaagccaattcattcattcattgaccccttggggcatttagggcgatgaccggcatccaatttgtgctggtcgagccgtgctcaccgccactttttctcgtcagaaaacagcagcggaacggaccggacaaaagtcagtcggccgagggcatttgttggtccaaataaacggttcactaattgtctttaattggtcaattagtgccctaatctttcgtgaaaagcacgcgttgattttccaataaccctttcttttctctccccttcacagttacgcctctttgccacttttatgttttggatggtacggtgtaccaggcgcccgacatgcatacggtagctctttgcttacagtactcattaatcatttgtttgcttataaatcgtcttttcttggacaatgtttacctcttgttgttcacagttgctccattctcggctgattggtgtgatggaccctttgcgctgcgctttccaagaagcaggtgagggaggagctgatcacaatcagaaactgacaatgagtcaagccgagccgaatcgattgcaattttaatgattatcctaattaatgaccattttaattggtttaccatatccctcttggtcgcttcaatcactttggcttaattatgttacgcttttctcctttctctctaactaatctttccatatctatctctccccgtgtctaactccctctctctctctctctaattgtgcccttcccccctttttcattgtccatgttgcgtttcacccccgcccgtggtcatttttgggagtttcgtacgcgtcccgctcgccgcgcatccgcaacggcgccggacgacgcggaaacaaacgatgaagagatggctgagtttgacgaacagttagacacggatacgaaggagaaggaagggcacaagcgcacgcgtggtgccgaaccgttgacaacgcgtgcgacgccctaccaaagtcagcggacacatgcgctgctggccgcgttgggcgagcggttcaaaggcggcgacgaaactggaagaggcgccggagggcaaacagccggcgaagggagcgccacgaaaatggtaacagacggagagccaaaataggcaaccatactaatcagaatgatttaggat

SEQ ID NO: 43316 - DNA, 1236 bp, Heterodera glycines
cattttaaaaatgtaaataaatattcttatagaattatagtaaatttatttaaaatatataattatacaaaaaaatttgtcggaattaaaaaaaaatataaagaattgatcataaaataatagttaaataattatgcgtattttttaaatttaaatatatcttaccacaatcatcgtaataatcacagcggaatttatgcggaacacatcggcgattcttgcctgaatgaaaaaagtaaaaatttaaattaattaaataatcaaacaatttttacattgaaaatcgccagtttggcatgctggaaattggcatgtcgaaggttcgtcctggcatttgaacaaatcaatttaaatttttataccaaaacttcgcgcactgaccgatttgtctgcctgaattttaaataaatatatttttaattttattttttttttaaattttgctcacacaatctggcgttccatcacacacccagaccttctgaaatgtgaaaaaaaaaccaattaaattgtccaattttaatgaggccgacctgaatgcattgtgttctgtccgcgcaacgaaattggtaaggaaaacaagcctataaataaaaacataaatttataatttttaaattatttttaacaaattggccatttattactcttctaaaagcacatcaaaacacacaataaattttaaagggataatagggagacgaaaagaaaggcttaaaggagatgcagaaataattatttaagattttgaggatttagatttttctcttttttaaagtttttattttcttcatttttaaatttccccgcgcaattcttttaaaattaattatttttaggatttttcatactgaataccaaaggggaaatagcaccgtacaccaaaggtactctgaaccgatctcctaccgtatgatttgttgcgcatgaatccttttcatcgctgaggtcacgacagtcgtagttgccgtcacatttccgtgcaattgggaagcattggcggccgtccgcgcagctgaacaccgacccatcattcacctcacagttcaccggacttgcggctgaattttgttttttttttttcataaaatttgaacccttggctgatttcaaatttgaattgttttttattttaaaattttatttttattgtgtccaaatcgtccccgccccccttctccatcctttccaaattttcaagaatttttgcaagaaatttgaaaattctgaattttg

SEQ ID NO: 43317 - DNA, 1199 bp, Heterodera glycines
acatggtctattagccttacaaaaagcgaaaagattttcaagctgggaaaatttgcatgttttttgaaattattggtttaattgagacgaattcctgtaaaaaatgcacatttttggaatattttatgattatttattgtaattgcgtcttcaatttgattgaattggtgcacttttaactaattatcttactttcccctatttttaataatatttttcatcaacttttaccaattttgttcaataaattctctcaatttaatgagtcgcgactttattttggcaataaacaaataaacaggaactaattagcaattaatagtcaatgatttcagacactaattaattacctatcatcaatcaacttccatcgatgaatgattatgattctgtttggcgtttgttttcaataaattttcgtgaaaataaaaggacaatggaatcaaaaacaaaaattaattggactatttaagcgtaaaagtgagcagcaaaagtcaccattcaatttaattatacccaattaaaaaaagtaaatcctctttaaaaatgaaattttcaataattttattgctttccttggccttttgtgcgttaatcatcgatgcatgtgagaaaaaattaatataatgaattatttttaatattttaaatagatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaagaaggaaaagagaggaagtggaggcggaacatggggcaacggaggaagaggaaacggaggaggaggacacggaggaggaggacatggaggaggacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaaataaaaataaatttttgtattttttaattcatttctttttacccgcataaaacaaaattagttcttccgttcttttgacagtatccctgaaaaatatttaatgatgtaatttattcaatgctttttttatcgtatataaacgctgacaaatgtgtacagtaatgtt

SEQ ID NO: 43318 - DNA, 1151 bp, Heterodera glycines
gattgactctttaaacacaaaagtggggggggggggagaagggaacagcagaaaagcaaagaaagaaccgacgaccgactgaaaatgcaaagcaaagcaaagcaaatctggaagaagcttaaattgtctgccaacggaggcgagaggcacaaccatccgtcctcccttccttcccccccccccctcattattctcattacaattggcacagcttggctggagcaagcaacagaggagggggaaaggagggagatagaagaaagaatgggaggaaaagtggaaggagggcaatgggagtgtccgtccccttgtcgcccctcccattcggtggttccctgctgcccgccatgcatccccacttccgtccatccccttcggcaatccatcaccagcagtccctcttccccccccccccctccttttccgttttcgtatcgatccgtccgtttgctttgccctcccacagcgtttagcagccaaatccgccaaattttatccttctgtcccgactcatctgctgcttctccatcttttcacttccattgttattcgcagcatttggaaagtatcaaaaggcggccaaattgagaaatgggtaaaaaaggagggttaaaatttgtggcaaaagcaataaaaaagtttcaggaaagaaatgccaaatttgcaagaagaaatgttccggcgaaatcgtgcggacggaaggggacaattaccttcacatcgaatgtttcatctgcaaaggtgggcttttctcctcctcccccactttcacttctctctttcgcttcagtctgtggccgttctctgtccgacttgggcttttacttaaattccgacggcgcttacgtttgccctgaccacgtccaacggcccaactcggccgcctcgggccaaccgcaggcgacgccatcgaagaaagaagcgaagaagaagtcgcgcagaagcgacgtctccctcccgctgagcatcgaagcggacagcgaagtgtcgcggccgactcaccgcgagtcgcttcagccgtcgctcggctcgcccgtcagctcgacaagttctgttcggcttggtcgccttcggtgtgtattttcgcccttgttttagcatgtgccggctgcggagaccattttgcagtcggggcaaatactcctcgcgct

SEQ ID NO: 43319 - DNA, 1049 bp, Heterodera glycines
cagaaaaatggctatctcttttaggagatttttcttctcgtaaccccgatgctaatccgttccggagagcctcttcaaaattttttccattaccctaagagctgcggaaattgtgaataattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaatggctatctctttttaggacaattttctatctc

SEQ ID NO: 43320 - DNA, 852 bp, Heterodera glycines
tcataaaagtcgattggaatcataaagtgcattagagcctctaatagtcacataaactgagaccatttttggcacattgctccattattcgtgcattccgaccccttttcctccacctgaaactcagagttgcttctcagccgagccaatctctcatcttgttccgccaattgcttctcctgtttcaatttcttttcataaagctggctaatccgctcatcctgttcggcactttccttcttcagacggcgatattgcgctttcagatcaccagcagaatggtcaagcgattggtcgtccatttgggggagggagtgtttgcaatggcaccgaatgaaagaattggatggaattgaatgggatgggtgctcgagagcttgtcagtctcgactcgaacagcaggggccaattttattttgcttgaaaatgtgaaacattattattctttttacacaaacaattattataataattattggtgaaacaaacaaatacatcaacatcacaaatggaaacgtccccgccgggcccgttaccgggccgcctgggcctttatttttcgggaataccaccgccgagcccaggtcccacgacagcccgtcttggtccaatttccatggccccgtctcgtcattttgggtctaatgttacatcaccctaaataaattacctaattaccgtgaagtaaatagttctaatgttatggaatccggcttattataaattttttccgtggtcaatccaatcaagtgccgtaaggtatacaacagggatggagttccgaggcactaaaaattttcggaagtcggaaagtgaaattccgatgccccaaaaatttttcggaaatcggga

SEQ ID NO: 43321 - DNA, 1198 bp, Heterodera glycines
caaaaatttacaataaatgtcaaattatttataaaaatgattaatataaaaaataaattcactaattttcttaggttcaaaattaaaaaaaactatttgtttttttttaaaaaaactaaaaaaaaacgatttttttcatttaattatttaaaaaaaaatttttttgataactttaaactcgtggtttattaagaaaaataggcaatctattttttaaacaaaaaaatatattacaaaatcaaaaatgaagaatgaatttttgaaagtttttaaaaaagcgtaaagcttattcaaatttaaatacgtaaaggattagaaaattctcaaattcaaataattcttaaataatgattatcttattttacacataaatttttttggacaaaataatttctcatatggaaatgagtattttaatttaatttttcattatgcaattattttaaaagccaaaatgaataaatatgcattattctggtaaaagtctggatcatttcacataaaaaaggggcaagaatgctcgttttatgtgattgtgccattgcaattgcgcaataatgcagaaagaacgaccatataaaaatattttattatgatttcgaatatatttaaaaaatcaattaaaatttacttttacgtcatataaattaattccgtagcatttgagaaagcgttttaaaataataatctttttattatactagaaataaaatttaattaaaaaatgttaacttaaaaattcagtatcaaaataaaaacagaaaataccatatcaagtttaaacacagctcaattaaaaaaatatttcatgatttatttttaaaagtaatactttttataaaactttgaaaacattaatttaattcaataatatttgaagaatgaaaagatggatttaaaaaatattatatgttttatataatataaaaattgattattgtatctgctatgggccagtgtttgtcaaatatttgtaagaaatttgatttcgctaatgactaaagaaaagtgaaaatatattaattattttatattataataaaaaaaatgatttacttcacagttctggtttaatatttataatttattttctccaaaactaaattaatatagtaatagtaataaatgcatattttaccacagtaattaattggtgtctatgtaatctttgaatttaaaataatctattttttaataa

SEQ ID NO: 43322 - DNA, 1050 bp, Heterodera glycines
tttttacacaccgagtcaattttgagcccctagttcaaaaagtaaatgcatatgtggcgaaatggtttttgtaagatagtaaagggacaaagggtggtggttcgagtccgttgtgcaacacgaatatttttatttatttttgtccaaaatattaaaaaatgacgaattttgggaattatttttgaagctttttcccaaccaaattggacaatcttagtatcattcgaaagctctttatgaggagaagctttttctaagcaactgctaagcaattggattgattaggaaaaagatatgagggttcgaaattttattttttgaataactttttagaacaacatttaagctataaaaacaaacagagaaaacgatgcagaatttttttctctgtcgctatgcaaaatttgaagcgcatttaacataggacaaaaaaactaaacatagaaatgtaaattccgtttttctctattaacacagataaagaaatagtacgccaaaaagagatatgtttttttctctgcactctctctttattgacacatgtctcgttttttgactcggtgtgtttacctgatcttaactcatataagccttaacttcaggttggaagcgcctggatatcattcaatcgttgattatccgatgtcattttcaacaatcaatgacaaaatagataataatatgtacttgaatttggatcaattcaaatctgacatttgtctggtttctgacaacgcaatgctttacaataacacaggaagtgtttattttttggcagcgcaaaaattgaaagttttggcaaaatattatttttccgagaagtatcttttgttcctcgtctattcgttgccctttggaaaagccttaactgaggagcaacttggaatacgcttacggaggaaagaggagcaaacgccgagacaactcaaagagaaaagtggcagggaaaggccgttgccttttctgaggcaaagcctggcctttataagggtgaaaataatgaaacttattttagtgacagtcaaaaaactgaggaaatactaaatacag

SEQ ID NO: 43323 - DNA, 773 bp, Heterodera glycines
cacaagaaacaagaagagatgatgaaaatgccaagaacgttgtgcaatacggaaatgccacaagaaacaagaaaagacgaggaaaagataagaacaagaagagataatgaaaatgccaagaatgttgtgccatagggaaatgccacaagaaacaagaagagatgatgaaaatgccaagaatgttgtgccatagggaaatgccacaagaaacaagaagagatgatgaaaatgccaagaatgttgtgccataaggaaatgccacaagaaataagaaaagacgaggaaaagataagaacaagaagagatgatgaaaatgccaagaatgttgtgccatagggaaatgccacaagaaacaagaagagatgatgaaaatgccaagaatgttgtgcaatacggaaatgtcaacaaacaagaagagatgatgtgataagaaatgttgtggcataaaaaatgccacaagaaaatagaagagacaatgaaaatgttaatgttgtgccttaagaaaatgccaataaacaagaagagctgatgaaaatgggttgagtgccagtgattgaaatgcaggagaattgagtcccagtgattggaatgatggtgggttgagtcccagtgattgaaatgctggtgggttgagtcccggcgattggagaaaaagccaagaaaaggatgcgaggccgcgaaggccgagccagtcgattttatcattcataatcctataatacaatcgtactacctagcgggggatgcgccgaaggcgctgaccccgctagttt

SEQ ID NO: 43324 - DNA, 1266 bp, Heterodera glycines
  misc_feature (5)..(6): n is a, c, g, or t
tctanngagtcatctttcaataaacattttttaatttgtttttatgtgattttattgggactattcagaaatgtttatcaaaatattcgggcgtattaaacttttagaggacgagagcaaaaatattaaacgacgaaaacatgctgatactatccaaagaactttttttgcaagaaagaaatcatcttttagcaagccttaacctgcttttggctttacacaagaaaaattttgctgaagcgctgaaagaacttggtattactgtaatcggttattgggatctgttgtacgagcgtgtttctgaactgtaatgaaaatggaagtaaaatagtcctgttttgagcatacacttcaaaatttcataggaatgtttggcgaatggtacactgatcaaagccgtgcaggttttggtacattctaacagttcagaggctatttggacagttttagtgtcccacccgccacaaaacaggaaagtaccgtagtaatacctcactcatattgttattttgctatttcattgtgctgtcatttttcttattcgacaagggataaataaataagtacttcaaatttaaaatttgttttgtttaaatatgtgcaattttagtgcaattttttctatttttagaaaggggttgggagcagcggctgttttttcaaaaaaaattttgtgacggttggtggcctgctgtgctgccaatagacgtcgcctggaatttttttattaatttggtaacagattttgtccaaaaatggccaaggcatagtcccccaaaattgggaaaatgacctagtcaaaatacggtacggtactttctccaagccgaaaaataaaaaaaggtgcaaaatcgtttaaaaaatgcaatttgtgttttttttgtatttttaattcttttccaaatgcaaatatattgaaaaaatttactttatctactcatgagtcataacactcaaatttttcgaaaatttggtggtagatttttggaaataaaaaaagtaagtcaaatagcagggatgctgatgtttcgtattttcgtgattttagagcatttcatgttcgtgttttgtatttttatattttgcaattttccttataaaacttgtcaaaaattggccaaaaatagcgaaatatgcattattctcaaaaccgctaaatatgtatttatatgcattgaaatttaagaaaattgaataattttaaagcaaaaaaatatttcagaggggagaaattttttagtaccattatttgctaataatcaggga

SEQ ID NO: 43325 - DNA, 939 bp, Heterodera glycines
tgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccacgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaccgatgcgcccagatt

SEQ ID NO: 43326 - DNA, 944 bp, Heterodera glycines
  misc_feature (38)..(38): n is a, c, g, or t
  misc_feature (53)..(53): n is a, c, g, or t
  misc_feature (854)..(854): n is a, c, g, or t
ttgaaaaaatcgatttttttgttttcggggcagtcccnccgagccgatgcgcncagatttatggggagaccgatcctttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgcaaggaatggatttaattaaattctctccttcggggatttnttttccattacgccgtgccgataacgttcaattgctctactcaatttttaaaagtttttgctgaaatatttgacgagctctgaagggcgg

SEQ ID NO: 43327 - DNA, 944 bp, Heterodera glycines
  misc_feature (58)..(58): n is a, c, g, or t
ggggtcaaattttaactttttttttttttttactttagactattcaaaaaagaaagtntaggcaattaaattttttcgatgctatgacattgggcaaaaactatcaaaatgggcgttagtcaaaaaaccatcaaattaaaaaaaaaatttttgctaaaactttgctcaacagcaaccaaatttttagttttttttttaaatattaatcttagcactaaatttcttttgttctccttcaaaatttttcaaatttttcgttaagttttaaaaatgttatgaccaaaaatcttcaaaaaatttttttttggtttatttggatgaagttatgaataatttctgtcaaaaagtttccatttgatggttttaatttaatttaatttttttttcgtacttttttccatattcttttagagtccgcctgctgagaataaggaacaggtcgaagaattgcagaaagccatcgaaaatactcgcgaatttcaagcgatgaaaaaggataagcaaattaaagagatcaaagaggataaggatgttcggcttgcttggtttggtccacaaatgtgggattttattacgaaaaaagaagaaggaacaacgagtgaagcagcagcacagaaaggagatttgtgatcggaagaagtctttggcatacggtagcgaagtgagagtgagtggatcagttggttggttggcggcatacggtaggacgagcatgacgtcattttgtctatttattctttaacccacaacacactttgtttggcctagcaaacattttttcttgatcctctttttgctgttcatcgtctgtccttggccttgatggaccacacagggatagtaacccgggatatgtgaggtacggtactccactccaagacctccctcacccaaatttatcaaaaaaaaatttgataaattttacaaaaatcaaaaaattatca

SEQ ID NO: 43328 - DNA, 885 bp, Heterodera glycines
acgatatttgaaacgcaaacaaaaaaaattcttgaccaaataatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttgctaccaacagttgccttctcttgtctggccctatcaaacaatcttacgatatttgaaacgcaaacaaaaaaaattcttgaccaaaaaatagctatctcttttttctcatttttttaccgcaaacttgctaccaacagttgccttctcttgtctggccctatcaaacatcttttttctcatttttttacggcaaaattggtaccaacagttgccttctcttgtctggccctatcgaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatct

SEQ ID NO: 43329 - DNA, 812 bp, Heterodera glycines
  misc_feature (65)..(65): n is a, c, g, or t
tgtctcgtcggcatttaaaaatgaacaaaatgagcacgaaatcaaaatcggactttattcactcnggtttttcaaaatgtctaggaaatttgggagtaatttaagctcaagtcaaaaaatatataaatggaaaaaataatgaaattaaataaaattaaatcgaaaaaacggaaaacaatttttatgatatgaaaaagaaagaattaattgaacgagtcgcataattcgttaaattggattttaaatttttgttattccatcattcatttttgttttgagggcgggggaatgaatgattgttatttttattttattttatttatttaaaataattaatcttgttaaagttagagtgaccgtgaccgggaatttttcgggaagaaagtacctggatttttgatcgggaccttgaccaaccgacacttttccgtttaaatttgatgacgctttgtatgaacctttcagcgcctcaattgcaaaaatttcaatcaattagaataaagtttaataaatattttattgttcactcctttttacaagttgaagcagcaaattagggtcagaaaatatttaataattaaaaataaataaataaatttttagataaaatattttaagtaaaaagtgaaaatattttaataaattttattttgttttatttttgctaatcggcggtcaaaagtttattttgtttgggcggcgaatcggccgaacaaaacttcatcaaatttgaaaggaaaagtcccggttagtctcggtcccgatcgaaatcccggccccggcttttcaggttccggcaaatactggtttta

SEQ ID NO: 43330 - DNA, 1001 bp, Heterodera glycines
tttttttgggttttcggggcagtccccctgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccgaatagctccctatagcctgtactttaatctgcagtggattttgctcccataatgtttgagtaccccaaccgacacttgaaaaatcgattttttgttttcgggcagtcccc

SEQ ID NO: 43331 - DNA, 1236 bp, Heterodera glycines
  misc_feature (1191)..(1191): n is a, c, g, or t
ttttatttttaagggctggggtggctacggctatggctatccctacgggttttatggcaaacggcaagccggttttggtccatccggaaatgctggcacttttggtgacggtggagaaggaaatgccaacggaggaggagaaggaagaggagggccatcgtcaccaaacaatttttgagagagaaaaacaattacaaaaaatggagatattcttgatttccaaaaacggatttttgattaatatgataaatcttggccaaactttatttttcttggaaaatacaaaacaattctaggtgaagttttaaaaagttcttcttaagtttatttgacttttgtacttttgatttatgttggcaaaaaaataaaattcaaattcaatcggatttcctatttatatgattattttataatgatttaaaatttctttatgcataaaaatgaacataaatttttaatatatttaaattatttcatttttatttctgaaaatgtgaaaaattttataaaataaaaaaggaactcattgagagtggggataagagacaatatgctgaccaatttaaagaaatatgcgagaaactttgcgcaagttcacgttcaatttatgattggagaacgaaatttggtttggtaagttgtaaaaattggggccataattttattaattaagttattaaaatgaataaaattgtgacaatttaattaaaaaggtcatgaaaatgtgtattattatgatcaggatcgccaaaaaatgcctagtaaatttgagaaattagaggaaatatttgtggcaaagataattcaaaattggaattgaaggtaaatttaattaaagtataatattcaaatctccagaaaattcttggtgatttatgatttttgggcatgaaaaccaccaaagccgttttaaaaaaatgataaaacaaaaaacgactaaacaataaataaaattaaaaatattattttttttttctctgaaattatcaaagatcttcttttttattatttcaagaattgagtacagtacgctcccaccgtttcttaccgaagaaaaataaaaatggaactgttgcacaaaaaggagaaaggtgcatttgcgaccaaatattttgaaaaatgtcttttttaaatttgatttgatttgtttggtctctaatttttggttcgttttttcaatttattctattntgtgcatacgggaattaattacattagtttttttaaaataatgac

SEQ ID NO: 43332 - DNA, 1019 bp, Heterodera glycines
gcgagtttggctctgaaaattttgaaaaaacgtctatctctttttctgctcaacactcaaatgaactccaaccacattttcggaataatagcgacgaccctaatttttatggattttctttctgggcgagtttggctctgaaaattttgaaaaaacgtctatctctttttctgctcaacgctcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaattccaaccacattttcggaataatagcgacgaccctaatttttctggattttctttctgggcgagtttggctctgaaaattttgaaaaaacgtctatctctttttctgctcaacactcacatgaactccaaccacattttcggaataatagcgacgaccctaatttttctggattttctttctgggcgagtttggctctgaaaattttgaaaaaacgtctatctctttttctgctcaacactcacatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagttggctctgaaaattttgaaaaaacgtctatctctttttctgctcacactcaaatgaactccaacacatttcggaatatagcgacgaccctatttttctggatttcttctgggcgagttggctctgaaaatttgaaaaa

SEQ ID NO: 43333 - DNA, 1003 bp, Heterodera glycines
ttcaccatggccttggtgaattgttccgcgaaatgcacagtctgaccaattgtccggagttcacaaatttcgccctccttcaccaaatgatcacttctgcaaccgcaaattggagacggaaatgttgtcactgcagaaccacaatgcccgatcattgaccaaataaaactgacgtctccgcccataaaccttttgaattcaaaaaatgggaaaaaaacaaattttaaaatttaccactttactcgtttgcccgccaatgtgccaattccgtcaatttgtgcccaaagtgtgcttccatagcgctccaagttttctcggctatccttcgcggggaaaacggcacagacgaaattgtttgatggagaatttgaccgagcagcctggctgaatgagatggtaatcttcgtacaactctggccatggtcgccgctcagcttcatgtagatttcgccgccaaaggtgatcagattgtctttggcagacaaaagacgcgcctccaaagctgccccaacatcagtgacacaaatccaacacccacattggtctcaattggtgcgtattgcaatggcccacagatacggcgtttgatgtcaagcacctaacaataatcaatggaatttttaaataatataaaaaatgctaaaatatgtttttacttttttgagtggcggaaacacatcaagtttggcattgatcagacgaatagtgccttttagtcgtctgtaagccttctgtgtaccgacaagcccgaggatcagaagagcatcctctgggtcaaccgaatcgttttgtcttgtttgttgttgctccttcttttttggcgtgtaatgggcaaatttgtgccgaacttcccgactgatcccttcgagggacgcccggctggcggaacgtgatctgtcgcggcttattacatccgcaatttgatctgccaatttgcgatgtgaggtgcgctgcaaatgatcgacattcatctttggtcgtcctgttggagttgctaaaatta

SEQ ID NO: 43334 - DNA, 676 bp, Heterodera glycines
aaacatcataacttttttttcagctggccaaattttataaatttggcatcgttcgaaagcccggcccctacatgtttagaagctgttgataagctatttctaagcgattgaaaacttttttaaaaaattgcaacatgaatactgcacaagggtcagaatttttgcatatttttacttataaattttttacatgtccgtatatctttgtgttttttggaaagccaatagagcttgttaagagctttcgaatgacaccaagtttattggatttggtcaataaagaaaaaagttatgatgttctaaacttgtctcagactaaactgtcccagtctgttttctataatttgaaatgagaaaccaaaagaaacttggcaatatttaaagacgatgcgaaattaaattaaaaaaacccgttaaataaaataataggaaagaaatgccgaaattgcgaaagatgcttaaagtaggcgaggaacgcgtgagaaaatggagaaatgtatttgcgaattatttaaaaataaaataaatatttcaaaatttttaagccgaacgtaattaagtgtggaagaaaacgtttggaattggaatttaccgaaaggaaaaaaacgaaatttttaattcggtgattttggagtaccaaattaaattattgttaattggtgtgtatttttgtgac

SEQ ID NO: 43335 - DNA, 949 bp, Heterodera glycines
agtttctcaagcagactcggcgccacacacaccgccaaagcgttggtgcccatttttgtgtgttcttcgttggcagccacgcgacgcaacaaacggaggacagagcgcaactgaaaaagaaacatcaaatgagtgcaataatgccgtccgtcttggcatttttcagtccttcccccccccccaattccatggcatctttcgagtgttttccgtcacctccccaatttccaaaagtcgccctccccccaattttccttcgttggcctccgtctcaccagcactgtgtgcgcgggagggagcattgtgagcagttttcggcaccggcaaatgcgctgttcgtcgcttagtccgtccccattcgcttccatccaaaggcggtaattgccggaaatgagcagctgacccgggatacagcgcaaatactccttcaacagcgaggcggtcacgtgaacattgaactgatggaagtcagggacttggccctgaaaaaagggggaggtgagaggggaggggggaaatgccaaagaatgacctggtccaactgctggcgaaggatgcgcaccgtttgctgtttgggcgatttgcggaaaattccctccgtctccgagccgtacaacagcaaatggtcgatcatcgtcagaacgggctgaacaagcaatgctttcctttctgtgccctttgaattattttctgcttcacctgcggtggcattgtgccacggagctgacggccgaacaaacgcttagtgcgcgagttgccaccggtggcgcagggagggggtgcggcatgggcggaggacgaatcggcacggcccaaaacacgcctaaaagggacaacggcattcgaatttcgaaaggagagagaggcaccaaatggaaaacaaaaaggaaaggcacccgggcagaccgaaatgaactgatggacaagactcatcgctgctgcgcttggc

SEQ ID NO: 43336 - DNA, 1003 bp, Heterodera glycines
gattttcaaaatctgagttcagattcgtgatcagcgcatttttttaagcctagaaaaaatacctgcaaaatttttaacatttttttttcgccgggacaccaattcttgaccattgccgggggtagtacacccaatttgatgaaatacaaaactaaacaaaaattggtaatgaattcaagcggtaacaaaagttggaccaccttctcctgtatcattatactaatcaaaatgaacgacctttatctcaaacccaattaaatttcgaattgccaatttcatcgcttttattgaccttcattttcggtaattccggaaagtaatcgcgcacaatcaacttctccaaattctgcacatattgctcctcgggtagcacttttcgtgcctctttcctcgtctccaatacttttgcgccgagttttactaatttctttttgcgtgacgactcgggaacgtccataagtgcgtccgctttgtcaaaactattaaaattgtcggcctctttggacatttttgccaataatcagtccgtcaacagaaataaatgaacaaataaatgcgttttgctgaaatttattaaaagaaaaatattatgcgtattggtcacttttaacagttcatagggtcagccggtttcgaaaaaattaaattttttaaacacggcgattcaattttgggctccaagtagagaccggaaatttcaaatttgcggatcccgctgcggggctggaactcaaaattttttgcgggacgggatcccgcgggattaatcctgcaaatcccgcatttaaaatttgcgggatcccgtgcgggattgcgggattttggaaaattcgaaaaaatttcaattaaattcaaaaaatttccaaaaatcaaaaaatgctgaaaaataaatttttaggggctggcgggatgcattaaaaggggctgatgggtcgactaagatttttcgattggatccgacagtaaaaagttgatcggaaatcaaattattaacggttcataa

SEQ ID NO: 43337 - DNA, 736 bp, Heterodera glycines
  misc_feature (24)..(24): n is a, c, g, or t
aattctctaacataaagtataacncatttgaaattaaatttatttaaattagtgttttggcacaatgagagcttgaccataatttcatcactcatttttggattttctactttcatgtgccgatcattttaattttctcaatttttttatttacagtgatcatttttctatttatttcgaattgtttcatccgtctcataatttcatcacggcaaacttcaattttcttacaaatttctgcataattttgttgccattcttttctcgaatattttcttctcttttgcttatattcattttttatttctataattttcgctattatttgtttatttctctctactgattgatcacattggtctcaattaatagtcaacaaaaaataatgcacccataaatcagaaatttattgaaaacgaaatcgtgtaataaaacaatatggcagcataaacatgaattgaaataatccccaattataatgtatggtatgttttaaggaatttcttcatttttaaaattacattaaaattaaaatttttaagcatattaaaataattccgaatgagttcttgattcaccaaattttatgtttaacttcattcgaacgctctacatttatgtgcaatgccttctttttcggctgatttgtattttgccatatatttttttttgtttttgaatttcctggattcttatggtacaaatagtaggaaaaacacttactttatatgcttct

SEQ ID NO: 43338 - DNA, 488 bp, Heterodera glycines
aaacaacattcacttcgctctatagaactttttttccgccttacagaatttcttcatatttttcatatcgatagagaaaaaaatactgcatctgtctatagtgaattcatttttgtctatggtcaaactcaaaagttataaattttataataaaaaaaactattcttttatttagattttatggctaagaaaagtgtaataaggaaactacaaagcaaaaaaggggcccaaaagcgttggactaaatgggagaataagcgaacggagcgacatgcagctgcgtttttcaagaactgctgttcttcatctacctccatataacaaacaataaatatatttcctgctggccacctttttcgtcctttctttacggacggtcaaaattaattatcgcggcgagaacggcggtgaaaggaaagggggggggggcaacggaggtcgaaggaaatggcaagcagcagagatgggttaagggggggggggggggg

SEQ ID NO: 43339 - DNA, 1450 bp, Heterodera glycines
  misc_feature (1434)..(1434): n is a, c, g, or t
gtggctaaattgtaatgacaataaacaccaaacatctgtttttttggcttcttaggtgattttttggtccattcccttcattgcttatcaattttttgaacacatttacattattaaaaaaaaatttttcttttggcttgttcattggctttatccgatggaatttttagaccctgatttacgcttttaaattaataaattaggaacaacaatttaaatcccatgaacacacctctaaaatcgtattttactttaaaagaataattttctaaaattctttttgttatatatttataaaattgcattatttattatttggcttataaaaatttaaataaatgaataaattacaaaattagtgcgagttttttccttgtcttcagagatgacatcatctcttattgaattttatgcccatattcataaaacaaatatattttgctatgcatttttaagccctcgtcactaattaattccttttttcgtcatgaattcattacctttttatttttatttatttaagattattaattgtcattttaatgctaccactcattacacaacatcaaaaacaaattccattgtcttcgatcagtcgcggcacaactgtacagtttggcaatggaaaaagtaatcaaagaaccggacaatgctcaaagtgaacattttatgaaacaataatattaatcaaattaaaaaaacattccgtatcattttttaaatgttaaaatttttcccttttccaaaagaatttttgccttttggctattttcagttttttatgcattttttccattttggtgccgttttcatctttttttaattttagtgccttttaggcgattttttgccaccaaatactattctagatgaggtcaaaaaaagacccaaggaagcggagtttatggaatgttcgacatttaacagtgggagaaaatgtccatattacggttttttaagcgaattgcttaccaccagcaactgctgctgttgtaagccatcgctgcagcgaagaagcggatgagcacgtgaaaaggccgatgaagtaacaaaatttataatttttgttggttttttcttgaattttacaataaaataattgattttttatttcacttgaattaatcattgaaaagtgtgcccatttgtcagtgcctttatggtgtggtcgcgcgggaagcgaaagcgaatggcggcggacaatccgaaaatgcacaattcgaccatctccaaacagttgggccacgagtggaagctgttggacgaagctgacaagcgtccgttcattgacgaggcgaagcgcctgcgacaactgcatatgtgaggaatttgcattttttatttatatatttttcaataatttaaaatttaatttggaaaattatcaatgacatgaatatgattggaattgctttcatccaaaatgtgggccanagaatttctttgtcta

SEQ ID NO: 43340 - DNA, 1629 bp, Heterodera glycines
tggtgttgtgttgttgttgtttgctctgctggcgcattttgtgatttattaaaagtattcatttttattttacaaaaaaaatttcttgtgataaaatggttttgcgtcatatttgcgtgcttttatattgcgaaaaggtacagtactgcgcgctacgtaaaagacaaagttacggtgctcttacgcacatataaaagtgcttgaatgtgcacaaaatctcactttcgcgcaatgcatttgcttatcgcattctcgcgcattttggactgttccactgatgaagtgggctcgcgaatttgtgctagtgttgcggatcgagaaaaattgttgaaggaatttgcacacagtaagctcatcactacatactccgaccgtaatggcttcacccacacgctcttctttgctggactcactgaagagggcgccgactctgtgcttgcttatggtaacctgaggcgcccctacaatgtttgcgttgcggcccattattactcgcggcaccgtattatgctaaagtacccgcaattcccatgtgtaattgagaagtgtttcggtcaaagggatgacggacccttgcacaaatattacccgcttgaactggtaaaagtcatcgatgacttctttccgcctgtgtacgttaattcgttgtctcaaaagcgtgacggcgcatcattgtcatcatcatcctcgtcatcattgctgcgaaatttgccatcaccttcttccgatggtgctgatgatgacgactatggtctctggtttggctcgatgcccacacaaaacagtgttgcggaaacaccacctcctccgtcttgtggttttgtgaaaggaataatatggattgaaaaaaagcaaatcaaaaatattctaagtcaagcagttaaacatgactaattgtgcatttttctacctaaaaacatcaactctgtaactcagatgatgatgaatctttttaatatttccaaaactgctacttctcttactaaattatgcatttttctacctaaaatttgcaacttctcacgcttcattattttaaattgtaatcttccatttgttaattatgcatttttaaaagtacaattccgtataaattacgcctttataaaaccaaaatcatgtacaatagcattcatccccacaacccccttagttacaatagggcgatagcgtttcgacagcttaacagaaataaccgtcccgtccttaatgttgggcctcaggaaattggggtactcaatcaaaattgaacaaatgtcatcatcatcatcatctcctcttcatcatcctcatttgaatggcacattgcgtagcgtaggacactcctcttgaatgtgtcaaagtggagaagctgacaggcatcggcgctcagtgttatgccccgtactttgagcaccgttttctcctccccgctttggcggtgccgcatccgcagggcgtactgcttgcacccaccggaaacaaattccacgagctcgtggtccggccattcatccgaaaggtcgcctaggtggggtcccgtctccagagggcacccgtccgcctcacgatgggcgaaacacacactgtccgtgtcggtgtagatgagcaccgagtttggtgcgcgcgcaaccgtctgcattagccgca

SEQ ID NO: 43341 - DNA, 1188 bp, Heterodera glycines
ttgtgataatattcttgaatcgcagtctttggaagtcctccgaaggtgtgcgaattgcgaacccaattaagtcattttccaccaaatgaggaacatcttttttttactgatttaaaattttacgatgaattcgagccatggcttgggttcatcaggtcacttgattttttgagccaatttttgtgtttaaagcgattggcggtgatttgcatccaaaagcatcgcttcccaatttgatcttacgaccatattcattagtgacaagggaatagagtactcaggccttttacagagaccaccaataaagtgattttctcgattcagcatcgttcccgagcactccttaataatggaacgcctccttaaagttcaagaaattttgaaaaaatgaaatcgggagaacatggaaatgggaaactcagacttaccatttattttaatatgaagtggatttggtaatcacttctttattgcttgcaattagaagcttctcgtcttcaaaagcttacgaatgctatccaaagagcaaaagatttaaccggcaaaaatagaatttttgagattaatttaatgcattttttctctcaaattttaatgaccatttgtcattggtttggatccgctttttactattgactagggctaatatttttaggctctaaaaactgccaaaataggtaggctttaggttctaaaaaactcctaaaataggcactaaaaaacctcatttttaggggtgtaaaatgacaaaatgtattcaaaaaagtaaaaaaattaggccaaatctgtattgaggtaaataatttttaaatcacaaattcaattttaaaaccaaaaattcttgccaagaaaataaataaaaaattttggagatgaatttttaaaattttttcatttcttacggggtgtatttttgaaaaaaattttaggtcgattctttggggtgtattttttgttgttattgcatttttgttaacaaattttgggcaaaacgccaaaataggcaaaaataggctctttcaaaattttttaggctttttaggctctaaaaataaaagcctagaaaataggaacttataactcgaaaagtagcttaacaacagcccaaaaaaacatgtttttcgtgcgtttcaggccacggggagctcaggaaaaaaataggcttttgcataaaaagtgcatccctaa

SEQ ID NO: 43342 - DNA, 1036 bp, Heterodera glycines
tccagtaattctgaatttaaaattttttattaattttcatagcttcactattttatttttttagcaaaattaattcataaatattttttcagaaactgctctgaaacgcaccaaatgttaatttaaagttaaataaggctctctgatgctttttctatcaaaagggagatgaataaaatttttaaaaatttttaattcctttttaaacaggccaaaaagtttaggcttatattttaaaaagtttcatcgaacctagcgcactaacatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaacaggccaaaaagtttaggcttaacttttttttcagaaactgatcagaagcgcaccaaactttgcagggatactgaaaggaagagtaataacctattttaaatattatctagtcagttcatttaaataatttttatccaaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggaatagcttccctatagcctgtactttaaattctgcgtggatttttgctccccataattgtttgagtaccctaaaacgacacttgaaaaaaatcgattttttttgtttcataaatattttttt

SEQ ID NO: 43343 - DNA, 1031 bp, Heterodera glycines
  misc_feature (799)..(799): n is a, c, g, or t
atattatcgtaataatataaaaaatgttattttctacaaaagtaactatgattttttgtttcttttatgaatatttttattaataaagcaaatttcatgatttttttctgtattttttgaatgattttttagtggtattccatgaccttaattcccaacaagaaattaacatttagagcagaaaattggaaagtattagaaaataagctttaagaatatttttaaaattatttaaacaaaatactatcttttttatccctttctaaattcatatttttttttgtcaagttagtaaaaaactttaatctaaatagcaaaattgaattctgaaaaaccgatttagtaaaattatataaagccgagaatgattgataaacaaaatttacatttacgcaattttatttgccaatgaaataattaatatattttaataaattttaaggctttaaatatcaaaaaacgttggtataaatatttaagaaattgattaaattatttaataaaaatatttttgtaaagtcacagagcaataaaattttaattataatatttttataaagaaataagttaatacatttgtttatatttattatgccatttattaagtttaattttagttataatttttattttttaaatttatgagttaattctcacttgaggattgttcggaatggcggatccttctcaccatcgtataatcgaggaaatacggtatttttaattaataatatacgcttcttttgcaaaaaattattactaatggatagtataatagtattttcataatattttatanttataggaggtgttaattttataaagaatttgttatttaccttatacaaattattacttattttaataataataaaaattttaattttgatgatatatttgtgttttataataaattaattttgttcctttattagaacagatcacaccccacaggtttcatgaaaatttattgctattttataattactatttcgttttgactattaaagctaaaaataatttaaaatttt

SEQ ID NO: 43344 - DNA, 1176 bp, Heterodera glycines
ttgcggaattgggcccgagataaaaatcatgcaaggcagaaggtgtagccaccaggccatttgtaattggacctatccaaaaatagagaaaacattacggaaggaaagaaagagatctaagaccttttttcgcgcaagtatttgaatgtttgtgggttctcaaaagcaatatgcatagggcagtattctcaactctctcctctcgtcccaaaaaacgagaggcgagagacgagaggcgagagtaccaaaaatggcgagagttggcgagaggcgagagacgagaggcgagagttgtcccacccctgatgtgtagcccaaaaaatgttttggctttaacttttcttggaagcaacaaaatttaagtaatttaacaaatgaaaaaaaacatatttttttaaattggacgaaaatttaggacttaattaattcgaaattttaacagatagaatttcggaattttttttatgaccttacgcttacagtgctaagaactgcaactgtccataggccaaaatttatctctcctctattccactaaaaagatttcctgaaagtgtagaagtgatttaaatatgggggaaaacctccaaaatttggcactttagaccgcttcggcactaattaatttctaatgagctaattacatcgaatatacataataaaaatctcttgaagcacgtagaaatattcaaataaatctttttattcgaagcgaaaatatttggaaacttaaagaattgggaggctcattaaatcacccataaaataaaatgctaccccccccccccccccacaaatacaaaaatagaataatggtattcatttgtcagtcctaattaatctctaatcacctcctcaatgttcctaaaatatttccataaagcatagaaatgtcaaaaatgttttgaaagtgaataaatcgcctaattgatactaattaatctttaatgagctaaataatctctcataaaaatactcgaaatgcaaagaaatgtttattttaaagccaaaatatggaggaaattatacagaatttggcccataaagcacccaataatcgatttaaagaaatcctataggaatttagaccttaaattgctcatttttgcggaaaatccataggaatttggttggtagtgttaaaccaccataatcaggcctaattagtttttctaa

SEQ ID NO: 43345 - DNA, 1136 bp, Heterodera glycines
  misc_feature (990)..(990): n is a, c, g, or t
taattcacaatttccgcaactcttgcggtaagggaaaaaaattttgaaggggctctgcgaaacgatttagcttcggggttacgagatagaaaattgtcctaaaaagagatagcatttttctgagaataaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctanaaagagatagccatttttctgagaattaattcacaatttccgcaactcttgcggtaatgggaaaaatttttgaagaggctctgcggaacggattagcatcggggttacgagatagaaaatgtcctaaaaagagatagcccattttt

SEQ ID NO: 43346 - DNA, 1011 bp, Heterodera glycines
aaaacaaaaaaaatcgattttttccaagggtccgttttggggtactcaaaccatttagggggagcaaaaatcccaacgccgaattaaagtacagggctataggggaagttattccggaaggattcggtctcccccataaatctgggcgcatcggctcggggggactgccccgaaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaat

SEQ ID NO: 43347 - DNA, 443 bp, Heterodera glycines
tactatagaattgggcccgctaaaaaaccacacaaaacgcattccactcaatctctaatgacctctaatcatcgtaaaaaatattctcgaggtgcggaaatgccaaaaaaccggtttttgaaccggtttaaaactcgaaaatttgagtgaaaaggggggctcctgaccctttaaaacggtcaaattcggacaaatttggtatcattcgaaagctcatgacgagcttagtctaaaaaaacaaggtataaatcgaaccgacgacatctgataatgataggtttttgaaccggttcaaaatcaatgaaaatttgggcaactacaaatttaaaaaaaaattgaattttgcttattgcgctaaaaaaccgccgcacactcgactacggcggccagtaggtggggagagactacgggctacggaagaagtccgcgcgtgatccgcaggc

SEQ ID NO: 43348 - DNA, 1258 bp, Heterodera glycines
aaaaatttttaaaatgagaattcatgcgagtttttctggaaataagcttaatagggcctagttaagctgtaaaaaaaatttgggggcgatttgaaagagaataaaaggacccaggttcgatgaagttttggtaagccaaaaaaaattccaaacatttaaaaaatctataaaaaatttaaaaatgagaattcatgcgagattttctggaaataagcttaatagggccttgttaagctgtaaaaaaaatttggggcgatttgaaagagaatagaaagaaccaggttcgatgaagttttggtaagccaaaaaaaaatccaaacatttaaaaatctattaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaaaaatccaaacatttaaaaatctataaaaaatttaaaaatgagaattcatgcgagattttctggaaataagcttaatagcgcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaaataaaatgagaattcatgcgagttttaaaaattaataaaaatttttaaattaagagttactggcgttagcatcatagcggtgcttttccttgtctttttgatgcccttgcaaaatctggtgcgcttctgatcagtttatataaaaaaagttaagcctacactttttggcatgtttaaaaagaggcaggttcgatgaagtttttggtaggcaaaaaaaaatccaaacatttaaaaaatctataaaaaatttaaaa

SEQ ID NO: 43349 - DNA, 959 bp, Heterodera glycines
  misc_feature (30)..(30): n is a, c, g, or t
  misc_feature (55)..(55): n is a, c, g, or t
aaatgcagctgatgccgtcggaaaagctcngatttttgggggaagtttttttctntcagtttcaccactgattgttgaggcaatttttttcgccaatttcttttgtctacaaacattatttattgcgtttcatcctgtagtgtgtaaaaaattttcaataaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggccgatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttacctaatatttatttatactgttgaactgttggaaatgcagctgatgccgtc

SEQ ID NO: 43350 - DNA, 962 bp, Heterodera glycines
  misc_feature (795)..(795): n is a, c, g, or t
  misc_feature (873)..(873): n is a, c, g, or t
  misc_feature (917)..(917): n is a, c, g, or t
atgtcctaaatatggtaattaaggaagtgagatatagcaaaagaagcttccccgaaaggaagattaatggaccaatttaggcaataattgattctatatggtcgagcaaattggggagctcgttcatatattcaggggaaataattatattttgaattttagaggcccgggaagtgtgcgaagaatccatggaattggccaagaaagtgggcaacaagccggtgttcgcgagagccttggccagcttggcggacatttgcagtgagctgggcgagacggaggcgcgcgaaacagtcacagtgagtgccgaaacgaacaaattggcatggcggactgttcatttttccgccttgggtttccttttccagaaaagctgggcccgctatgaacaagcttttcgtctgctgcgcaagctcaacgaccgaatgggccaagtgacggtgttggcacaggtgcagtggcagagcgaatgattagcagagtttaggcagagagcaagaaaaactttcggtgcaattgagggaccattttaaatggggctgatgccggccaccctaactgttatttgcacaggggaagctgatcattaaagtgatcagcatcacctttgcagatcgaattgaaaaatctaagcaaaagtgccaaaaaccatttagtgccaaaactctccgtttgaattcaatttactcgcagatggccaaatcggccgccgaaaataaaggcgtccattacggcgggtcgggtgcgagtgccaggcaatccaactgaacaaaaaatggtctggagatggccacntctgatcggggccaagggtggggatttggccttccgcatttggatttaaaaatcggatttgtccactttcagcatccngatcatggagtgccatcaacggcttcaagaacttacatgtgagncggattgtgtggatggaaatcccaaaaatgccattaaatattgat

SEQ ID NO: 43351 - DNA, 697 bp, Heterodera glycines
  misc_feature (88)..(88): n is a, c, g, or t
  misc_feature (95)..(95): n is a, c, g, or t
tcgtcgtagtcgagaatccgtcgacccaattgtcctcttgatacacgatttgacgaggcctattaattgctcgtacaaagaccccatnccatggncgtaggcgggaatgaagtcccactgaatgcctcggcgcgcggcaaaggtgacgacgtcggtttcggacggggggcaggtcagaatgtcgagggctttgctggtttggacgaaggtagggcattatcactcaggattcgccgtggtcggccacgacggctaaagaattgtcgtaagatattaatgaagcttggggccgacaagtcggtggtcgcctcgaggtacacggcgcgggtgacgaagcaagtgatgatgaccaaatacgccttggtcagtgatccgtcgcttagccgagagggggtgggcccggcaaaatcgagaccgacaaactcaaagggattggccggtttgaagcgcattgagggcagagggggcatagtgggccttgcaaagggaggtgccgtcattctccggcaggatggacagccccgaagaatgccgcgaattgttcgtcgtgcttgaggcatccaataacggctaaggaactcagtcagagtccagtcaacgccggcgtgtctgaggtcggcgtggatttcttggacaattagccgagtcagaaatgagtggcggtcgaggaggacgggcgaggcaagagtgggcagac

SEQ ID NO: 43352 - DNA, 1127 bp, Heterodera glycines
taaaaaaatttacgaattaggaaaaacgaaattcaatttaataaaagttttaacgaaatgcaattcaaaatcgtaaaaattttgagtttttttttccaatttcgtaaaattttcccatttttaccagtgcttatcgattatggcaaaaaatttacgaaattccccccccccttgaccccccctgtccacctatgatgaaaactaaagaatttaaatattttattttttatttttaaatttaatttcttttcagaatatcacttcgcagttgcccgattctgtgccgtatgatgcggtggacattaccgagctggtcaccatttgcatccctttctttctgtacgccgtaacagtgctgaaaatggtcattgaatttagcaatcagcccacgtcgagcccaagtaaaaattcacggcttttaaaaatcaaaaaacaaatgcttttgcaaaaactctccattatgttttaacatttttgaaaacaaaatcgatttttctttacacgtacacaccgtattttctctaattatatgcctgcgtaaattatttttgaacttcctcagaaagggggagttaattggagacgggtaaattacgggcatataattagaaaaatacggtagttcgtttgggtgtggttgtagtcatgtgccgtgatttcttgtgggatcagccaatttttttttgtcgattactttagtcaggactatcatcataaaagggttgcggtaaaattctaagagaaatacgcaactaagcttaaaaaccgtaaattaagaatcgtgcttaattatctccctcattcagtgcaagttgccattgtccttccggtcggctcccaaggcaacaaggaggagcgtgccaagtttgttaatttgatgcaggagcgcactcggctgttctccatgtgtctgctgagccaagtgccctactatttatcccatgccatttaccaatcgttgcgtttctttaaaatcaaccaagacacacttcaggtggtacagtatacgctgaggaataggaaaccggaaaactgtaggagcaactcagtcccggccaaatttattgcttcaaaacttttcataattaaccaaaaaatttcatagtcgaatcactaaacaagcttta

SEQ ID NO: 43353 - DNA, 818 bp, Heterodera glycines
gtgggtaagctcccctctcgattatcgtcataaagtaccgccaattaattcaattttccctatttcctgaatcaaatagcatcaggaaaaagcggcggaaattccgctgactttccattgaatttgtggaaaattaacggatgagtaattaattcagtgatggcgaattaatggtcggcatttgacgagaattggacactttcccacggatgaaaacgaataaaaaatggagaaatggaaaaagaacaaaatgaattggcttttttaaattctaatggaaattgggaaaggcattattacactctcacattttggacgaattgattttacaatggacggacaaaaatgggaggagaagttggggaaaagggagaagagacaaaagggggggaggggggggcggaggtcggaattccccggaggacacacaaaaaaagagaggatttggcggaaagggggaactgggaaaaacgagatactaatggaaaatgcatgaacgaactttgaaacaatagaagaaggagatagaaacgaacggcggatcaatcaaaaaacaaatggggaggggtcgaaaattccattgggagaaagggaagacaaaaagtgccattgggagaaagggaagacaaaaagtgccattgggagaaagggaagacaaaaagtgccattgggagaaagggaagacaaaaagtgccattgggagaaagggaagacaaaaagtgccattgggagaaagggaagacaaaaagtgccattgggagaaagggaagacaaaaagtgccattgcgagaaagggaagacaaaaagtgccattggga

SEQ ID NO: 43354 - DNA, 631 bp, Heterodera glycines
ttgcactttatgagtccttttttttttgtacgtccgttcagagtgtataagtccaagctatttccaatgaattaaatcaaattttgaatccaattacatttttgaattcccatggaatcgacggaatcagctaagtgggtgcagagttagttccgtgcaaatgtcgtaaatcatttttaagtgccctctattccagggctcggatctgtcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttattttttaaataaaaatctgttaacaaatcgattaaaaatcgcaaaaatattttccggcggcgcctatcggcaccgccggaccccctgtccatcctccagacgcaaaaaaagcgattttaaagcaaaaaagtcgtcgcttgacttttaatttaattgcaaaattggtgttttttggtgaaaatctgttaacaaatcataacgaaattacaaaaaattttcc

SEQ ID NO: 43355 - DNA, 982 bp, Heterodera glycines
  misc_feature (881)..(881): n is a, c, g, or t
ccgtgcgcgtacaacaaatgccagaacggattttcactgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttttccactggcattgttacccatctttggttccaacaaaagattaatttcaatattctccgtgagcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgtacccatctttggttccaacaaaagattaatttcaatgttctccgtgcgcgtacaacaaatgccagaacggattttcagtgctcgtggcttggacatttcgttggtcagcgaaagaatttccttacgggttttttaaaattatgaaaaattttagtatttaaatttaaaaaaaacctcgaaaaaactaaaaacctaaaacaggctttaatttaattgaatttattgtaaatttatttcgaatgcaagttgtcactctttcttctgcctngtcattttttaacataatagtgtgtattcatttaggaattattttttgtttgttttttttcatttccatttccaattgttcaaagtaaacactgcaaatat

SEQ ID NO: 43356 - DNA, 711 bp, Heterodera glycines
  misc_feature (28)..(29): n is a, c, g, or t
gatgatgaaagaaagaggtgtcgatgcnnaacgcaaacattttacgaagggaatcgcttttagcaattattgggtcataaacattgaaattcacacaaaaaaaaagagtaaattcatttaaaaatatacatatataattaaaaatatataaaacatctttatatataaaggcaaaggtgtaatagaatcgcgacatcgatggagaaaaataataaaatttcaaaacctttttttctggggtaaaaaagtgcgctaatcattgattttgaaaaatcattgattttgtccataacttttcataaagtaattgatttttacatactgcgatttatttttataatttgatgaaaaatcctagacaaaataaggctcttgcaagaattgggaaaaaaattaacggaaaaataaaaattttgaaaaaaaatcaagtacttgatggtcatagacaaatcaatgatttttcaaaaatagaattctgattcgtaatcaacactttttttacatcagaaaaattgttttgaaattttactattttttccatcgaacaattttaaaaatgtatttttgtgtttattggtcctggtggtggcaaggcaatttgacaatgttttgcactctcacacaaaaaaaacgacgctgtgacgaacacaaaaagcgtagcggaaaagaaagagagaattcaatggggaagtgagtgagcgagtgagtgag

SEQ ID NO: 43357 - DNA, 1023 bp, Heterodera glycines
  misc_feature (1002)..(1002): n is a, c, g, or t
tctttttaatttttataaatgatctgccgtcctttattgctaatgaagcatcatcagttggcataaaaatgtatgccgatgatgttaaattatattatgcccatgaaaatgatgataaaacaaatcatttagataaagcaaatgaagctttggaaaaatggtcaaaaataaatgggttagaaatttcaaatgggaaatgtgtttttctttatttagggaaaaataatatgaaaaaagattatttaattaactcaaaaaagatttcagaatcggataatgttcgtgacctaggcattataattgactcgaaactgcatttttcagaacatattaacaaaattgtacgaaacgcttatcttagagttttccagattttaagagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacaaaaaatataaggaaagactaaaaatcactgatttacacaaattagaagaaagaagaaaaatcaatgatttaacaacagcttttaaaattataaaagggttcaccagcctcgatgctgaaaaaagtttctttttctcggaaaggcccaggaggcctttacttttgcgagtaaagcgccacacggccaaaactcaaaataattttttcaatagaatagtaaaaagctggaataaccttccagtggtagcggtgcaaattaataaggcaaaggaattcaggggtttactaaaagcaatgagttctgagtaggattttccatgttgccatatttacactatatttttatcacctgtgaatttttaacatttgattgatttatttttattcatttttttttattacgatattcattttgtattttttatttgaccaacttttatttggntgttttcttttttggcaccat

SEQ ID NO: 43358 - DNA, 754 bp, Heterodera glycines
acggtggggtcgattgggcgccgaccagttgggcgccagcctgctttttgaggaacaactcctttcatagttgactgaactgaatgaatttaatatcattcaatagacctagctattctctattagcctgctaaattttcaaaaaatttggttatttttcaaaaaacttatgtacaaaaatattcggaaaaccgaatttgaagttttttgtccataatatttttgaaacttaaccaaatttttcgaaattttctaggctaatacagaactcttaggtctattgaatgatattaaagtcattcagtatcagccgatgatgaaaagatgggcggatcgagggagggtgaatctcattaggacaatgaccaatcgaataccttcgccttctattggacaattccaacttaataaacatatataaagatatactaccgtaccccgtcctgccacaccgcctccgctagaccttattcacaagtgacaggagtcggatggatgggaagccgcggatgccgaaccgattggcaatcgaagtgtgaacagtggcatcgagggcaccaagctgaaaaattataagacaactttttaaattttaccccttttttttttgcttttaaacccaaattttttgctcgaataaaacaatatatttgaatgtcggaaaagaaaaaatgccagctttgttgagcagatttgtcgtccagaagtgaacaattttttgcattttttcattactgaagggattttgctcagc

SEQ ID NO: 43359 - DNA, 1340 bp, Heterodera glycines
  misc_feature (21)..(21): n is a, c, g, or t
  misc_feature (96)..(96): n is a, c, g, or t
  misc_feature (130)..(130): n is a, c, g, or t
aagaaaccgtgaaggaccaantgtcattcaatgcaaaacgaagggcgcgcacaagcggagagtgggcaatgagggcggagagacaaatgcaaatgnagcagcagcaggtggttgggcgtaattagttttnaaaacaaagccccctagactcaattagcgggtaatgattccaattagactaagtcggaacgggggtgttaatgatgtcggttttttgaagtgagattcaacacaaaccccttttcagtatcagcgattaaactgattattttaattgttttagctttgaaacaatattattatttttcttttttaccgtttagaaaaggtcccatttttccaaaattacggtcccgattaattctaattattaataatagcatttttaagggaggaaaagcggttgaaaatgaatcgtcacaatcagcaggaaaagaaaagatcactctgggaaagtaagtaatcctttcaaatttagcgttcaattcgattaacctttggtcggatttgaggctatttgaatgtgcggataaagcggatgaagcagatgaagcggatgaagttaatcgggcacttgaggaggtggaactcgactggcgggagaaggtggacgaaaagagacgccggaaaatggaaaaggacttccgcaggatggagaaggagcgtgcggagcagcagcggaaagcgggcgatgtgcagcctgaacagctgagcggggcggagaagcgcaagctgtacgggccacagtttgacgcggccaaattcagggctgacgtggaggcggaaaagccgtgcgacggggagccgctccaagttgcggagtattaccttttcagggtaagaaaggatactgtagggatcaaatgaatcatttcaagtctttttttatgcttcggttttggcaccggatgcttgtgtttgaccacttgaataaatgatcataatgactagagaacgtaaaaaaaggcaccaaaaatcgcgaaaaggcactgtaataggtacaaaaaaattgaaaaaggcatgaaaatcccgagaaaggcatgaaaaaaggcattaaattttttttttaattaaagatctttagggagcaaaatatgtaaaacttaacaaaaaaatgaattttggtcatttaatactaaatattttaaataattttttcgaataagtttttaaacctaaaatttttaccaacaaaaaattgaaattttggcgatctatttttgagaactttcagttcaaaaaaaaaggcataatacatgaaagtcaacgtagaagcctcaaagcgtttttatgcttaatatatcggaacttatgcgcagaaaaaaggcatatgcctcaaa

SEQ ID NO: 43360 - DNA, 964 bp, Heterodera glycines
tttttttccccaaaaaaattttttaaaccccattttttcccgcgggaaatgttttttttattaattttcgacccggttgaagaagattagactagaaaaaatgaaaattttgaaatcatttttccactcccttctctcaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactccctttcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaacattgaaaattttgaaatcatgtttcccactcccttctcccaggggtattattttgtaaagtctttttt

SEQ ID NO: 43361 - DNA, 1028 bp, Heterodera glycines
gttcctagttttttggaaaattgcgccgcaaaaaaagcggttttgaaaagcaaaaaaatagtcaatttatggaccgttaataatttgattcccgatcaaatttttacagtccgatccatttgaaaagtcttagtcaactcatcagccccttttaatgcatcccgccagcccctaaaaatttatttttcaaaatttcgtgtttttttttgatttttagaaatttttttgaaatttaattaaatttttttcgaatttttcaaaatcccgcaatcccgcgcgggatctcgcaaattttaaatgcgggatttgcgggattaatcccgcgggatcccgtcccgcaaagaattttgagttccagtcccgcagcgggatccgcaaatttgaaatttccggtctctagtaaataatacaaaaaaaagaactaaattaatataaattatgaaatattaatgaatacaaatttcagttggttatgctgatgaatggatttgagacgggtaaattttattttttttattaattgggcataattcccttaattgaggcttattgtccattaacggcgcagttttctgcacttatcctgacttgatttacacatccggatcagttggtttatgtaagaattttttgtgaaattttggtttttttaattaaattcttttttagccctttggtacgcaggtatttaaaaatttaaataataatttctatcccggtggagcttcttgctccaaaattaaaaattttattttaatttttataaaatatataaacttttggcgaaaatccgtatttttctttcattttaggttttttaattcaacaaatcacacaaaaaatgcaaattgaaaactaaaaatattttgttcaaatgtgtgtcccagagaattcccaatttttatgcatttttgacgacttttgattaaaaaaaaattattagaataatttagtggtccttataatgaattatttataattatttttaatatttttcaaagcttaactttccgtttcaaaacaaaaat

SEQ ID NO: 43362 - DNA, 603 bp, Heterodera glycines
acaactcgactgcccgccgtccttgtcgaacaaaatgccgcaatcattgtgaaaagtgccaaataaattcaaatggctaaaaaacggcgaaacaattattaatttcatattcaaatccaaaaaatgattaataccggatttttcagggttttgtccgcgatccgtttttttggaaattgcgggattaatcaagcgcggtagggcggggggggggacaactgcgtctgagacaaatttaacaagccagaacttatttctttgttggtcaaatcaaggaaacttggtatcattcgaaagctcattatgttcaaagatatttgtaagcattttaaagcgaatttggttagctgatagagcttattaaaagcttttgaacgatatgaagtttgtttgatttaccaacaaagataaaaagttgtggctgttatagctagccggcttcgatccggcgggatcccagcagcgaacccacaaccagacatttgaaatgtacaaatttcaagaaaaacaattcgccaaataagtattttttcaaatttagggaaatttcacggtttaccctcagttgggcgcgcacggttgggcgctcacgtttgggcgcgc

SEQ ID NO: 43363 - DNA, 1285 bp, Heterodera glycines
tgctttttatgcctggacgcccttaagaaaaattatggcggtctttcaagccttttaggtcggaccccatttgggtacttttgggggttgcgcgagcgatgccgtcgatgcgtttgatttcaaaattcattgtcgtcgtcgcgctttttcttcagctcttgtggtgtgtcgaaatccaattccttcttccgctttcgctcatatctatctgatggcattgttttgctgaaaatttcccagtcaaatttcctaaattgaaattaattaattgatactttgtgaccaagtaataagcctcaaaatttaattatattcatttgtcagtggtaaatagagaccggcgcgggacgggatcccgcgcgggattttgcgggatcccagtccgcaatcccgcattttttggaaaatgcgggatttgcgggattagtcccgcgggatcccgtcccgcaaaagaaattttgagttccaatcccgcagcgggatccgcaaatttgattttttgtgcgggattatgcgggattttattgatttttttgaaaatttttctaagacagaatgccaaatatttttaaataaattaaataataaatttaattaaagttaactcatttttcatcgcaaatttcattcaaaatttgtgaaattttcccggcggcgcctatcggcaccgccggataggcttttacttaataatcctgtagaaattgagtcaaaaactgcgtcatttggtcaattttagacaaaatctgttaacaatagcattaaatttcataaaatttctcgcagatgtcgataggcaccaggtatggcacggaaagacttccggtttccgacatttttggggtcggaattccgacttccgaaatttttgatgaaaagtcggaaattttttaaatttttttttcaaaaaactagtaagtttgtacaatttctattaataaattgaactgaaatttttaaaaatttcccggcggcgcctatcggcaccatcgaacccctccccaaagttcactaaattttctttggataaagcgcaccgcaaaaaaagggtgtaactgtcccaaaaaaaaaaatccaaaataatataaaattacattaaattattttgaaaagcattaaaaaaattttcaaataaatatagaaatatactaaaaacagtttgaaatcaccttttacatggtttagaattttaaatttgcctattaaatatttaaaatttttttattatattgtatattttttgaaaattttccgatttccgatgtttttggggttggaaatccga

SEQ ID NO: 43364 - DNA, 567 bp, Heterodera glycines
cagtgatcacccatttggacggtgtccctctaaatcccttcgggcccaaagatcagttcttccatcgcttggattctgttctcgttggccactcattcaacgtcactctccactcggccgacttctgttcgcgattggcacgtcaaatgaaaaaccaattaggcaacaaatggcgtcactttgtccacggagaatgaccgaagaaaaactagaagagatggagaataatttttaatttactgttcaaagtctcttcattcatgtacaaaaccaaaatttccattctttttcaaattgccttaatctcctttgaaatatgtctttttctttgctttttacgtcgttaaggtcctataacaaaattgattctcactcagattgtatttgccaaaaacttaaacaaataaaaggtaaatgctttttccattttgaattcttcatcgttttgttttgtccgattttttctcgaccaaatattccatgactctaaatttcgtatcactctccgagtaaaccttgaccggtaaatatggaatcataggccccatactcacaaaaggtcaaaaa

SEQ ID NO: 43365 - DNA, 904 bp, Heterodera glycines
aaacagtttaaagggtcagtaccatccctactgcaccattttaaatgccgcggtcccgtcccacaaatttcacattctttaatttctccctcacaattcgaacaagtaaatcgtgcgctaataaaattcggcttatgaatggtttcttttttcaatgaattttcatccaacattgtatttgtctaaattaaaatatatttattgcccaaatttttaaaattaccgtgcattccaagtcgtatgccactattctataggcggtcatttttttaattttcaatttttgcataaaacataattttttagggtcatgaaacaagcggcattttctacaatgtttttggtctaaaaaaaattatttaagacattttaatgtttataaaacctaccgcaaatatgttctgtatctgtcctaaattctccttgacattttgtacatttttggtatagtatgcatattttctttttatggtactcaaaacaattctcattaaaaaaggttctattacatttatcacagttaaatgttcttctctccgggggacaaggaaacccaaatccttaattaagtattataataaaatttacgctaataaattacctattctacaacattttttacacctttcctcgcattccaagctatgtttttcttctctttgatatgttttttcacagctaatacaatatttatttttaatagggaaaaactgtccaatacttttaattcctaaaaaatttgtttttaccagaaaaataacaaactgaccatcccaatgatttttttcgtgataaatgcaaacattatattttcgaggaccatttcctttaaaaatcggacacaacccgacactttttgaaaatgcaacaattcggaatttccccggattttttgaatcctaaa

SEQ ID NO: 43366 - DNA, 783 bp, Heterodera glycines
cccacgttttggcgccgacgatttggcgcccacgttttggcgccagagtcgttttggcgcccacgttttggcgcgaagccaaaaattaaaaaaggtaaaaatttgatcaaaaattttacaaaaaaagtgaaaaacttttaccttccaatgggtttttcaaattttcaaaaaattcacaaccccctagaattttttttcaaacttcccgattttgactgtgttttatgggtgtagattagagatcaacatgtacctggatccagccctgtatttttcctggatccaagtacaggcacaggccatttttcggcaacctggatttttcctgtacatttattttcctgtacttatgtacagaaaaaaataggtacaggccattttttgaaacaggtacaactacggttttttcaaaatgttgatctctagtgtagatcaacatgaaggagtgctatgatcaacttgctatgaacattttgttggtcaacatgaaaaattgacttagcaagaattttttcaaatttttctcttcgctatgcttcaaaaaatgtcaaaacattttgaatatttttaaactcttaaattttttcggttgaaatttcaagagttagtgattataaacataaccttaacggtatattcaaacatagaaaaaatttaaaaacctgaccctggcgccaaaacgtgggcgccaaaacgaccccgactcagccaatattagtcaaaaaattgcttgaaaaatcgagagcatttgttaaaaaggcagtgccgcgaagagacgatgtg

SEQ ID NO: 43367 - DNA, 1052 bp, Heterodera glycines
  misc_feature (20)..(20): n is a, c, g, or t
  misc_feature (44)..(44): n is a, c, g, or t
  misc_feature (70)..(70): n is a, c, g, or t
  misc_feature (82)..(82): n is a, c, g, or t
gctttttcactattttatgnaaaaatccggggaccatttttatnttaatgccctacaaaatgccaatttnagtgaaaatgtntcatctggatacttgcattgtgtgcagtttttgctttaccatcatatgcaaaagctggtgtggcgtcttgagaacaaatggggcattatttctgatcaaaataatgacaaaaatttggaagcaaaaaataatttattgcaaatttacacggagaaaaaaatgatcgcatgggaacaaatggtgaaaatctatgggaaagagttgaaggatctgacagaggtgaacgaactgattcggaggaaattcgaattttgtctgatcattgagggcgaaacgcgtgagttttttttttttgatgagatttgtcacaaggaatagttttgtcttatgtgccatttatttttcggggtccggacaatccgtcagtggtcaatccgtcagtggacaatccgtcagtgaaggacaatccgtcagtaatggacaatccgtcagtaatggacaatcagtcagtaatggacaatccgtcagtggataattcatcagcaatttttttgagcaataacaaaaatctcgcgaaaatgattgttaaaattaataaaataattttttttatagattcttaacatttctagttctttatacttcaattaatctttattttttaaaaaatgattatttcataattttataaaagaatacaaattattaatcaacatttttagcgacttaaattaattttcagatgtttttaaataaatctggggtgtttaaaaaaattgcttatgaattagttactggactggattgtccactgacggattgtccacttactgatccaatccctgtcgcaattacactgctgcaacgggtaaaaaaaaattaatttaattgcaatttaaatgggttaaatgttacttaattattataaattaattttttccctaatttagcaatgtgttcatccttttctgagatatggagattgctctacggacgaattcaaatgctccaatgggcaatgcatcaatgc

SEQ ID NO: 43368 - DNA, 1349 bp, Heterodera glycines
  misc_feature (151)..(151): n is a, c, g, or t
  misc_feature (189)..(189): n is a, c, g, or t
ccagggccccattttcctatgttcgtgcgacctttttattgccaagtgtcgctcatttctttttgtcttttaaaatatagttttactgaatctctttttttcccttttcctctttttttccccttttcctctccttttccccccccccccncctcagatttcttaagtttgacgtcatgatcccccccncctttgcgcaggtatgcgtggtgctgccacattttctcgtggtgatgttgttggaattggcattgacttcaaatttgatcgtttcgctctttctgctgaggaataataatgatcaattgctaccatttcgataaactcatgactttttttttaccattttgttgccgttatttttatttttttcatttaacaattaaatctgatctcatttcttgttaatatccgctaatttagattgacaaaaaaaaaataaaattaaaaggaaatgattgaaaaaatgctaaagcaagaaaaaattctaaattaattcaaacatatcattttcgaatatttgctttttttgctacttttccattgcattttttattacaaaatcaaaacaaaaaattataaagcccccataaaaatacgcatttcaaaaatatatcagcaggtgatattgagggacttagctgatctgaactgatcattccgtgcctgtgctgctgcttcttctgctgttttgtgctccactccctcctccgatggcattattcgttgattatcgtccgttcctccccctattttcgtcactttctttttccgatggcattggcattattctttgattgtcgtcatcgtcgtcaatcattcccccattttggtcactttcttcgtcctccgttttgctgtgcccaccgtctctctccaggatggctatacggtatcgtttcagcacattcatatggtacttcttcaaatgacttcctcagcgcgttggtcggtttccccggcgaattggtccatcgccggtaggcacaatgccgacattcgatcacatccgggccgaacagataaaactgtgcgtagtcaattctctgaacatcccaaactttattacggtattggaaataagtgccaattttgctaaaaatagccacaattattttaaatcagtattttgactttataatttaattttttttttctttcgattttggccctctctgcataaattttgccaaaaaataaaataaaatatatacccgtgttttgtgcgcatatgatctcaccagagtggccatccgtcgttcgttttttgtccctgttttgcattcttggcagcccgacagaaaagtgataatgctttcgaccgtaatgttggcatactgtaaggaaaa

SEQ ID NO: 43369 - DNA, 1029 bp, Heterodera glycines
aaaaatctctaaaatttggtaattctttagacaaaatctgtgtaatttatgctaaaaggaattgaattgaggcgatacatcgactaaaggaatgtggagccaacacatcattcataaaaattaatttttttgtgagatttttttgagttaattcaaatcaaacccccgcccccgtccccgcgggggcgaaaaaggattaattgtttgaaattactgaagtaaatccgtttgaaaattttcattaatttaatttagctttaacttttagaatcaagcggtgcagagatacgccgccgcaatttttttgtttgttggctaatattttaagatttttgtcgaaaaaataaacctattttgcgtcaaactttaaaattttttagtaaaataatgatatttcgccataaaattttgaatttatttgaacctgggtaaaagtgtcaaattttaaaatttttagtaaaatatttatatttcgagcataaaatttcaaattctatttgaacgtgagtcaatttgtttatgctaaaattacgaaaaaaactaatataaggtaaataaaacggaaaatcaaaaaaataaaagtcaacaaattctttctccaaagtttcatcattaataagagcctgtggctgctgataattgggcaaacacgaaaatgaatcccaaaaacgcaatgatagcgatggcagccacggctgaacgcttttgacgtcggctccccattttcagtcctgaagaaagttgacaaatgggaaaaaattgtacgaaaattcttagacattcatcgcttttatggacggggaaaaagttacggtacaaagttacggtattccttcccattggattaccatttgcatttattacaaacagtgttttacctgctgcacctccttccaatgcatttccatccatggcaaacgttttgaacactcgcaaaatcgtctccgttctcttcatcctggccttttcacctccggcattgcgcttgaacagttctaccagcgattgtgctgcacttttcaccaggga

SEQ ID NO: 43370 - DNA, 494 bp, Heterodera glycines
cgaaatttttgaattttatctttataacttttagatgcttgaaaccctttttcctttttgtaagaataatagagcatgaaaagggctttcgaacgaaccaatatgtttgatttctttgaaactaaaaaaagttatagcttaaaaactggggctggctccgaaacgaccctttccttacaaattattagagtagagcggaccgggacgggaattcccgaccctcggagggtccgggttttgaaaatcgatttcccgatcccgctgggcaaacgggaaccgggaaaaacaagcacaggtaagaatatgggtctgacaaaggagggggggggggccaagtgaatgtggagtttcgggatgaaactttgtgggtgggtagtttgatcccggtttgtaatgtgaattttttaccgtttttgctgaatggacctgtgcgccgatttacgcttccttttataatttgcaaagaaaggagaagcagtgtgagcagcgacggc

SEQ ID NO: 43371 - DNA, 1156 bp, Heterodera glycines
  misc_feature (54)..(54): n is a, c, g, or t
  misc_feature (145)..(145): n is a, c, g, or t
  misc_feature (1125)..(1125): n is a, c, g, or t
ctttaaaattcacttgaaaatagagtccgcaaatttgaattatgagcttaaacntaattgagttattatattttattaccaaggttaattataattttttttctcaaaattaatgataacaattaaaaccaacaaaattcgaatntaatcgtagaatttttattcagcttttccccttaatttcatataatttttttactcattttttgtgtaatttcttttggcagaacattgaggaattggctatcgaggtgaaaaaaagcaaagacaaaattcgcaaatttttggacgaaaaattgcccaaaggagctacgctgatcgacgaaaagcaatatggggaaattaagaaaatgcgcaaggaattggcagacgcaattgacaaagtggcggaggaggagggaaaggacggaaacaccaaatcatcaaccgtaaatttaccatttccaaaaaacagtggcatttattggacaataaatgctcataatttttactaaaaggcaattccaaatttaaattttattcatcatttcatgtaatatttagtcggggaatttcaaagaatttcattgggtttcaataaatttatagaaagaaaaacttaaatttttatgggttaattttttttaatttttgaaaatagttatatattattaataataaacaggtgacatagcagataataaaacaaaaagcacaaacttagtgaattatttaactctttttttgaacacgcttttttatttttgacataaaaatgtttttcatttttttctgttaatatttcttgaaacaatattttatttaattttaataaataaattattaacttttcagatggacatgattattgagtttaaatatgtggtcaaaatgcaagggaacaaagtgagcccgaacaaagtcagagttcggatcagcagttttggcaaaaaggcaaattgaaaattggaaaactaattatttaaatttatttaaatttgaagtgggacatggacaatgatccttcgcggaatggaactgattcgaatgtggaaccttcggtcatgcccaaatcaaatgacggcactttttaattggaaatggaagaaaatggagaatccgtgaagtgatctgataacacaatanaagatgaatttaatttttataatttacaatt

SEQ ID NO: 43372 - DNA, 1326 bp, Heterodera glycines
tttttaggttttcaaagaatccaataaaatttttttttctgaaaaaaattaaaattgatacgaggatcggatccttagaacaatggatcgttagcctgggatcaccaaaacgatctttatgcatacggatttcgatcacagatttttcgatccacgtatcagtgatccgtggatcatgaaccaatggcttagataataagggcaattgaagaggctatccttgctgcctccagaaatagtgtaattaattaattttttttaaataaagtttcggccacagtttagatagattatgatgatagggttttttccatgatactgatccggtcatgagaccgcaaaaatagggttaaatttaaaaatctgatccagattcaattcccgtatcttgaccccaatttttcaaaatttctgactatttactaagcatgtggccctgtctcgaatggcatttggatgccaatttgagacatttccaaatttgttcaccttttgcgcagttcaataaatgacgcccgacggaccagcacatggttaccgtcctgcttggccagcttttccacttggaacatcacaaattggagctgctcaaagtggcacaccgggaacaggtcgggttgattgacatacaaaatgattgcgtttgggtcgccgaacattttcctgtcgaaataaaattctaaataaattttttgtaaaatattcttttcatcgtccatttttggtcccctcgaatgggaaggacgtgtttgaaaatgaacaaatttttataaaaatatgagaaaaacccaaaaaaaaaattaaaacaattattgctcctttcagttgctctcagatggcaaggacgtccttgaaaacagatgaatcttgagcatttttgttatctgtttagctgtcatcgaaaaatttgaaaataatgttttaagattgtttcacccttttttggcccccttaaatttcaaggacgcccttgaaaatggacaaaaatgtttattaaattgtcttgtttgcccttttatctgtccttgaaattcatctgaaccctgttaacataagtgtgtccagactaatgaatgtgctaattgagtttaatcggttttaaaaattcttttttgcgatttgtttaccaggcttggtaaagggtccgcgcaattcctggccccgggcgattttctggcacaactgccttcgccataattggcaattttttgccgtgcataatctccaccttgtccagcattttacggtggcactttgaaacggcagtagccgccccggggccgccaatttggcccgggttcacttcgacctgacaggtaaaattga

SEQ ID NO: 43373 - DNA, 741 bp, Heterodera glycines
tgacgaatagtgacataattttcagccaaaaaatacgcctaaataatttttattcactgattgcagttgcaaatgagcacgactgggatttttaagaccaaaaaacccaaattagttacctaaaaaaatttttaaaattaaaaatttttgccaagaaagtaaatttttgagaaaattttttttcatttcataggagtatattttgaaaatttttagctcgatttttaggggtgtattttttgaaatttttttaggtcgattcttaggggtgtattttttggttttattgcgtttttgttaaggaattttccaaaaaatgtcgaaatagtgaaaaaatagtgacaaaacgccaaaatagtgatttttaactattttagtgacaaaacccataatagtgatttctagtgacgaaaagtgacgtccaaatgaaaaaattttaatgcagaaatgcgttttttgagctcctttcttcaaaacaatagagcaaaaaaaaagttttttcactaaaagttgcggccctacttattattatccaaattcttaattgaattgtttcctatcttaaacagttctattttttaaattaaatgtattttacgcacaaaaaatcgcgaaataagcacaaaaatatacaaataaaaattttattaacactttttatgtagcaaaacacataaaaatttaaagctttcaattttaaaagaaattattaaatactttttaaaggttttttttccattg

SEQ ID NO: 43374 - DNA, 985 bp, Heterodera glycines
ttactatatacgttatattgacaaggagtttcgttgctaaaaccattttctcccggccgaaggccgggagcgccctgaaagtagtggaagggtcttacaactttttgaggagcatccgggaaaaatataggttttccggtccgagagccaactgagtaccagggactaaattctcacttttgtttgcatttgaaggcccctaactttttttgtaaaactcgaattaaaaagtgcccgctgtgagggcactccgccaaagtgtcctctaaatgctggtattttttaaaattttttttgagcaaacccctggcctgcaaaaaatggcaactgaagcgtgctcaaaaagtacacttcagtaccaggtgaataccgcgccagggtttgatctgagcggggggtggtcagcgaacttattgtagagatttgaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggtcggttttagacaaaaaatgcattagggcaaaattgtagagtttttaagctctatcgaatggtgtgccatatggccggaaattttcaaaaattttcgagctaggccccctagaaattttcgaaaattttttttgggttgaaaatgggggtcaaaaatatttttctggggtattttgatgtgctgagcacgaatctgatgttaattttcagtttagtaaattttagaattttttaaaaattcaaaaatatttggcaattttttgaccctccaggattttgggttaaaatttgaaaat

SEQ ID NO: 43375 - DNA, 827 bp, Heterodera glycines
  misc_feature (824)..(824): n is a, c, g, or t
ccccgaaaacaaaaaaatcgatttttcaagttttcggttggggtactcaacaattatggggacaaaaattccaacgcagaattaaagtacaggctatagggaggctactccggaaggattcggtctccccataaatctgggcgcatcggtcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgnaaa

SEQ ID NO: 43376 - DNA, 1147 bp, Heterodera glycines
  misc_feature (1059)..(1059): n is a, c, g, or t
tttgagaaaaattgcaataaaaatacaagaaaattgtaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccggtctctactcataactgctcagaactgaacaaataattacatctacataaataactgttccacaacatctgccctattatcgagagcacagttctttttttcattggcgaaaacattggcatttaaaatgatatgattatgagaaatgctgaaaaattaattaaatggcgctgtgatggtgttggaaaggttataggcgaagaaatttttattttatttaagaacgaattcagagaaattcccactttaactgtgcgttattactagagaacgaatttatatggataaaaaaaatcagaaaatatgaattataaatatgttccaaaaattcccgaatatggacgaaatatagaaaaaatgctaaaaattggttcaacgtcgaaaaattataagcattatatttttgagattaaaagtgaaaaaacagattaattcactaaaataaaattatataataaaattcaatttagtatctcaaatggttatttaagaaaataatgtttctcatgaaatgttcactttaaatatattttaaatgggaatttttgaaaataaaataaaagtttttgacattttcgaatttgtctgcctttaggagtgagtgtatttcttgaanattttgcgtctttaggaatgatttttttcaattcccttttcaaatttggcatccgccttctccgtccgtcacacagttgaagcatccg

SEQ ID NO: 43377 - DNA, 1157 bp, Heterodera glycines
cgatttatggtgtacaggatgtttgtcgaaacataactcgtcaggcctgtaagatagacctgccattgctattcctgcaaatatggagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaattacatttggatgcaacctttatttttcctcgcctctcttttcgaaaagaaaagctattagcaagcgtatttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgctgcttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcggctaaatttgctaatcgatttatggtgtacaggatgtttgtcgaaacaaaactcgtcaggcctttaagatagacctgccattgctattcctgcaaatatggagtctagtcagcccaatcgattgcta

SEQ ID NO: 43378 - DNA, 655 bp, Heterodera glycines
  misc_feature (598)..(598): n is a, c, g, or t
  misc_feature (653)..(653): n is a, c, g, or t
gtataaaatttctcaaaaaaagagatagccatttttctgggatagagtataaatttaaaaattccctcaaaaataaaaggtctattgcgcaccgccctccctatcatgctcgagagcatttgtaggggtataaaatttctcaaaaaaagagatagccatttttcggggataacctctaaatataaaaatcctctgtgaaataaaatggcgattgtccacacccctccgtctcatccgcaagcccttttgtgaggtataaaatttctcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtcgattgcgcaccgccctccctatcatgctcgagagcatttgtatgtttataaaatttatcaaaaaaagagatagccatttttctgggatagagtataaatttaaaaattccaaggaaaaatacacggtcttttgcgcnccgccctccctatcaaacgcgagagcatttgtatgtgtataaaatttatcaaaanaa

SEQ ID NO: 43379 - DNA, 920 bp, Heterodera glycines
caagaacatttttatttattttttatttctcaaaaaatattacaataataaaaaaaatttttgttagaaaaaatttcttacgttaaaaatttagaacttttaaaattcaatagaatttttaaagaaatataattattttttttgacaatatttttgaaacaaatgaagtctgttagcaaattttcaaattgtttaaaaaaacgtagagagccccgctcctgctactatggacagacatttcttaccatgtatgggtttttcatacagtcaagcagatggtccatctgaaaatggaacaaaaaacgtaaatccactcataaaaaaataagattgttttgtacataatcataggtgttcaatgtgctgtcatcctccaagtccagttttgaaatgtcgtcctgaaaaatggaaattttaaaaaaatctaaaaaatttttttcccatttttggcaaacttgaaaatagttgaacacactcattacggcacagtgcacattttgcggatacaacggcttcaaacaaatgtcgttcagcgtgacgttgtgttgggtggtgccatccgaatccaaaacggtggcgttcaactccaccacttgcttgtacagctcgaaggcggagcggaggaattctctgtgttttttataaataaaaaaaataaagccttgaatttaaataaatttattttccaaaatttgaaattttgacaaatttctttaaaaaacaaaattttttttaaagattactttttgaaaaccggcccaattttcattgttttctgccaatttgctgggtcttcacggtcccaaaaactgtcgttgttcggaacaatgatgagctgctcaatgcgatagaatggacttaaaattaaaaaaaattaatacctaaaaaaatcactttatcttttttttttacccaaaatg

SEQ ID NO: 43380 - DNA, 964 bp, Heterodera glycines
gccgccaaccatgccccgcccgacccatggttacaagcttaacaatcaacttaaatctcaaataaaaataaaaattccgctactagcctacataaaagtttcataattttaactctaatatttttaaaacttaaaaaaatacatttattcaatactagtatgtaatttttaattatgagtgattttgtgtttaaatgatgtaattataataaaaaaatatatattataattaaagtcttaaaataagtataaattctaaattccaaaatagcggaattttaaaaatgaatacataaatatataattaccattaaaattaaattttccatcaaaatttcaatacctttaaaacttttcttttgcctatttattgaatatattatagtgcaaattgtgataggtcagggctgctattcgtccttggatgatgccaaggacgtccttggattagggcctcgtctattggaaatttgaaacagtccttttttccaaggatgtccttgcaaatgagcattcaaaaaaacattcaaaatttacaattatttttttaaaaaactatttttaaacattttctaattttcataaataactttttcattttaacgtcattatctatgcatcattaggaataattatttggacatcactattttttgataatataaaaaggaaaaaataatcacctaagaatgtaacttgcaaaaaatgttcaaatatttggccaaaaagccaaaaatttgttttacaggtttctaaagttaaattcaataagttccgttgaaaaaaatgaaacaaaggaaaaaatcgctttttctttgcaaaaaaaaagttgaaaaacgttttataattaattttaccaaaaaaaaattaatcacaattttcactctttttttgccaattttcgtcacaatctaattaacaaatccctaccccaaagaatacatttgaaaattaatgccaaatc

SEQ ID NO: 43381 - DNA, 155 bp, Heterodera glycines
cgccacctcggcgcacacctgcaccggcgacggtggcggcctggccatgcgtgccggcatcgccatgcaggacatggagttcgtgcagttccacccgaccggcatctacggcgccggctgcctgatcaccgagggtgtccgcggtgaaggcggca

SEQ ID NO: 43382 - DNA, 1022 bp, Heterodera glycines
ttttccgattaaaattaaaaatgaaaaagtgcaagcccaacagatgaccagaaaaattataaaacaaactcaaaaataagacgtcgcctgaagcacaaaatcattgataagtgatacgattgatgaaatgaagtagtaatgggaaaaaagacacatttgagtagcaaaagagaaagaaaaaacgaaattagttgccaattaattaattaggtaattaaaaattaattacgaatgaatatttgccccgtcatatttagtaatacaaaatgccaaattagcaatttttctaaaggacccaaactttttggcattttgcaaatgtaaatagaaaatttgtgaatggctttttgttgctcgcttccgattggaattgactgtcactgcttgcgcttgagctgctgatccgcttgtctgctgctgatcacttccctccgtctctttctctgtccccgcccaattcattcacacattttacatgatcgaacatcgcgatcgcccccctccaccggtgtcctctcgttctctgccattcctctcgtcctctggcagtgttccgccccgctgtgctctcctctccctctccttctctcgtttccgcttgtccttggaggcggaaccgcctgctgcaaaaaatgataaatttgttttaaaattactgtatatgcatgggtttgattttgataatcaaagcaaatagactttttggtcttcaacggaatgttccagatttttttggatcgacaaaatcttgtcttgccccttatgattggtatcatgagaaagcccaagcagaaaaaatgttattaatgcatatttttgtagacaataaaaaatattcttttgaggaaggatgggacacatgcttgctaattgtaagcatctgctcataaatctaaacttagcttgaacataaaatatttgacagcaagtgttaatgagtcataaactctacgcctctcgcgaaatttgtcagcccaaaaatgtcaccgcttttccttccggacggcgtcgatgagctcatt

SEQ ID NO: 43383 - DNA, 1189 bp, Heterodera glycines
  misc_feature (1115)..(1115): n is a, c, g, or t
  misc_feature (1128)..(1128): n is a, c, g, or t
tgccatttccgtcatttgtgctattttgtgccaatacctacccccttttttcagcattataaaattattactgctatacataacctatttattaaaaaaataatatttttattttcgcaatattattgcttaatataataaatcgatgaataaaaataaaataataaatttatttttattttcttttattgttgcttttttatttttccatgtaataataaaataattttatacatttatatttttatgaaaattaaaatttttgattttttttatacaaaaatacattagaaaacgttgcttaatcataaaagtttttcctccatccacttttaaatttttgaaaaattccaaaataattagacttattaaaataattattatttacatttggaattggtgagaaaaataaataaattttttaaattaagaggatttaaatcatgaaaaaggtcgtgaccaaaattttgggtatttttaaaattgcattatgccttggcataatgaccatcatcaacactacggttttgtgccaatccaacaccaatccggcgtcccgtgaattgaaaatttttgtggacccacccggggtccattacactgtcagtgcggttgtgataacggtgaaccgtgatggcacaatgccaaatatgcccagacacattttccatggcacaaagacgtggacccaactggacggacgagaaatgttcattttggaaaagacaaaattggatggacgtcgaggagtcgtattcgaatatgggccagaaaatgcgactgaagaagaaatggtatgggttcttcggtatagaataattaaaataaaatttgaaagaaaaattgtaaaagcatcaaaatttatttactacagacaaagagatatagagagacatgcagagagacagagagagggaaatagagttatagcaaagagaaagaaatagtgagagacagaaaacatagagaagagagtgagagagacaaaagaaagagcgagagaaagagagcagagatgagaaagaatagaaagaggggctgatggagtacaacgtgagaaaggggagaaagagaggatgagcgagacagagaaagagagagaaaaactaaggganaccccaaacacanaaaccaaagagagcacccctgaagggagcgagagagacagaggtgagagagacagaagaaa

SEQ ID NO: 43384 - DNA, 752 bp, Heterodera glycines
aaaaaaatcttcgggtttggtcgggatagggattaggacgggatcccgactcgtgatccgtcccgatcgtttttcaaaaatgttcgggattgatcgggattccgtcgggatccctccgaacccagttgtccggtctctaatgtttaatgcagtaaataaaagggaaaataataaaataatttaaatgcattattttttaaatatgattttaatgaaaagcttatgtatattgaaataaaacggctcccgaaaaatgattcagtgagaaagtaattttaaaaaaagcttgcaaattttatttaattttcaatatagatcaaaaaatacataagaatttttaaaatgaaaaaatgaaattctttaactcctcagcagaaagatttatgttttgtttttgaaaacttatgtttttggtaaaactttttaaaatttatcaggctgaagccactgccggaccttttcttcacaatttgtttaagaaataagcatcttagattaaatttttaactgctgtttgttcatattagagtgaagcgggaccgggaattttgggcaaaaccgggaccgggacttgccgggacctgagaagccgggaccgggacctcgatttttgtttgggaccgggaccgggaacggggaccaaccgtgaaattttaaaaattcaaaaaaatttattttaatttatttcaattgaaagtaatacaaaattaaatttttactttgttttttattgaataaattccaaaagtttt

SEQ ID NO: 43385 - DNA, 605 bp, Heterodera glycines
ctccccttctgccgaagtttggattgtttcggcgccccttgacgcgacgccccaagagacatgggaacggctgcagacgaacacacacaatctgagcacaaacagcaaatttaacatccccgacctaaaggtgggggcggacgaaatggaaaaagtgccaaaaagaaatgctaaaataaaactcgaaaactgtgatttttgcttttaggtatattaattaggtttttaaattccattgtttttcttggctttgtccatccctttaggttggcacgcttgaccaactggtgggtctgtcggacgacctggccaagttggacgcagccactgaacagttgggttttccattaaattagacggcggcgtggagactttcgctaggccccaacggggaataagagctgaatagggcatagtttttgtgaaaatttgcacatttgcatttttaaaaaaacttgcccaataacattttgaagaaatttgaatattatattagcaatattaattggcgattttcaggacaacacgaaagttggtccaatacttttcggaggtgctcgaggaggaacgcaacaaattgttggagaatttggtcgtctcgggca

SEQ ID NO: 43386 - DNA, 1112 bp, Heterodera glycines
aaaagagctcctgtcccagaaaagatttgcatgggtggctcagtggtttttgtaaggatagtaagggccaaaggggggggggttcgagttccgttgtgcaaccatgaatatttttcatttatttttgttccaaaatattaaaaaattacgaattttgggaattatttttgaaggtttttgccaaccaaattggataatcttggtatctttcgaaagctcttgatgagtagaagctttttctcagcaaacattaagcaatttgatgggttagaaaaaagatatgattctttgaaattttgttttttgaataagttctcgaatcgacccattttcaaattaacctgacctatcattagatgcagaatttttttctctatcgttatgcaaaatttggtgtaaattgtatgagtagaaaaaaagttatatgtggcgaagtaaattccgtttttctctaataacagagataaataaatagtacgccaaaatgagagatgtttttttctctgcactctctatttattggcacacatctcgttttttgaaacggtgtgttaagcccacgttttttaatagccaaatcaaatttaaacggctatattttttctaattgtcaattgcttagcatttgcttaggaaaagcttaccctcttcaagaggtttgaagataccaagattgtgtggagaggattcgaagcaacgccctttgcacccattatgggtcaagcccagtgttagacaaaattaatcatttcgctaattcaaatttacattgaaacgcagtgttattctacctaaccgttttatttaacagccccactcatttttgaccaccgccccactgagatgaactatcaaaattttgctgaatacaaaggcgtggcaataagaggagcagcggcatgggaaagacttgggcagcacgcctttgtcaatccgtaccaagacttcgcttcaatgtcacacagtaaaggcgatgaaccgcttatggagcgtccctacagcaaaaacaaaacaaatggacgcggaaatggtgtccgtagtttcggtagacagtcaatgatgaggggtaaaaacattgagggaaaaagcgatttgcacgcgattataggtcg

SEQ ID NO: 43387 - DNA, 1058 bp, Heterodera glycines
ctgtcgtcccgtgcctatttttccgttgtgccatcgaatgcttttcatcgacggataaacgacgcgcagcagcacaatttcattcagtgtccaaagcagcagcagcaggcaaaagcagcacgaaggaagcagcagcaaatggccacatcaacggcacttcgcctgagacaggtcggaaagagaagcggaaaagcgaaatgagaattgaagggggacagacggaaaattgaacaagtgcagaaatggttagcacctggtaggataatcaagtcactgatcagagcagagactgatcaacacgataaggtgatcgtagggtaaccagtcatgaattagagcaaaggctgatcagcacttggtaggatgattagtcactgatcagagcaaagactaacctacattgatagattgttgggttgctgattagaatttgactgatcgttgtcaatttcttggtcttcagcctggcccttccgttggtccgtccccgcgtctgtcccctccctcctcctcgtcgaactcctccgtctcctccacccaccgtttcgtgctcaatcggtcggattggcgtggaaaagcgtgtccggacggcgaccttttgcccgcttcttggttcatgcttagttcggaagtgagcattgaccattttgtcctggaatatccgagataagcccccactttaccatcctccattttcccaggatctcttccaattgcatcaaaagcttcagcggcgcatcgaccggcgacgatcgctgaccaaagcgaattttccgtttggcgaagcaaatcggcgacaggcgaacattttacaaaaatgtgccttttttgaggccaaaatgtgttggccttctgctgatcagtgagttcagatcgtcgttttccggccgatgtgctccgccggtcgctgtccgatcaccacatttgttttatggacccgaaaagggacgtggaggcgccgatcactcgcggccccaagaccaactcgtggtccgcctcctcaaaagcgtcgtcaccgtcaacgaatgggccgaagaagcgcgtgtccttctccaccg

SEQ ID NO: 43388 - DNA, 757 bp, Heterodera glycines
attagcttagcgataaatcgaagaccagcatttttgttctcccgagacaagtccagctgaacattgtaacgtctcatgtattcttcagcaaacgtttgcttttgttgctcattttgaattcggtctggaaaaccgctggcctcgacctgaaatgtgctctttccaattagaatttcgcctttttacattcacttttaatttaaccataagccgaacatattccttgaaaacttggtcactccttaatcgggaaataattaattgaaacaacaaaatacactgaccattgttcataatgccatgccctccagaatctatccacccggtagccacactccagagcccgtgctagctcaatatgtgtgtaggtgccacagtaggcacgctgtaggtccgtatgctcacaattgtgaggcattcttgtgccaagatgacgaaatttgctagcacatcggtgacaacaactgaacaacagccgctcgtccaatttcattggtagaactggtatgcgaagcctgcgtggcggaatcacacggacacgatacagtccacgatagatcaaatcgttggacgaattcctattaccatttcacacttagaccatataagacgcctccttactacacttaccagtccaccattatttgttcaacggacgatgtataatttttggtatcccaatgggataatcagtgtcataattcacctgtcagagagttaagagcataaaaatcaattttcccctcttacccagggg

SEQ ID NO: 43389 - DNA, 785 bp, Heterodera glycines
ttcaatcataattaagaaacataaaatttaaaattgtctcttctaactgaaggaatgaagatcctagtaggtggaaaagctaatgtggctctaggacaggggtgtgaccaaacaatttttaaaataaagaacatcaatgacaaaataaggtttagggtaaaaaaagacaatcttgcaaaattggttcgaatcagttaatatataattttttcgataaaaaatgtattaaaatgttatgtttttcacatcctatttggattttaacaatttttggggaagaaattagcaactgctgaaaaaaaaagattttcaacgttttttttgcagtgtatttttttacaagttgatgaatgggaagtgggtccggcggcgccgataggcgacgccgggaaaatttttgaaaatttgagtgctattttatagcagattttcaattaaaatcggtaaaaacatgattaaaaaaacggtaaaataaagtgcggtcatgcgggatcgaacattaatgcacagcacaaagcaaacctgctgttttcaccactaaactaaaatacttaaataataaaacttattatttctttccaaaaaagtgaaaagttattgcaaaaaacattcgaatgatattaaattcataaattcattcaatttgggcaactatgaaatgagttataccccaaaaaccgggctggcgcccagtcgaccttaccagcaaggaaaatctaaaattttcagcaaaaatactaatttttccttaaaaatttcgggtgcgtaggggcccttgggggggg

SEQ ID NO: 43390 - DNA, 1190 bp, Heterodera glycines
attgtgggaagcaaaaatagtacggcttttaggcatttattattttggtcaactgagagaaaaaattttcggtaaaattttatttttatcaaattctttatgcaaagttagcatttaaataaatagagaactatttaatttcttgtgccgagaaaagtctgaaaaagacaatgaaaatgagtaataaaatagaacataaattgaaatttcagaaatttagttaatccgctataaatttccctttaaagagcatatattcacattatgtctttgaatttaaaacttttttaaatggtctagaaaatggaatactagcatgttgaatactgcagaaatgttaggccctcgacgaaaaacaatgaaacttttagccaagcattaaatgtctatttgactaagggtggaaattataaattacccaggaactacagtgaggtaaagtccgtatctttcagttggatgtgcataacgaaaataaatgcggaagtcaaaataaagacactgtgttttgtttctaattctgaaaatagggcatcaatggcccatgatattcattaataaactttagcgatattttaaaatttctcaattatattgcccaattttataaatttgtttcattttggtcgggttattgtgggaagcaaaaatagtacgtcttttagacatttattatcttggtcgcatgagagtaaaaatttcagataaaattttatttatatcaaattcttcaaacaaagttagcactattctctgtataaatcttcataagtgcggtggaggtgaaacatttggtaacgtcaaagttcagtacttataaaatagaacatgagttgaaaattcattctttacgcctggttcaatccctattcagacattagattattttcaattttctttttgtattctggagggtttcctataaagaaaatatgattcctcatagttttataggaaagtgatacatattttatcattttttaaatgaaaatcctgccaattgagcttaataatcgcaaaaaccaaccttttttttgtcgaaaatctgttaacaaattgcacccaaatttttaaaatttccctcggcggcgcctatcggcaccgccggaccccttctttcccaaaagttttttgaaaaagcgctccgaaaaaaagtgatgtgaaaatcaaatctgaatttctattaatat

SEQ ID NO: 43391 - DNA, 1485 bp, Heterodera glycines
  misc_feature (1403)..(1403): n is a, c, g, or t
ttagaagcagagtatttttttacctcggcaacaagtaatgttttatttattttttatactttttataattagatctgctctaatgcaatttttaccaccatgaccaaaaaaatagaatattctataaaaagttgttctcttttcaaatcctttattatctttttttttatcttctttttttttgttttgaattaggttttaaattaggattaatattaattttttttgatctacctgcttctaacactcttcgataaccatgaccataaccataacctgaatatcttggaactgaagaaaaaaaatacctaggaaacctgccattacacaaataataaactattaaaaatataatcgatgtaacaattgtaacaagaataaaaactataatttctttttttatctctccccaaaaatcacttcaaaaagatctagatgtttaacataacctgtcatatgctctattttccattattagataaattattatttaatatattttttaaattttttctataaaaaattatttatttatcacagatattactcaaaaatttaatttttttttaacaaaaaagttttatatgttcaatatatttttgtttttctaactctataataaaagaagtcttcttaaataaaaagttaatctctttttttatattaatttgataatttaaaataaaatctaataatttttcaatttctgtcataacatccttttcgttagattctataacaaatacatttttttcttttttatatataagatcagcaaaaataacactttcattttatctcataaactggttcataatcaatactttttatatttttttctctttctatctgttttaattttattatatctatttctatcttttcgctttcatatttcataacatcttattgtttacaaatagcttatttttaataatttatacatcagtagttatgagtacatttttttgccctaaaattgccccaaccccgcacaccccaccatgaacccgcgaatcatcgagagaaaatccccacagagctggtgaaaaaagttgttaaaaaaggtgaaaaaacacggtgaaaagaggtgaaaaaacgcagggataaaggtgaaatttaatggttaaaaactatgggggggggttattgacagccatacgtgcaagggtataagggtgccccgcttcataccaccacctaaacccatatcctggttcacccctttttcatgtaattgattataaataaatttgctaatcttttcgttatttgtgaaaataattaaacaacttttaatcaattctttggtccccctttttccaattttccatttttttgctagctgcccccccctcctccgctgccgcccgcccattatctctgattttgatctcgaaaanatactttcaaatccgcatttatttttcgtcatcaaagtgttccgtgggcgtagtggttatgcgctcggttcgctctctcagt

SEQ ID NO: 43392 - DNA, 1044 bp, Heterodera glycines
  misc_feature (182)..(182): n is a, c, g, or t
  misc_feature (867)..(867): n is a, c, g, or t
tttttctatccttgtggactgagtcggcccttgaaattatatagcagtgaacccaatacttccttggaattttccagtacgggtttgtccgtgaaaatttgaaaaatatttccaaaaatcccattttcttttttctatccttgtggactgagtcggcccttgaaattatatatcagggaacncaatactttcttggaattttccagaacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatagcagtgaacccaatacttccttggaattttccagtacgggtttgtccgtgaaaatttgaaaaatatttccaaaaatctcaatttcttttttctatccttgtgggctgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaaattatatagcagtgaacccaatacttcattggaattttccagtacggggttgtccgtgaaaatttgaaaaatatttccaaaatccctatttcttttttctatccttgtggactgagtcggcccttgaaattatatatcagtgaactcaatactttcttggaattttccagtacggggttgtccgtgaanatttgaaaaatatttccaaaatccctatttcttttttctatccttgtggactgagtcggcccctgaaattatatatcagggaacccaacacttttcttggaatttccagtacgggtttgtccgtgaaaaatttgaaaaatattttcaaatccctatttcttttttctatccttgtgg

SEQ ID NO: 43393 - DNA, 778 bp, Heterodera glycines
agggagggaagagcaaatggggggagaagccatggagaagggggcagggaagagcgtccctgctgctggaggggaaaaagttgaaatgggatttcatttgcagaaaatcgaagcaatcgaacgcaagttagccgaaacaaaaagtgaattggaacaaagcaacgtggcgatgcaacggcacatttggctggccgaaaacggcacgagcgttgagcaagccgaatacgcactgcagcagttggaagtgcggaacattaaatgctcaatagccaatattatggcctttccaacagagacagcgaagtgagtgcactcagcaaattgcgcatttgaaaaaggaattggccaatttggccgaacgcacggatttggcggaacagacgcgaatgtggcagaaccttttggagatattcgaactcaaattgcagctgaaaaggaacgcaaataagtaaaaatagcatgggaaacaaacgacaaataaagaaagacatgggaagaaaaaaggaaaagcgttttaggggggacgagccgaagccatggggcgaccgacgagccttttgatggacagcggagaatggtgttgtcaatccagaatttgaattttattacccataaacaatcacgaaacaaacaccaaaaatgcatcaattactgtaggtacaaaaaagtagcgacaattacggtacatacaatggtattaaaaatgttaaacgtagcctacggcactttctctcatcggcacgttacttcgtcatcactttgaatggcgatccattca

SEQ ID NO: 43394 - DNA, 1108 bp, Heterodera glycines
atatttctttgcattttgggcgtcgtttattccccgctgctacttttttcttcggtttaattacccaagtttgaggtgctgggggtgtcctgcccctaatatcgggggcaggaaataaattttgggaactgcgctgcctaacggcgggtgcttaaagggcgctaaaaatgatcaaatgattatcaatttttatttttcttaattccaaaatgattcgaaacgcaaaaatttaatcataattcatgtggtaaaaatgcatttaaaaataaaaaaattattgaatttgcttctgaattttttaattttaaatagaaaattactttttcgaaaattttgcacaaataagaggcggagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtaaactgctgcattggcagagtcagagaggggtcacaaagagttcgcacagcatcgaatatttccttcattttaggcgtcattcttccccactgcacttctttcttcggtttaattacccaagtttgaggtacttggcgtgtcctgcccataatatctgtggcatggaataaattttggaactgcgctgcctaacggcggtgcttaaagtgccctaaaaatgatcaaatgattatcaatttttatttttcttaattccaaaatgaattcgaaacgcaaaaatttaatcataattcatctggtaaaaatgcatttaaaaataaaaaaattattgaatttgcttctgaattttttaattttaaatagaaaattactttttcgaaaattttgcacaaataagaggcgaagaaattcaacgaaatttttattaggattttgatttaaaatgttgagaggtttaacaaatttgtacagtgaatgttggatcgtcaacaccaatgagaaatgactaaaaggaaagagggagaaaagggcgttggcttaggaaaatag

SEQ ID NO: 43395 - DNA, 1461 bp, Heterodera glycines
gccattaaaatgatttgcggattagttgctcatccccgtccaatttatcaccattttgcctttatgtgatctgtctgatcagtgctggcgcgtgcgcacattcatttgctcgtttcgaccgattgtcattttgatcagtctgatcactgctctgctgtccactgttcatataatcaataccgtactccaaaccgtaccccacactcaccccttcccaccatcacacatttgctgatcaccgccaccactttttgctcaccgacatcccccgccgccctctgatcacacatttatcagaatgtttttgttgtaccatttcttactgtcaccatgataataataataatgtgttgattaaatgctgtctgattggttggttagtcggtgtaataaaatttggaaattgagacatggtggtgataatttggcccacacagggggtagataatcagatcagccatagttttgactaagcctaaacctaagcctaggcccaagcaagcgtaagcttaatcctaagcttaggccttgcctaactaatcccgtgtctgagttgcctttggcatctttcgtcattcgaaataaattttaaaatattacaaaaaaaaattattttgaagggtgtatttttcaatttccttgtattattcttatagattttctcaaaaatgccaaaatatgtgctaaaacacaaaatatgtgtttttgtgtttttataagtcgctctaattcgaaaattgttcggagcaaatgctatttttgggcttctctcgtcataactaagccgcagaaaaaatatgtaaaaacataaaaatccggtctctatttattaaacttactacacttataatcccgccccctcccccataaatttgaacaaccaaatttatttcctaaaaattcgtgtgatccctgaacaataatgataatgagtgcatgtgcgacaccaattagttctgttactgcttcaacaatttatttctctaaatttgccaacatttttttctcaacggaattggccaactgtgtcaaatcagtccccgttttttcaactgattttccattttttttatcagcttctgacgcttttttgttctgtgatgacggcgagggccctggagaatttaaattttcaaatattggcaaaatgtaaaaacggtgccacccggagattgcgccggatgaaatcgtccaccatttggtggaccccgtcacaattgtacagcatgttgatcatcagaaagtccatctcggacacgtgtcgatgggtgccaaaagtgtacttaatttgtaaaaaataaattttagcatttctgacttaattattttgggagataatttttaggatataaaaagcgtttacatacctatttaattttatttcatataaattattttcctctactagtggggacctaaatatctcaaaataggacccccaaatacgatattgcgtttgaa

SEQ ID NO: 43396 - DNA, 1305 bp, Heterodera glycines
  misc_feature (712)..(712): n is a, c, g, or t
  misc_feature (722)..(722): n is a, c, g, or t
tgtcccccgcaaaattaagaaacggacgcaaggcgccgtctgaggccgcgacgcggccgaatgcacttgctcatcacttaacaaacgcgcatgcactagcaacgaagtcctttgcgcgaagcgctcatgtcagcgcccgcccatatataccaaaagtatactgtctacaccgagcaattactgcgccacacgctagtttatattaccatagagaaaaagggggtttcgtcttaaaaactaatttgagtcgaacggctgtcgggaggggtctgaaagtggtggaagggtcttacaactttttgaggcgcatctgggaaaactataggttttccgctccggtggccaactgagtcccggcggctaatttctcacttttgcttgcgtttgaaggcccgtaactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcagacttattgtagagctcggtgagctcgatttttccaaattttaaaatttcgaaaattttcaaaatttttcgagctaggcctaaaaaacgattttttcgtttttgaatttnaagatttttnaacgatttttcccagaaaaacgaagaccacttccaacacatagttttttgagctctatcgactggtaattttttcggaaaaatttcgatttttttccggaaatagaaaaattttttggcctcagcgggacatttgagtcccgggcccataactcgtcaggggtcggttttagacaaaaattgccttagagccaaattgtagagctttttaaactctatcgaatgttgtacaatctgttcggaaattttcaaaaattttcgagctaggccccctagaaattttcagaaattttttttgggtttaaaaagagggtgaaaaatatttttctggggtaaattagggtcctgagcacaaatatgatgtttattttaagtttcagattttttggaattttttaaaaattcaaaaatatttttcaatttttcggccctcgggattttgggcgaatatttgaaaattcatagctcacttcactgtgggactattttaatgaaataaagctttaaaaatggagaaaaatatggagaattttatgggatttatttgaaatttatatctcaaaaaagaaaaaagttattccaga

SEQ ID NO: 43397 - DNA, 1134 bp, Heterodera glycines
  misc_feature (90)..(90): n is a, c, g, or t
aaagacccggatttcattttgatcattttttgatattttttaatgatttttgctttctcttcattggtataattttgccattcttaaatntaaaagtgtttaaaaaatttaaaatagaattacttgatttgccaaaagcctttctccatcggataattgttgatcgttcaacgcccaattctttagcaatttcacgttctttttcataagttgatgattccgatttacggttacattcactcttctttttttcaaattcttttaaaatccttagtttttcttcttttgtataaaatttgttcttctcttaatttaaattttgtaatgttttttaattttaaaatatttttaattgaataattaattaatttactacttccttttatcccaaatttctttctccattcataaattgcgcgaactttcactcccaactcttccgcaatttcactctcaattactgtactcggctttaagttcttttttcttgtccgttcttctttcattttatcaaattttattaggatttttttacgctgttcatcagtcaaattttttggttttttgcctaaattttaaaatattccaaaaaacattaattaggtatttgtgatttacttagtccatatttaaatttccaatgttttatttgatgcattgtgactcctaatttgtttacaatttgttctgctgttatttttttcgagaaatttccattgtcaatgcgttctctaattagcataaactttttcacaatttttattttttcttcgtctgataattctctgcctaaaaggttataatatttaaaattaaaaacctaattatattgcttaattttcaacattagcattaaaaatcaaataaaatattcgtagacacatgttgactcttttgtctccataccaaaattcgcacgtttctttccatatttttgacggtttcgtagcgcatcatttggcataatgtcatcattatgttcatcttcttcagatccgttgctcatttcataatccgaattttctgaattcccttcataactttgtttgttgtcatcatactcataatcatcattatcatcatcagcattatcatcatctgtactatcattttctgctttttttttggaaatgt

SEQ ID NO: 43398 - DNA, 1707 bp, Heterodera glycines
aaaaaagcaacatcagcatatgctaacggcgacattgccattcgagcaaagaagaccaatggttcgacgcactgcggcagctcattttccatttgcaggtgaagaaaagcaaaacgaacgcgaggcaaaatgaggcgaagcggaaaagcgtcgcttaattaaggaacggcgcgtttggatgcccgaatttccgccggaatgccctctcgacgatctgttgctattcccaattcagcagcccggggagaccccgacaagcgattcgagtgaatttttaacgatctcatttaactaatacaaatgctaattaagcgggcgattatggcgcattcgaagcggggccatcgaatgatggccaaacgatgccggcggaaacagccgctgcaaacaatcattttgtgctaatggggcagcccaagggcgaagggagcccctttctggtgccaaacccaatgtacacgctcaacttgaagcaacaacacttcggcggagtgcctttgcccgtccatcaccagcaccaaatgagcttatctgttggatctgcggaggtgtgcccattctgactaattagtgcactaacccccactctcattgtcagtccgccgctgatcaccaccagtgccgtccaagacaacagtcgttgtactgctccaactcctcgcgacagtccgagcctccaccccagcaaagtgcagcagaacaacagcaacaacaacaacacctttacgctgcccaacaacagcaaatgcgcacttctccgatggaagtgaaaagccaattgttggcacaattggccaacgaattgggaagcccaacggagcaacgcaattaggggaaatacagcagaaacagtcgaaaacaatcactgcttttgttgtttcacttcaattattggcttcgcccatcaaattaccttcaaattaatgactcatcaaaattaaaagaataaaaaggaattcaatcagtaaaaaatattttttatatcataaaattttcaaatacggataaaaactaacagagaaagaggatcataaaacgtaaatttattttatttttcaaatttaaaaaatattcattaaaaatgaagagttttaatataaggctaatatgttggtcctcattgtcagcagttctcttcctgtcgctgtgctttgtactatcatttccttatcaaatgcctcccccaatttcctctcacagcccaaaatatgagaaaaacgagttgcacacacagaacaaaccgccgaatgctgttgaggtggggggggggggagggaatggcgcatcgattggtgcgattaatggggaaaatgaagcgaagcaaatttggcgcgttgggagtcggcgggggctgctgattgaagaagtgccaaaacttgagactgaggggctaaaaggatcaaatggaagaaaatcttatttaaattttaaaaaatccattaaatgcctaaaaaggcgaccgacccgttgccacggtcgaatgcggccaatggcatcggcggtgaacaccgacgaagtcacgaaattgccttccgccgggaactgagcacggaaaacatttctcactgccgaacatccgacgccgcatcagtcgccgctctcttctccgaatgggccaaaacagcacgaacatgggccaaagaagaaataaacacaaaaaggacgaacaaaaccagcaaaatgatcccccaatgataagggggggac

SEQ ID NO: 43399 - DNA, 989 bp, Heterodera glycines
ccatacattttccgttgttggactcctttcgcaaccaattcgacatcttaaccgatttagaagccagcaaagaatcatcgaacactttggccttgcagaaaattttgaactcaatgaccgaattctcagtgacattcagagtgaatgactcgtcccaatgcggggaattcgttttcttcttaacactcgttttcttcgcttggtcctccttcgagtcaacaatgatttcaacgtaagcatcaggtgccttactcaaaaaaccaccactgttgagtttagcagaagttacttaattttgagatttatttttaaaaccttacaaatgaaaaatgcctgttgtttgaagagcaaaggatcgaaccgatgcattaccatttgttgatccgttgagaactgctgatgaatcgtcaatagatgccatcaaaattaaatgttttatgaatgtctcttatacaccaatcctaggggtaaaaaagcaataaccaatcaattgattagttaaagatttgcagtaatgccgagtctaatgatattaaacggggtgtgataagaaaatacacaccaacaaccatcaaagaacattgaaatcttttacaaatgaagaccttttcaaaggtggaaaatacaaattggataaataatcatttctttgtgttgtgcaggtgagtggaaaccagttgcatcgcataccgctcactcgccttccattcgacactagtgattgtcgacagaatttttttattgctcaaaggcatctttcaactaattaatcaattaattgatgcgttatgagtacaatttattggttctaggtatattaaaactacctaatctagagaacaaagaattcaaacacgaataccggcggcccggtacttaggtaaacataccatacacgaagattttttattctgatccaaactttaactcgccaaactgtgaatgaattaggcactggaaaattgagagaaaatggaaaacgaaagaga

SEQ ID NO: 43400 - DNA, 937 bp, Heterodera glycines
ccccccgcccctttgacagcggaatcgaatctcattttggtttatttttgttggtctttccttcttaacgggcagggacgccgctcgtaattgggtgggatgtgatatttgacctcgtttttaatttaaataattaatttgtggcattttgtctatttaattttgttccccttctaaatttttttgttttctcagtgcttttctcatattatattttggcttcaaaatgatggtaattttattctcatcgctctccccgacttttgatttttattgaattaaatttgttctgttttgtgctgtggactttaatttgtgttggagatacacttttggttttaattgtttgagtttttactcagaattataagaatctattttttttttttgcaatttgtgttttcattataagtttgtgttttcattatatgatttaatttaattagtaaaatattgaataatttacgcttcatctattcataaattagaaaagttctctttctaaattaaatagcataaatgaatataatttaataaaatttttgattatgagcaaaatttagaacaaattcattaaattaataatgaattgcatttaatttttaccatttaattgagaagtaaatattttgtaatttttataattaatgataatgaacctattaacctgagcaagtttatttaattaattaaaaaaatctgataattatattgtaagaaacgtcaactctaataacatatcaatcaaataatgaatagcataattcactccgtgtaattttgctttacaagtattcaacagttatcattagggatcggattcttagtttttaaactattttttctgcggttttatttcgacgagaaatgcacgaaaaacacattctttttcgaaaaaatgcgtttttagtgccactattcatcactaggaatcact

SEQ ID NO: 43401 - DNA, 82 bp, Heterodera glycines
caggcccacgtccgccagcagcttgaccagcgtttcccgcgtcggtggcgtcttcaggtactcaatgaccgtgggttcctcg

SEQ ID NO: 43402 - DNA, 897 bp, Heterodera glycines
tatcattcgcttccggcgccccgcccgaccgttcgtccgactcgcggcgaccgtccgccgtctcttccttctgctctcaatcgggcacttctgctggtcgcttctgttcgtcctccgcttcttctctctgttctgctgcttcacaatccgctgactcttttgactccaacgaaagtgacaaaaaaagcaatgaaatcgttaacagcggaacaataaataaccaaaacgaccggcacaatcactgccagcggaagccatgggacagtaatgaaaggacaaatgacagtatccccggcaatgggagaggaaacggtagcaaaacaacaaaaataatagaccgaataatgacattttttaattaattagtttaactatgaaaagaatagaaaaatttaatgtgtgattgcctgaaaaacagaaaatttccaattctcacaaattcaacgatttccagacatgggaggccaagcagtaacagaacgagcgggagatgaacaacacaagcggacggactggcggagaaatggcggacgaataaaagcggggggagacggagaaggggcggaggagggggaggaggacgaagtgatattcctttgaagttggcatttgtttggcgttttgtctctcttatttcaattaacaccgatttgtttttgttctcttctctgtgatttttccattttcgccgccctttttttctctcgccagtgccgtctctctctctctctctctctatttctctctctctctctatttttctttctctctctctatttttctgtctctctctctatttttctgattgctctctctctctccatttatctttttctctctctcttcctattgcccttcccttacctttttcctctatcgttgacctcctctttttct

SEQ ID NO: 43403 - DNA, 671 bp, Heterodera glycines
tctaacagaaattcgaaacaaatttaattacttatataaaatacaggcaaaaataggtgtgaactggaaattgggtctataaatgatggaaagccctaaattaaggtggctaaagccgagacaaattccccaaaaaaattcattttgcaacattttcggcggattgttgatggattggatggatgaatgaatggcttggatgacagaaggaaaatttgttgggatggcccatcgcttaatcctccttaaaaatgcggggacggggggggcgacaaaaagtccccgcccattatgtaatacaatcccaattgaaaatgatagtagccctaatgggctgagctgatctgatcagaccagcggagcgatgggtgagtgagtggagtgatctttgtgctttttcttgccgctgcttctcctaatattggcccatcacaacacagagaacagagtggcgaaaagtggggctgctctctgccaaaactgatcaatcaatcattctcacctctctgatcagttgtgacacaaattgtttggcgccgagatgggagcgatgagggaaattaagcgccaccacctttcagtctcaggtctcggtcacagcagtggttttacgttcacccaaaaaaattttttggccagaaatttgaaatgcattttggaggggggggggg

SEQ ID NO: 43404 - DNA, 1139 bp, Heterodera glycines
agctgagagagacttccaacgaaggccaatcgtactacgaggagcaaaaaaagaggaccgacgggatccgagtcggttcatcagtttagggcagaaaaagcatggacgaacctcacatctggcataaaaaaatagttgcagggttttgttttagggaaaaaaaagttttcctgaagagatgatgaaaaaattaaaaattcaaacaatttctttttgaatatcacaccgttttaaacaactttggcatttttcccccggctttaccacattttttgtaggcaaattagtgacgaaatatcaataccatacaattttttcagaaattgttggagttttaccgcaaagagcgcgacatgttcacagagggactggagaaggcttccgtcaacgtggaggagttcaaatttccgaccgaaaatgttgaacaaatttttgacggacttttcgcattggaaatcaccggcaaacaaatgaaggccaattacgaaactacgaaggaggcgcagcgagagcatcagaagcaatccaatgccgaagcaatgcgcgcacaaaatttggtcaaggcaaagccaacaaaatgccaaagtggtgggttgacgagagtctcgaagcccgggtttttagtgtgcccgatgccgttccacccggaataaaagccgagaatttttgaattttaattgctttcatcatttagcgtccaaccaaaaagcgattcagtgctatttggacgaaatgactgagaaaggccaacaacagctgggccagggttggaaagcggacggaagtgccgagtgggtggataaaataaaatttgcgaaatatttttattgttttttccaggacatcgtccaatgttgacatgactgatggaggaaaagcgaaggtgagaaaaagggggcattggtaaattaaaatgcaaatggcacagagaatgtgtgccgtaagaaatcggaaaacggactcaaagaattccttaacttaaaactagggtaggtcgggactgggaattttgggcaaaaaccgggaccgagacttttcgagttggaaaaccgggactttttggctgggaaaaatcggaaaaaacccgggaattccccggtcaaaagcggggaattcggtactcagttgtccgtgttttg

SEQ ID NO: 43405 - DNA, 977 bp, Heterodera glycines
cccacccgtctgttccctgtccactgtttgttgttcaactccaataccaagtccccagttgcgtccttctcagcatgaaaatattcgctgatgtcttcgctcgaaggcacttctggcaatggcattagttcacaacccccaattgtgccattgtttcctgcgtctgaatcgcgcgcttttcccaaagtgaagcgactgccgggcgaagcggactcggaaatggacaaattctaaatcaaaaatttaaaaattatgtaatgttattgttgcaatgaccagttgatcggtgccaaagatcggcgcgttgtcattcacatccaaaatttcaacagtcagctgaaagagtcggaaggattgtgccaaaggcaacgacggcgccgaaggcgatgccattcgtttggtgacagccaatcgcgacacaaaaacaaactccaaaaaactttgctcatttttagcatcaattgggagagattctcgatcaattctctcggaagtgaacaaatcgccagacgaagcattaagcgaaacgagcgaagaataagccgaaggggagagatgccacggggaaaaggagggcggcagagaaggcagacggaggacggaggaaccgaaagggcactctgaggggaagaagggagggaggggtggccaaattggaccaaactgcgggaagaaaatgtacacggactgaccaaccttcgaccaattggacgtgcagagactgctcggaatagggggaggaagaagcggaggaagagaaggaagaagagagacaaaggaagaggaagaaggagaagaagaagagaaacatccgacgaaaaagggagggtcacataggcaggcgaagttggtggaagatgaagaataatgtgatgaatgaattaagtgctttgagtccgatgaactgttttgtcgaccgacggcgaagagtcagccgacgattcgctgatttctgtcagagattagcgctgttttgg

SEQ ID NO: 43406 - DNA, 1446 bp, Heterodera glycines
  misc_feature (16)..(16): n is a, c, g, or t
tgaggcacaaaaatanaggggaaaaccctaaagttcaaatcatatttcaggggctattgatgtgattgttgtggaacaacctgacggctcattggcctccactccatttcatgttcggttcggaaagtacggcgtgttcaactacgagaacaaagtcaatatttatagactaaaaaaaacatatacttacgcatttttcagtacgtcgacattgaaatcaacggggaagagattgacctgaaaatgaaattgggagagaacggagtcgcctttttcttggcaaatgacgaagagggaattggcgagacaaaaaacgcggagggaaaggtaaattgaaaaacttattttaaattggctaatgctttcgagaattaaattgctttttttggggagggggagggggtgaaaatggaaattcgaattttggcatgtttagaaaaagcaaactgttagtattttaagccataaaatcatcttttaggagtttttgagagaatcgcaaaacaaaaagtggagcgaagacacacaacagaacaatcggccgtcagcaattgacctggaaaaccaacggaaatgctcttttgcgagcagtagcagcagcaccagcagttgcacttcccaaccgcagcacaatgaatgcccaccaacggcgacgacaacagccgaaagaaagtgcgctttaaaacaatggaaaatggattaagttcacaaaagtaaaaacagcttataagaagcgtccggcggtgccggcgatttctgccggaatttctatggcttcagaatttgcaggcaatccgacgccgccaaagcggtcaaaaatgttcaatccgtcctttctcaaccacaaggcgtccgtccaacagaaccgtcagcgactgcctttttcgtcgtccatttattcgtgccgaaggaatcgctctttgcccgatttggccaatttgttgtcgccttcgtcgaacatctacgactctgaaactgttgctgaagaggaggggatgggccgacggaagggcacaatgagcagccgaatggacgagttgagaaagtcggacgggacgccggaggtcaacaacgccctgaagcattccaattccgcatcggtgccgttgaagagttattatgtgagtgagagggggacggactgaattcgaaacgcggcatttttgttttagaaacacgagtcagcaaaaactacccaattctcctcccctgacagtgacaagggacgggcagagggagaaaagggacagcgggcagaggacgacgagtcgaagagttgtgccccgtcgaccagcgaattggcggacggcgctttgtccgactcggaggtggacagacacggaagcattgtgagtagcattcggtttagtgggtagcatcggcagaacaaatttaacaggcaaatctgagagtgagagtttcaagaaataacgcaaaatgaagaat

SEQ ID NO: 43407 - DNA, 1498 bp, Heterodera glycines
ccccccccccccccccaactggctaattaaaacgcaacaatccttcgaaactgtgttttagagagacatgagaccaagtttgacttcttcttattgtgaataacggcatatcaagtcgagcatatggcagcccaaatgtcccaagcaccagacatcacggccaatacccggtatgaacgactgcgttaacacagactcatctcgcgcgaggcagtagaaagagcgcattggaacaaatcggtaaaaaaaaacaaacaaagatatggaataccactcggtggggagggtctcctttttcaaaaaaaaaaaaaattatttttttggtaattgcacgaaaatttacattctttcggcgtctaaccggaaattttgtgttcgcccatattcaatcatatggcactgatgcattccatttgattggctagatacccgacttactaggtaaattgggaatctaccaataaattgttgaatctgaaagtaggagacagcaatgtggggagtggttttgacgacgtggaaggacgatgtcgccaataatcaatcacaacacgtcgtgtcacggaggacggacaggaccaatgaacctactccacacggcataagccgagagaaaaaatcagctacttggacttcaccagcctctacccgtttaccaactttacgaccgactatccccctcggccaccctaaaatcatcagtgtcccacccaaatgagcagacggtcaactggcgctctccatccgacaacccctacaaaggtctgctcaaagtcttgcttctaccttcaaacaacaacatcaaagtcactgttatgcccgtaaaatttgatcaacgcctcctattcccactctgtgaaaagtgcgccaaacacatcactgcaaaatatcccaatggcctcaaggacaacatctactcctgcccacactacaacccaaatgaccgcgccttcgtgtccacttgcacccatcttgagttaaacgcagcattggaggccggctacacagtccgcaaagtcttccacgtcctccaatacgaccaatggagtaacaatgtcttcaagtcttacgtgagcgaaatgatggccataaaaatccacgcaaccgggttcccgtcgtggtgtgagagcgaagaggagaagagtgaatacattgaggagtgctggatgaaatttgcaattaaactcgacaaagaaaagatgaagtcggagcctgggaagcggtacatcgccaaactttgcctcaactcactctggggccgcttctccatgaggaatcttctctccaaggcggtaattaacaatgacccttgcgtcctccgccaatacactgacgacaagaaaattgacattatggacattgagctgatggatgaggacaacgcgtattcatactcacctacaagccgaaagaggagtttgtcgacgaaaataagtactcaaatgtcgtcatctcccaaagcactacatcaatggcgcgtctatacctttacgaagtg

SEQ ID NO: 43408 - DNA, 764 bp, Heterodera glycines
acacaagcaacaaacaattatctcattttccatataattatatgaatacactcgcgcaggcttatcaccccctccctttaccacacgttttgtcccccaaaaatagaaaagaaatatttcaattgtttttttcgttaatgttgaagttgtttgccgtttttgttcctcttgttcatgttggacctgttgcatttccggtacatcaacctttttgagatgtgtcgagacagaaccaattttcaaaatcctctcaactttgttaccttccctccatagtatgaaaaaattggacatttcattggaccataagtaaatgaaatgtttaaaaaaataataattaatgtaaagcgtttgtttggcccaaatattgaatcagggatgaacaaacaaattttctaatacagtcatttgagaataaacggcctaaatttgattccctggttaaatgatggttcagcatttctgttttccatcgaaaaaccatactttacccattaagcaccctccgccgactttttcctcaagagggtcgaattgttcattcggcacagatcacatttgttatatgtgtacttttgtttttgttttcctcaattttatttttttaacgtagacttcttcaaaaaacaccaatgaatcgttaaaacaatttttcgttgttttcccatgaattcacctaaaaagaagaggaataaatgttcatatatttgcaatttcttacatttgttaagtaaatgcatggatatttgcggcggttaaatctt

SEQ ID NO: 43409 - DNA, 698 bp, Heterodera glycines
cgtccctctacactctctcgaccccttttgtacggcttgaacttctgctcgctctgctcaccctggcactgctgctcttcctcaactcgcgccgtaacgaacttcttctccgcatggattttctggccatgctccgtgccatggaggtatgtctgcttgtcagtcctagggttgctgtcgccattcccgactgtcccacccactctcgacaccccattgtctcataatctcggcactgacataacattactctcttggccacacggagttttgattaacgtactctccaccccccccccccccctcgagactgatcactgatcagaaattgcccccgctgtttaggatgatcagcgcttgcagcggactgagtttctcaacgaccaaattcttcacaacggttggcatatcctttttcgcgtgtcctttgacagtttgccgcctccaaatttagctttgcccgcccacattgcgcttaattatgcgtcccgtactgaaccgttcgtgcatttgtgtccgtccgttggcgttttgtgcgctcgacttggccaagcgggcgattgggtgggcgaatttggtttcgatcggctgaaccgaattgtgtgcgacatggaccaaaggttggcacagttcagcgagcatcggctggagaaagtgcgaagtgcgcactccgtctacgtggtaagaaatgcctaacg

SEQ ID NO: 43410 - DNA, 907 bp, Heterodera glycines
tttttgtttttttattttgtcgactttttcaagaacatctcctccccgacatttttttgcaaatttttccggccatccccgacaaattttttgtcggggatttcctcctcggtcccagaatgatcatcggcttttcttggccacaccgaacagcaccagcagctgttgccacacctcaaccaccacaactgcggccaattcggcgcggatggcttttcccattgatttaatgtctcttccgctgttttcgtcagctgttggtggcttgacaatttgctgaaatgtgcttgatcatgatcacagccaaaaggaaaagcatttgccattgattgactcattccgttatgtgcttttccttccctccataaagcaaatcgataaaacatttttaaattaaataataatattttttaaaattaatcatttatattttttaaaacgatgactcgtaagcacagccttcgcagtcgcagcctcgatgtggtgaggatgagcttaatatttcaaaaaaagatacccagagatgggagggagttccgattttttatttaaaaaatggagaatttctcgagttaaggcccagaaaataaaggcgagacccctgggggccaggaccaaaaaaaaattctgagaaagttttctaagcttctattcatacattagaatgggaagaagttccaattatttttttggtgtcaaagttccaattacaacagtcaggatcaaaaaaaatgggaatttctcgagttaggtggcccaggaaattatagaggggcctaggggccgggcagcgggactaaaatgggaatttccgaacaaggttctaagaactattgcgtcttaggggtcagaatctgaaaacaaaaagggatttcacgaatttcggccaaggacaattgtgtccggg

SEQ ID NO: 43411 - DNA, 1347 bp, Heterodera glycines
atgctcgcgacggaagctaccactgaccatggtgtaatcctgaaatgaatgaaggcaattaaaaacgaagtgtgcgcataatttcagacaaaaacgcttaaaaatgcataggtaaacgaccgcctatttacataaattggctcaaaattccaaaaaatttgtcagcaccgcaaaaaaacaaacaatttttaatgattttttatttggaataattcaaaattctaattaccgcaaattataattttttatcggccaaatgctgattttataagcgggatagatacgtactacgtaccccgctcccaagaaagttttatgacaattttgattaaaaacatgcagcgcattttggtcattttctggacaagttagcaaataattggggctaaattatcaaaaatttatccggcgccgcctaaccatactcgtgatttttttgaacaaaacacagcacgaacatagatttgcgaaaagtaataaaaaaaaggtcgtatttcgagggttaatcccattaataaatgtgatggctgaccacccctcgctgactttgggttcgaatatggaacacctgcgcctaatactgtttttcaaaactgaaaataaaaaattatttttttcaatataacacactttgctgccatcgaaaatcgcatgcagaagcagtgcaccataaatgtcagccatcgtggctgctgcggcattcaatttctcacagagcagagaattctacaaaatgaaacaaaatttgaatactttaattaaaatggctttcccagtttaacggtcatattaacaaagaattgccgtccaaattctaaagtgccaaaaataataaaattaaaccattttccaagaggctaaaaataaaaaaaaattatcaatttaagaagaaaaaatatatacctaatgaccatattttaagaaatgtaaaataaaataaatgtaacatttttcaggaggatcaaaacaaaattaaataaatcattttcaaaaagtgattaatcatagaaaatttaaaatttttaaatttttcaaaacgtcccgctaccggcaggaaccagtcaaaaattaggacccagcgttccggacccgggatcctctactggtcccgatcaagttgctaaaaacaaaaaattttctcgatggcgcctaacggcaccgccgtgccaccattcaccgcaattttttttttttaatttgacccaccctaaaatcaaagatggtttttagcaaaaaacggaaagaaatttcaacgtttttccaggcgctgaaaatattaaaatagaactggtgaaaaaatttctaaaatatcgccagaacaaatcgtcgccgcacaatataaaaatt

SEQ ID NO: 43412 - DNA, 1333 bp, Heterodera glycines
  misc_feature (1170)..(1171): n is a, c, g, or t
catcaaactctcccaccggcgtaaaaatgatctgaccaatttaaaggctgcctcatgtatggcgaaagagtcgtcattccgaaaatttttcagcccaaaattctccgactttttcacaaggaccatccaggaatgaaacggatgaaacaactcgccgcccgacaatacatattctggccaaaattggaccaagaaattgaggaatttgttcaaaattgtgaaccatgtcaattggctgcaaaggcaccgatcaaaaccgatctccattcatggccaaaaccaactggcccgtggcaacgaattcacatcgactttgctgggccattcttcgcaaaacatttttaattgtcgttgattcattttccaaatacccggaggtatttgagatggccaattcaacagcatcggccacaatcgaaaaattgcgttatttatttacgcgccatggcatcccagaaacaattgtttctgacaatggcacgcaattttccagttcggaattcgccaaatttgttgcagccaacggcatcacacacttattttcggccccatataatccaatgtcaaatggacaagtggagagatttgtcgacacatttaagagagcattcagaaaattaaaaggggaggggaagccgaacaaggagatcattgacatttttctgatcacctatcggacgacaccaaatgattcacttccggatttgaagtgccctgctgaactgctactcggtcgaaggccaaggacaacgattgatctccttcggccaccgccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcacgacggatcattcggccgttttcacgccaatcaactgcgctacaggaaaacagccgacaattttgatcagtccttggccatattaaatgaggcatttgagttgccatttcctccggccctgcccaatcaaccacccgacgcagaaaatgccaatttagggcccaatcaattgtaaaacgaggtggcagaacccattcagggacaatttggctgctccnnattgaggacgtcccaaattcaacgacgctatcctcaacgccaacgtcgtaaaccgaaccgcttttcaccggggcatgaactgatcagcctaaaggggaggggtcgggcaggcacattttccccccgattattatttccctttctcatttgcatcactggttt

SEQ ID NO: 43413 - DNA, 942 bp, Heterodera glycines
aaaaccccaaaaatgggatgcccggaaaatagggaagacaacgaatacaaaaaaaaacctcaaagggaccaaaatttttatcaaagaaaatggggattgaaatgatccaaaaacggagagaggttaaatgtagagtagagcgggaccgggaccaaaacacggacaactgagtacaactgagtaccgaggtcccggttttgaccgggaccagtcccgggttttcccagccaaaaattcccgggttttcaacccgaaaaggtcccggtcccggttaagcccaaaattcccggtcccgctctactctagttaaatgcttcggcagtatatgagtaaaagttaaaaatgtggagaaaatgagcaaaatgaataagcaaaaaaaaaaaaatctttggaaatttaattgagtgcataactcttctgagatacgaaagcaaaaattaaggaacagtgaacggtaaaactaagtgtttgatttgatttcgaccgaagtctatcgatgggaggtgaatcaaataagggaaaatgagaagggctcaaaaaaaagtagaggaatttggcttcgaccgtatatgaattcaaataaaatttgggattatcaaaacaaaagttataattttgtgactcaattatctggaaaaattatttagaaaatttggaatatgcttcggcagttttaaagtcaaaaaaaatcaagcaaattcgaaatctttgacaatcttaagaaaaacggctgaatacagtattccattgactacggtaggaaaatgtcttagcaaactgtttttggtcaaagtccgtcataggtgtaaaattgacggatgctaaacggaacggagagaacgctgccatttccactgcccttgccactctccctttgctttcgtccctcttctgtgtccctgcctttctcaccgctatttgttctcccccccccccggcgat

SEQ ID NO: 43414 - DNA, 823 bp, Heterodera glycines
tgatgctgtaatgtaaaatcgtattacaatagccgtcgtccggcgtataatttctcgagtaaatgtcaattcctgtggagttgcactactgtagcgatggacagcgacggccaccaaatattcgtcgtccaaaataagtgagaaatccttcggatggagcttcagccttaattttgaatttttgtattaagcctagaattactaaatgccaataaaaaattaacaatttcgaaattcgccgaccggttaatggctttgcgcagaatgaggaaaacgcactttgtttgtccgttcgaaattcacgccatttcattttggacttggcgcgattcaattaagcgtaggtcgaaaggagaagagtgaagaaagaggatcaccgcctcgctgttaccgaactcattccttaatataagacatttagattaattaattatttcagaaagtccaataaaaaaaatatttttagaaaaatttttataaataaaagaaagtttggctaatgcatagtcaatcatccaaaaaaccaagtaatgataatgccaatggattcgctcctcgaggagatgagcgattgttaaattatcacattggcaaattctatcaaaataaactgacaaatggattcgatatccggcaataaatcaaggaacttttcgttttatttcgaccctaccaaaaaatatctatggtagttttatgtgctatatggtcaataaataaattataatctttgcttttaccatgccatgtgcagtgtcttgggcaccattgtgtccgtgtgattaggcggaagcgcccgaggcgtaatgtcggcattggccat

SEQ ID NO: 43415 - DNA, 744 bp, Heterodera glycines
atttaattaaaaagagccccgagcttttcttaatttgtcattttgtttatagataataagtattattatgcgttcctctttttttatatacacaaattgtgcgttccttttcaatgtaaaaaaaactaatttttctgcccatgggcaaaaaaatatcgatttaaaattttcaaatatttaaatagttattttataattatatgatacatttcaaaaatcgttaaggaattaaaaaaaaacaacaaaaattgttgagccatggaaaatgcggacgaaaagccgccgccggtgaccagcagcggcggcaccaatgccgccgccgccaccgctgcgttagcaatgcaaaaaattgtccaacaacacgcagcaaccatcgcgaaccaagtgcagcaacagcagcagcaacaaacaggcacagaatacaaacaaacaaatgcatattttgggagacaaattatggaaaaatatcatgtgtacttgccggaaaaatgggtacttccgtgttttttgctggtacttgtgggttttgtgtcaacaaaaaattttttgttgttaaattttatttgaaatttataaaaagttgtttctattggttatcggtgtcgtagaatccgaaatctgatatccattacgacccataacccggatttggaggcatataagcgacgatgatgtaaaatgctttcccacttcattgcagactatttccttatcagcaaatagcctcctgtctccgcccacacc

SEQ ID NO: 43416 - DNA, 1250 bp, Heterodera glycines
attagccataagaaatttcaaaaacgaaaaatattttcggtgagtaggacggattggctatttcaaattaaaaaattcacaattttccaatttttgacgttttaactcacccttttgtccatcattttaatttggcacgatggcattggcacctccgccggctccacttgaatttgtgccattgctttgtgacgaatttgggcaacggacgtgcgacaattcttcggatttggcgtcatagacggcgaaaatgccttgccactatccaacacttcgaaactgttaaacgaatggtaaaaattcgatatatttgtttgcccactccccctttttttaaagtcatgaaaatgtcgctgatcacgaatcgaacatcgttgccgaattcaaacagaagtcgaagagtcaactttttcaaatccaattttaaaagtcaaaccgttttacataaatgaaatgctttttctcgagttcctttccgaggtttgaaattgaccgaaatgagtgttatattcatgatcagcgacccagaaaactcccgggagtgttttcgtggctttttaaaacaacattttgtgaaaatagggcaggggacgacaaaccacctgttaccaaaatgtcggtatttcctgttttccgaccctccactgattaatccgaccctaaaacattgttggcacttcttttttgccaaaagttaatcggattgaatggaatcattctgctgcgttttgcattattcccttgctttttttgtttctcacctcccctgcatattcggctgttgtctctccgctgtgtgcttttgctgttccttttccatttgttggtgcccattttggatgtcaatctgtcaattttgaaatgccacccctttctccgctggtgccaactccgttcgttttcatccgtgacgatttcgccgtcgtcggctcttccgtcggcagaattcgcgcagagctttcacatgaattgcccaatttgttggtggcacggacggtcagcagagcgagagagactctgccacagttcttttgcaacgccgcgggcaacacgagacgactcagccattcgccggacgaagacaaagagtcgatgatttggacaccgtcgccaccgccctggggttattttgtaggaaccatttattatgggagaaaggaatggtctaaacagtttcgtacatcgaatgtgtgagcggaggcaatggaaaacggagaaaattatttcaaaaaaccaaaatcgaaaattca

SEQ ID NO: 43417 - DNA, 1182 bp, Heterodera glycines
  misc_feature (5)..(6): n is a, c, g, or t
ctatnntatttggtacaatttgctcaatattatactgtacattagacagtaattatctgaatttttgactaacaatctcccgttttcttttactccaaacaattgatttattaattgccctaaaattaaaaatgatttatactgaatttttcttaataccagatccatttggggcagcatacgtagttataatcaaagagatttcctcattcaataaatcaatttcactaaaactctgttgtatgtggtaaaaagattccaaaactacatctgcgttattttgtaccaaatccctaggcggaattattagcggatcactcagagcttcacaatataaatcatacgaaattttttctattacccaacccttttcatttttttccattgctttatctgttaaatattcaataatttttttgaaattttcttttgaattttcttcggaatttttaaatataaatcttataacattttctttgatgccaaatttcttgttttctttttgggtgtttgctaattccgtataataactatcatttggaatattttttttattactgaaataattttttttatttctcaattgtcgtttttcttttggggttttcaaaaaggattttccctccatttttaaacaaaaataaatgatctaaatgaaaacaaaataattattgattttgatatattaagatatttaaagattttccaattaaaacactcactaaactcagaataaaaaatgaaaatattacaaaatattaaatttcaacaaaacataattcagatcacaagaccataaatccgctaattctcaaaattatgctccaactcccggaggtggcggctgtggaggatcttggttgttgcggcgcattggcggctcattttcctccggaatgagatgaagcatttgccgatttcgctttcggcgagggtccctcagcgccactaaatgtaaatcaaaagaataaaattgatttttttttcacacccccaggcgtgggaggacgaattggagcccaacgctgcggccgaatttgtccatgttgtggctgttgggccaaacatttggagccacaaaagcatccgccaaatcggggtgacgaggtgggtggttttgaatttgatgtagtggaattggtcgaaatggaattccctaaaataaattttcaacttgaataa

SEQ ID NO: 43418 - DNA, 958 bp, Heterodera glycines
agttgagagagtatgcgcattacctgtgttaactgatggtatgatccataagaaattgttcgacattccgtcacttgacggttttgaacgtctgaaaaatcgtccgaggaatttgcttaagcttatgtcacacaaagtgccgatcaaaaacctgccaacttcgcctaaactcatcgacgaaattgtttgtcggaattcctctcaattaattttaaaatttaattttaagatcgcctttttcaaccagccaaaaagtttctatttttcgcataatttcgacataactaaaacattgcaacagaggtacgctattgggctgttttgttactcactttcaccttccatttttagtggctgtcttggttcttccacttctgacaatcgctttttttggaacaaaaatttgctgaatgaaatgttcgtcaacgacggttcgccaattcctgcattcaaagaatggataactccgctcatttacggattcatcgagcacaaatcaattgtattcgatgtggacattcgtgctcacatgacgctgatttcgagacgttcagtcaaacgggcgggtgttcgatatctgaggagaggcattgacgaggacggcgatgttgccaattttgtagagacggaattcatcgtttgcgtgtttggccattgcctttcgtttgtccaggttcaatttccctcccccttcccgctaattcttaaccattcacttttcagtgtcgtggctctgtgccggtgttttggagtcaaaagggttttcagcttaagcctcctttggtaatcgaccggccgttggacatttccctccccatttttgcttctcatataaaccgtctgatctccaattacggaactccgcttgtgctggtgaatttggttgatcaatcgggaaaagaagcttctcttggagaagtgtattgcagggaatcgcaagaccgcaggcagcaagctg

SEQ ID NO: 43419 - DNA, 1210 bp, Heterodera glycines
cccctttcggggaaggacaagcacgctgattttcccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacagtaccatcgaaagttgataaggcagacact

SEQ ID NO: 43420 - DNA, 307 bp, Heterodera glycines
tttaatcatttcacgtgaggtaaaaaaagaatacaaacctatacaaaagaagggtattattgatgccaatttaaacgtactaccctttgggtatatttgagtagaataaatatattttcttgtcgttacttaaatcaatgagttgttttactttttacctcaatgtttcgaaatcaatataaaaatatcaggttttatgtacctttgcaacaattatactcttgatggagaatatgaggcaactcaaaataacgaaaaatatatgataacaacattcggggtctttatttatttaacttttataatt

SEQ ID NO: 43421 - DNA, 1386 bp, Heterodera glycines
tcgcttcagctcgtcaaaatatttctgactgctttcatcggcgaacacgtggttgatgatcacggaacactttcagaccaaacggaggcaacttccgcactgtccgctgtgtcgggctcgaaattcaccaaaatcttcttggcaagcccgtacatgttttctatatcctcgtcggtctccaaatgctcatcgcgctcatttgaagaattgtttaacgtcttccaatgcccgcaaattgttccgagttctttgatcgtatccttcaaaaattactattggaaatatcctttatttttatgtagacattggggggggggggcgtcacaaatacatcgctttacttctggtgcatatttttatacgcatattttgcaattttatgtgcatattttttcgaaccctaatcattacttattttatatacaaaacgaatttagaaatcaaacggttgtattagtgtttaaatttttcgaatgaattttatattgaatgtttacgacagccaactcataaggtaaataattgccaaaaccacgtgggtaccacttaatgtattacccaacaattcgtgggtttgttttcgagcccggattggaccggggccccgccgggatttggcatatgctctaataactcgaaaatagcttaacaatcccccaaaaaacttggttttcgtgcattttaagccactggagctcagaaaaaataagctaaaacctaaaaatatttaaatttagggtcatttttaggcggtgtgttttacggttttgatgcatttttgttaataagttttgggcaaaacgccatgcttttccaaaaatacttgtacttactttaattgccgctctattcttcaagttttgaagccgatcacccaaaatttctcggacagcttttgcctcctcagtgtcattttttccttttgagtttttcccttgggccttctccccaattttttgaatatcctccgacaaatttccaccatattgttcagaataaacctccaaaacttctgtcatttcttcgtcagaactgcccaaaattacttccaacaaaatctccatttctgacacctgagcatgaaaagggcaacaaataaaaattttattcgcctctcaaatggacaattttccgatttaggctaaattttcgaaaatttattcaaaatcataaataatatggtaatccataaattttttcctggaatgtgggaggaaaaaacatgtttttaccttcgtttgatgcttcaaacatgggtttctatatccatatttcgtgttttatgtccatgttttggcattttgtccatatttatatcggtgctgtgacgaagtgtcagaggtatcgatgtggaagtatccatgtgggccaagtgtcaaaagtatg

SEQ ID NO: 43422 - DNA, 1201 bp, Heterodera glycines
  misc_feature (136)..(136): n is a, c, g, or t
ccaataccataatccttttaccgactgtctgctgctactgtgtcatctcgtccttttcttttttcttcgctttggtcaatccgttcaaaaatttgagtgtctctttttcattttgtttcttttttgtaatattttnaagaattcatttgctttatccccgcagtgaaaggcttaacgcaaacaaaaacggatcgccggtctgatgcgctgccaaaagtgtccctttgacattcacttacgcattttcacacttttaattatgcttttcgtttcattggctaattaattattccattaatggcaattggataaattgagcttggccttctccgccatttcattggttttttttgcgtttttttcatttctaagagacgaaggagtgattttgctaatcagcacaatgtgccaaccattgctcacttctccattttgaagaaatgttaaaaattaaagagaaatgcccaaaaatcagtttttctccactcatcaataaatctgtcgagaattactactacaattaagcaatcttcatgctgtcttttatcagtcgttctgttcgtgtccccatttggggcattccctccccctccttttcttccctttccccccttatcaccgcttcgttctccgttcgtctcgtctccccccccctttccattcatatttctgcaaattcatttcattggaccatttttttgcctggatccaacattaaaaacaatggcaaatcgaagtttgtccgcgtccattgagccattggtgctaaaatcagcggacactgacaatgaaagcgtattggaatcaattgaaaacggcactcgatgtcaaaggtcagttgtgattttggcattttaatttggcactttctaaagcattcggaatgccaatgccaaggcactcttcgcttttctgctttctcttgtgctactttccctcggcggtgttctgctcattttgttagcccacgccccaaatcagaactaattggtaatttctatcaattttagtctcctcccttctctcatcaatttgctaattcaattctgccaatttaaacagcaaattaattatccaattagcgaattaattaatgagacgaaaattcgccaacaattcgaagaatttgaacaaaagtaataattagcagaaaaccaaagtgaaaatgaaaatgaaaagttaagctttgcaagataaatgg

SEQ ID NO: 43423 - DNA, 992 bp, Heterodera glycines
acacaccgtttcaattttggcctcccagttcaaaaaagatttgcatgtgtggctcagtggtttttgtaagatagtaaagggacaaagggtggtggttcgagtccgttgtgcaacatgaatatttttatttatttttgtccaaaatattataaaatgacgatttttgggaattatttttgaagctttttgctaaccaaattggatgcttttggtatcattcgaaagctcttgttaaggagaagctttttctaagcaaaagctaaacatttggatgcattagaaaaaagttataagcactcgaaattttgttttttgaataattttagatcggagcgtaaaaaattaaaactcgagcgttaaaaatattcataatatttttctctttcaatatgcaaaatttgaagtggatttaacaagcagaaaaaaagttaaacaggatgaagtaaattccgtttttctctattaacacagataaagaaatagtatgccaaaaagagagatgtttttttctctgcgctctctctttattggttcatctctcgttttttgaaacggtgtgtagaactataacaaacttctcaattctttttttttcaaagaaaattcggcgctatatggaaagtggccctttttgaaaattttgtaaaaaagtcatgaaaatacatttcattatattttcagaaatgcatatctgtgatatgacattatttactctaatatattttttctcacacgattacctacttaaagagaatttctctcattttgttcatttttaatgagaatttcagaacgactttaaagcgttagacagtgccatcgatcaagaaagaaaatcgccacgagcacctttctgcacatcgctaatcgattaaaaatttggacattgcctttgcctctgcctcttccgttctcttttctatcaaggttttcgctttttcctttcgctgggccgggcatggtcccattctgtcgattcttttccctctttt

SEQ ID NO: 43424 - DNA, 1581 bp, Heterodera glycines
ccattctcaacgaatctcatccttactccttcttcccgcctaataagtttccaaaatttggtctcaaaacttcacgcaaaccttcaacaaagtcctcgtgaccaacatttgcattgcgaatttgctgctgttcggcaccattgttaccaccaccgtttgctcgcggcggcaaattcgattggatggacacatgcagaaggcgccgccgaatttcatcgtcatttgctgctgctgcttccatttcactaaaatggtgttcgttttcctccgccgacaaactcaaatttcggttaagtcctggcgagatcggagcgttaaccaatggttcattttcaccatgaactccttcaacctgttgttgttgctgctgctcttcaaccgctgcgttttggttttgcgcaaaggttcgcaaattcaacgctctttgtcgtgtcaatggcggagagcgaattatcatttttgcatctggctcaggtatagcaaaaacaaaacaaaagtttccgctgtcgacacttttccactttttcgtttgatggcgtggcgattaggacggcgaatgcgatagttcggctcgaatttgttgcaatttgaaaacgttcgactcgaatcgttttgttgccctttatcctgtctcaggatttttaactccacttcttttcaacttcaactccaactcttttcttcaacttcactccaacttcttttcttcaaattttgaaatttgccctggctcagggtcaattcaattccgttgattttgttgtccggttcggacttcaaacaaaactacctaattccgatctcacctttccccgtttacctgctgttcctcaggagcgccaaataggaagaaaaccgttttccttcaattgaattggggggtggagaccaaacacacgaagacaaagccacacacaatatttatttttgaagtccgaggagatcaccaatgtgaagcaaattgagaacgaaatttagagaggaaattttggaaaacaaattaatgagaataatgagaagtgaaaaaaaatgtaccaaacataaattaaagaggtcaacaaacataaaataaatagagataaaatgccataataattttaaattaaaacaaatatcttaattaaattaaaatctccaacaacagggcaaagatgttctgcactacttttgctagtactgaaaattttacttactcaaaaattagcccaaaagacaaatacaaaaaagaaacataaatagttaaaaatcgaaaaaagaacgaatcattaacagggctgccaaaaaatgcacgaaaaatgaccaaaatatgcacataaatatgcaaataaaattgccaaatatgcatcaaatatgcacaaaaatcgtcaaatatgcacgaaatatgcattaaaaaattgaaaattaggggtgcaaattcaacaaaaaaaaatttttcacttgtgcacttgccaatgagctgctacatttcttttataaaattctcgttagcaaatttgacattttttaatcaaaaatcttcccatgggaaaaaaatttggggggaagaattttgagaaaattccaattcttagtgttgtgttt

SEQ ID NO: 43425 - DNA, 525 bp, Heterodera glycines
  misc_feature (473)..(473): n is a, c, g, or t
tttaaaaattccctcaaaaataaaaggtctattgcctctctcccgccctatcatgctcgagagcatttgtatgtgtacctttttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaanagagatagccattttttctggatagagtataaatttaaaaatttcctccaaa

SEQ ID NO: 43426 - DNA, 1186 bp, Heterodera glycines
catttaaagcgtttccatgactcaacgacaaaagcatctattcggttatttctatcttatacagtaaccattagcgtgttcctccacaccgtacctttttccggtgtctctaccgtatattatttattcactgctcacctttcgtttctccatcgtttcgctttgccattgattttgcccattttccgatggttcgcaaatgccaaattcaacaattgtgttcatcgaatccgtcgttgacgtgttgtccgcttcgtcgtcttcttcgtcttcttcatctttaattatttaaaattacaaaatgtcaattcaaatttaaatatttaaatttttcccacctttccctccctcataatccgtccgtccccactctctgctgaactgctcgccaatttccaatccctcggccaatttggccataaatttctctaccgtattaccggtgttgtttctattttttacggtagtaaacggaggaatgccaaaacgaagggaggccaacacttcggcacattcaaaaggaaattgaacgcacgaagcagtggaagcggaaaagacagaaagttcgagcagtgccaactgtttccttctaaaacgaagagacaaatgaagcaaaatgaggtgattagtgttaagcaaatgctaaattaatgaccggcaacggacacccattgaacgcgcaaagtgcgcgtgcgccgcgtggtgctgcgcgtacgcgcgggggacgcaacgaaacgaaagaacggcgaacgacgcgtggggacgaaaaagtggcatcatctaattaattcattattgcctttttatgactggactaatgaccatcactcatccccctcctccccccgccccgtaccccgcgcaattattcacgccgacccctcccgaggccgggcgactacctcccaccgacggacgcaccccgaggaaaccacacgacaaagggaacggggccggggtggaaggttaactgacgaaaaataaaaaaaaaaaaaaaaaattttaaaacgggaaaaaatttttttaaaagaaaaaaaaaagggaaaacctcttccttaaaaaattttagaaaaaaaaaacttcaaaatgttttttttttttttcttgttgacaaaaacaaccgaaaaaaaaaaaaaaaacccagaaaaaaaaaaaaaaaaaaaaaaaaaaaaaaaaaaaaaaaaaa

SEQ ID NO: 43427 - DNA, 733 bp, Heterodera glycines
  misc_feature (33)..(33): n is a, c, g, or t
ataaatattaaggattgaacttcttctaaattntggttaaatatggaatgaacaaaacaaatatttaaataattgtatgtataaaaatctgagaaatgattgtatttatgcagtaataaatttgcaaaattttaatatatacttcggtaaattctaaaacgaaaaaacaatattttaattaatttttttctgaaatattcaaattacctgattaaataatctatgaaataatttaaaaaataagaatatttagcaaaatcaaaaaatggcaagatagaggtaaatataataagatatcacagccaataattaatccttatacagaaataattagattttaaaatggaatattttggatattttacaaattaatttaatcaaataaaaatacgcaaacattttttttattattttaagcagtcggtatcttgaattcaagggctttcactgattgttgcaattgtaatttggtaatatttcaatttaactagaatttatgcatcgaattattcaatgaattaacgaccaatttgtataggaatatctacaatagactataataataaataaaaataagaatttatcggttacatgataattttaattaaaaaaattaaaaaaccatcatacagcattatttacaataagcccctaatggccacacaagtggaacccgaggctggacaagttctctgatcaagaaagaaaataaataaatattggttgttacaaa

SEQ ID NO: 43428 - DNA, 1230 bp, Heterodera glycines
gaagaggaggggaaaggtgaaaaaattaatttaaaaacatttaaaaaaataaatattttaggcgccagtgaaatgaacaaaggcaaaagcatcgttatggctgactccaaaaaggaaggtgaaaatattgttaattaattattaaaattatatttttaactgaaggcacaacgacagtgaaaattccgcaccgttatggagcagtgtcggggatgagtggccaaaatgccagtccaaaagcctctcaaattggcagtccaaaaaacagtccaaagggcactcaaattggcagtccaagatccattagcagtcctaaatcaacacaaattggaagcccaaaaggcattcaaattggcagtccacgaaaagaaaagaccaaattatcttcagctgttggctcttctgatttcaatgttatcgacgaatgtaagaagtcataattgaagacaattccaacattttaattaataatttagcaaaagaagcgaaaaaaccaagccaattcaaaccgagtccgtccagaagccaaaataaacgcgaacagcagcgactcaatgttactattggagaagcgggaagaggtaattaatgaaataattattaattgttctttgttatggcctaacgacatatttgggaacgtttatttaaaaaataaaaaaaactcaaagttcaccgctaatgccaatctcagacgctatgtttattatgattgattagggctggtaattaaatggaaatccattttctttttctggactattggaggcctgaaaggaacaaaacaacattttttgtcttggtttgaagcttctaggatagatttctatatccatattttttcatatttcgcgatttataatccatattgggtatttttccaccaaaaaacctccattagaacggccctcatcagcaaaaatggccttttgacccataaagatgagaaaaatttccgttattttttagtaaactttctcgagaatattgtttaaatttaaatttttcgcaaaaatggaaatttgtgtcaaaaataagtaaaaaagtggaaaatttcatttttttttcgtttagttttcactaaatttatatttatttgtctttttttcttcttcaattatttttaataccgtagtcatctatttttaatgacttaaatttaatgatttttgaagaaatttgaaaaatattcaatgaaaaattatgtccatattttgcaattttatatca

SEQ ID NO: 43429 - DNA, 725 bp, Heterodera glycines
  misc_feature (681)..(681): n is a, c, g, or t
ggcaagccatttgaacggcgaaaagcagcgcaaggccctagcccacggaatgtgccggatgggagttgagttgggcacgggacagaaccatttgagcatccaccgcaagaccaacatactgtggaagaggggattacgatataagaagggtgatcgttatcactgattgtgagacatttgcctgagaatcgatgatcaagaggcctttttctcctccatttgatttcaaaattacccacaattaaaaaggtcgtggccataaactcgcacaacaacttgcgcatgagctcgttctgtattcgcgacctctctttccatttctgcatattcattcctttttaattgtcgattaatccttctgtgaattttatttatctgattcgattatttatttaaaaaaaacataaactgaaaatttgaataagacagatgttgttgtttattggttttaaattttttgaaaatgtaaaaaatttatgtctgattttgtgttgaaagagtgcgaatgctctctttaaaaaataatgctgattaacgtctgttttaaaatcagttaagagagactaattggaatttgatatcactgtccaaatctgctgatggccctttttcattgggtcgaaggacggaaagggggagaatggggaggggggtggggacccttttctccactgcgacganaggtccttttcttttctctcgcttctgacattcgatttatcact

SEQ ID NO: 43430 - DNA, 1395 bp, Heterodera glycines
aggaaatagtgccaagggaaaggaaagaatgccaagtgcatttgaaagaatgccaaggaaaaggaaagagtgccaaggaaaaggaaagagtgccaagggcgaggaaagagtggagtgcctgagagagagatatcaaatgggaaagaaagtaaaaaagagtgattgcaagggatggacattaacttttaatggacccgcctgcctcatttgccgcttttctctaaaaatgattcccttttgtacagtgtgccaacacagaagataaaatctattctgaatgggactgtccccaggcgttggctgtgcataattatgccattcaacaggaggacgaattgagcctaagcaaaggcgacgtggtgaacattttgcggaaaatgaccgacggatggttttacggtgaacgaacgcgcgacgcacaaatgggatggtttccctcttcgtatgttcagcaggtcgcactttttaattcaaatccattaaaattcatcgtttttttaatttaaattttaaaaggtccaaggccagcaaagagttttgcttttaaggtgctgaacgaccacaacaaggccaacagtttcagacagaagctgagcctcgtccagcagcgttcctccgccggcgatgcgaatgtgttcagacgcggctcctccctgcaggcgatagcccacgacggaggcgagctgtccttctcccatcctccgcaccaacgcgaccacccgccgtcgatgagtcggttgagacgcatgagcagtcccttcggcgtgctttcccgtgacgcataaatggcgcattggcaacggagttatcccattctttgacggcgtcgttaatcatttcccccttccccttcccttcatcagatgccccttttaaatatgcttttctcagtttctcataatgttcccgttcccattgtttctttgtaaatattattctaaaatacaaatgctcacttcattttatttacaattcgtttttgtatcgactcatttttttatattttctgtaggagtgccgaagaagttagatagtttatttattcaaaaataaaaataaccaaaagaagggcatccgatggaatggaaattataaaaaatatacctaaccttacttttgaagtttgaagttcttttataatgtataaggcttaaatttttaggtgtaaaaactgtcaaaaaaaagttaattttaggttctaaaaaagcccaggtgcttgggaaaataggtgccaaaaagtcaaattttaggcgtgtaaagtcataaaattttatccaaaaaccaacctgggtgcgagtttgattttgtcgtttattgcagcgtttcaagctggaggagttcgtgggacaattgtgagtttgattatccatcctactaattttcggccaaacgtgt

SEQ ID NO: 43431 - DNA, 1307 bp, Heterodera glycines
cctcacgcgcacccgcggggcctgcagaacgttcagctttcctacagcttccgataggcctcccgatgttcgagcttggcttttgtactcgcccgaatcgtcgatggaagtgtcaaaaatgcgcaaagtgccgttgttaccgaaagtgtactgaaacgggcgaatgccaaaaggaagttaatgagatggccattcaaaaccaattaaaaagggaaatgtttaaggaagaatgtgattaaggattcttggattgactgggctcaaaaatattttcttaaaaagcgagcaatcgtattaattgctgcgttttaaattatgctcatcgaattacagaagtccaatcgaaagatacagtatccccgcgccttttacaaaagcaatgaaaaacaaaagcaaaaaaagcacagctttggccgaattgcccacggctttgctttggttgtgcagccaagtgattttcgcttgctcaatgctttgggtgcggcagtggagaaaagcggtgccgtggatggccacggattcgttgcgaattgcgacaatgtgcggcggaggctctgaacggagtttaatgaccggtgttaagcaatcggcaaaatcaatcacctcgagaatccaaaaaggtaagagccgagtgattgccctggggactgaccacctgaaaataaaattaaactatcaaacggacataatctgctgtcattcgttcctcacttggcacgtgtacaatccgcggtgctttggcgtaaccgcgtcaattgtccaaagggaagtgtcggtggaactgttcgcaaaatggcaacatttcgccggtattatgccgactgtggcggctttttgccactttcttactcataaaagaggggccctccgatggtttttccctcgaaaagccaaaaaacagtgaatgggacgcgtgactcgactgagcagctcaaattggctgctttgtacgcgtgtgccgtgtgcctttcggccataaaagcgcgcggtccgaccgcctcaacggcggaaattgccgtcggagcaatgcgtacgaattcgtaattctgaatgggacgcacttctttcgctgattggaacatttcttggccaccttttcgtcctctccgttgacgcggacaaagaaaaaaccctccgggggaataaaagggcccacgaaaaagacggaaagactgtgcgggtccgcctgactttcgttcctgtacagctccttcccgtggtaatcgaccgaatgaaatttgcacgaccgttccgggcggactaagcccaatgagaggaaaattggaataagcatcaaattagcagaa

SEQ ID NO: 43432 - DNA, 902 bp, Heterodera glycines
ttttgagaatttataattgaaaaatttgcatttgtatccctaaaaaaattcttcaaataaaagaggtaacacataccaattttgatacgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagtcaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgccgaaaaggccggcgccgaagtgggcggttcccttttgatactacctaaaacattcaattcattgcatcccaattaacaaaggcattctttcaacgaattcgttctatggactttttagacacctatcctaacaattttcatcgttaattaccagtttctcgcttcattttataaatgcctcttcttgatgtgcccaatttgttggcaacttcactttcaatagttgttacacttttatttctgttttttcttatacactcttttctcatctgatcaaattctttgattttctttatttttgtctcgtcattttcttccaattttcgatgatttgcttagccatttattttttaaattattattattattattattttaaatatttacccatttcctttttccatttgtatatttttttgcgtgatattccccaactttttcgccaatttgttcctcaatgt

SEQ ID NO: 43433 - DNA, 842 bp, Heterodera glycines
ccatttttctgataattaattcacaatttccgcagctcttatggtaatggaaaaaattttgaagaggctctccggaacggattatcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggcaatggaaaaaattttgaagaggctctccgaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttagggtaaggaaaaaattttgaagaggctctcccggacggattagcatcggggttacgagatagaaaattgtcctaaaaagagatagccatttttctgagaattaattcacaatttccgcagctctttagggaatggaaaaattttgaagaaggtctcccgaacggattaacatccgggttacgagatagaaaaatcttaaaagaaaaccaattttcttgaaaataattcacaatttccgcacctcttccgtaatggaaaaaattttgaaaaggttctccggaacggattaacatctggg

SEQ ID NO: 43434 - DNA, 1075 bp, Heterodera glycines
  misc_feature (965)..(966): n is a, c, g, or t
  misc_feature (997)..(997): n is a, c, g, or t
  misc_feature (1014)..(1014): n is a, c, g, or t
  misc_feature (1036)..(1036): n is a, c, g, or t
aaagtttaggcttaacttttttttcagaaactgatccgtagaaggccaaactttgcagggatactgaaaggaagagaactaacctattttaaatattatctagtcagttcatttaaataatttttatccaaaaaaaatttttttttggatttcggggcagtaccctgaaccgatgcgccagatttatggggagaccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaattgctctgaaacgcaccaaattttatttacatgttagtttaggcactctgatgctttttctatcgaaaagggagatgaataaaatttttaaaaatttttaattcctttttaaacaggccaaaaagtttaggcttaactnnttttttcagaaactgatcagaagcgccccanactttgcagggatactngaaggaaaagaattaacctgtnttatcacattagcttgtcatcagtttttataaaaaattt

SEQ ID NO: 43435 - DNA, 831 bp, Heterodera glycines
caccagctccatgttctgtgccacccgaatgccaaaacatgccgggttgagtgcatagccgtaatagtagaggaagtaatggactgaaaaaggcttaatttggtcttttaatagggatgcaaaaatcacatagaatgccaagcggcctccggccaagcaaagtggcacaatcagtcaacttgggcaaacccttgtcaaagcgaatgttctgaaagaaaataaataatatcagtcaattaacaaatgataaatgcttgttggtaattctatgggaaataatgattttgtcaaaggcaaattcggagcggaggagtagcaataagtctcgcggaaagaattttttttttttgaatttagtgccatttttttgtgccatattttaagcacaaaatgttttgcatgtaaagtatgcccatcagtacctaatgctgtcaaattcatatcagtccggaggatgcacttctcattggtcatcaatttagtattctcaactgactctcaaaattcatttaaagtggtttagtaatatttattagtatccattttgtccatccaatgtccacctccacaccaccaccacatgcctctaggaagtaaacgagcatcaccaccaacgcgtacgatggcagtcccccgttgaacgggttgttcaagttgttctgggtgagcaactgcttcaacagcaacagcaatggttccagcagtggcaactcgttcagtttccgtctgatccatttaacggtgtccgccacatggttcaagttgaagctgacatcgatgctcagttgggtctgccggtccgtgaatttgacaattggaacggctgcaaaa

SEQ ID NO: 43436 - DNA, 729 bp, Heterodera glycines
tggtataaatttcaaataaatctcataaaattctcccgattttttgctatttttaaagctttaattcacttaaattgaccagtccttcattgagttatgaattttcaaaatttaacccaaatttccaaagaccaaaaaaattaaaaatattttcgaatttctaaaaaattccaaaaattatgaaacttaaaatagacatcatattcgtactcagcacctcaaaataccccagaaaaatatttttcacacactttttcgaccccaaaaaaatttttgaaaatttctagggggcctagctcgaaaatttttgaaaattttacatcatgtagtacaccattcgatagcatttaaaatgctctacaaaaatgttctaagacaatttttcgctaaaatcaacccctgacgagttatgggcccaggactcaaatgtcccgctacaatggtgattagaagaggtacaacggtgatttgaagaggtacaatggtgattagaagaggtacaatggtgattagaagaggtacaatggtgattagaagaggtacaatggtgattagaagaggtacaatggtgattagaagaggtacaactgtgattagaagaggtacaacagtgattagaagaggtacaatggtgattagaagaggtacaatggtgattagaagaggtacaatggtgattagaagaggtacaatggtgattagaagaggtacaatggtgattagaagagg

SEQ ID NO: 43437 - DNA, 843 bp, Heterodera glycines
attggcaataagtgggttgtaaaaaactttttgggtaatgatttattttttgaagtgagtcaaacaccgtattagtgctttgctgtgccgagaaccggcaggcaaaggatggctttcaatctgcaagaaattagattggcaatatgtggttgtaaaaaacttttgggtaatgaattattttttgaagtgagtcaaacaccgtattagtgctttgctgtgccgagaaccggcaggcaaaggatggctttcaatctgcaagaaattagattggcaatatgtggttgtaaaaaacttgtgtaaggaattattttttgaagtagtcgtaaaaaaacagatatgattgttgtcagggggcttttaataatgttgttgcactgcccacggcaaaagacaacagcccaaagcaaacacaaaacaatacagcccaatgccgaagatgattatcgtttaattccaaataaaattagggcgaggacaatcaataggaaaactgcgacagcataaactaacaaccaacactccacaaaaatcacaaacaaaaatgaaacaaaataaataacaaaacgccaaatatattttaaaatcacaatattagcacatcctcgccctctaagaagcgatgtcctcagcgctttgggctcatcggtagtgcattcgggcgttgaaaggggcggcaagggtgtcagcagtggaccggttcggcataaagtcgcgttgcagggtcagaccttgtaaaacaacggacaaaacggaattccgacttttcatctgggcctataaaatcatcagcgggtagcttctttgcgcacacctgcgatggccatttgaaaaatccagctttta

SEQ ID NO: 43438 - DNA, 771 bp, Heterodera glycines
aatttcaaaaaaatgtcgaaatagtgaaaaaatagtgacaaaacgccaaaatagtgatttttaactatcttagtgacgaagtcgccaaaatagtgatttcttgtgacgaaaaatgacgtccaaatgaaaaaattttaacacagaaatgcgttttttgagctcctttcttcaaaacaattaagcaaaaaaaaagttttttcactagaaatcccggccctagacatgattccagggcgactctttcaattattaattttcaaaaatgttggtacactggtggaaaaaagtctgaacaaaatggtttataaatcgaaattaaatgaaacattatgggcaattgtttatgtatttattagtcccatatatcgactttatatcaacaccaaaaaatcccggatcaaaaaaagaatgaatgtgatatggtcaacgaagtgagagatggtcaaaatcatggcggaaaaaagtctttgaacacactttaaaaactatttcaaaaggctcttaaaaatctgaatgattcctgctaatgtatcatttgatgctgaacaaaaaagtcttttacaccaacttggtcagatcactccttcatagtgatcggggacatcctaatacgctgaaaatcagggaaattttcgaaaaaattcctagggggttaggaaaattttttttagtgaaaatgagtaagcccattagaaagagcataaaattctctaccgaattgcctttagaatgatgtggctatgacttgtacataaaaagttatacttggtt

SEQ ID NO: 43439 - DNA, 898 bp, Heterodera glycines
tggatgagttggaaaagagaaggaacaaaaataatgggcataagaaatgggagaaaaaggaacagatgaaagcaaaagaagaaaaataaatttaaaacggaagaaaaggattaaagaaaaaaaaagaagaaaaaagatgggagaaaagaggacagattaataatggaagaatcgcaaaaagagaagaaggaagagatgaaaggaagaaacaaaaagaagcataaatgaattaaaggaatgagagacagagaaagaagaggaagaatggaaggagaaaaggaaaaagaaagtttatagtattaaacgaagtcaacaaaaaaagagaagaaggaggaaagagaaaaagaaaaacgaaaaggaaaaggaagatgaaaagaattgaataaattaattgaaggaatgaagaaggaaggacgaaagaaagaagaggaataatggtagaatgaaaggagagaagtaaaatgctacttgcttaaatggaagataacacccaaagaagaaaaaaaaagaaaaattttaaatggaatggataagaaaatagaaaaagaaaacacagaggaaaaggaagaaaaggtagaaaaagaaggaagaaaataatggggaagagaaaaggaatcatcagcagagaggaacaggtgtaaaaagggagagacaacactgaaatggagaggatgtgaagcgtaagcgacacaaattgggacaaaactcccgaaaaacttgtcgccggatgggacatggggcggggaggttgacgaaaagtgcctctcccattcggataaaggctaactattgccgctgatcagaagccggagggagcagggaaatttgatgaaaaatcccctaaaatcggataaaggttaactattgccccactgatcagaagccggaggggaggagg

SEQ ID NO: 43440 - DNA, 1014 bp, Heterodera glycines
ttccgatcattgcttctgcttcgcccctttcccttttccctccaattcgtccgatctgtcccgacagtccggctccccgtcacaaacgtagtccaacttcacacattcgttgctgccacacgcgcgctcgtccgccatgcaaccggctgcgactgcgttggtgtccccttgcaactcttggggcccatcttaagccgaatgtgtccccattttcttagtttcaaatgtcctcctccctcgtgtctcccacatgattggacgtgaagcgtcgcgtgtgcctccactgtccgtccgttgtgcatggccacgcatgcgtactgtcccgcgtgctgcagctgcgcttgcggaatggtcagtctcccgcccccctcgcgcactccgtcgggcaatcgtccgcccacccgtgtccacctcacctgcacaaaattaattaattaaatctcgaatttggtattttatgggttttcgagagtctaaattcacttccgggtaaaaactgttgtccgttgtccgtgcgcggcattcaaacgatgcttcgcgcccctcgcggacgctcaattcgggcgggtggacgttgatttggagatctgaacttggagtatttatgagataatcaattttaaatataattccgctaataattttcaaatttttcgtggttttcttgtcgaaccttcgttgaaagatctttgcctgcccattcggtgactccgttggtgatcaacagaattggcattttgggaggacaatatgagaaaaagagccattggcaaaagtgccattgcggactctctccgccgcctcatttcttttttaaattattttatttgttatgcaaaaaacaaaaataattggcggctccttctttaaagcattgcatttttgggaagggctaatcaaatcaaagcaaacaaaacgaaacgaaagttgcgttgacttggccgtaggaaaacggctgctgcggtgaaacgaattaaaaggggcaaattgggaccgatatgaacggaggggggg

SEQ ID NO: 43441 - DNA, 720 bp, Heterodera glycines
aatttattaacaaaaatgcaataaaaccgaaaaatacacctttaagaatcgacccaaaaaatttcagaaaaataaacccttaagaatcaaccctaaaattgaaaaagttcttaaaaattggaaacagatcgtttcactcgcaaaatctcagagaagcaaaataaattttggagattggtttataaatcaattttggccgataaccatatgtcttttaaccgcgaaaattttgaaatgttttttatgtatttgtaagtgcgatcagtgaataaaattgtttgccttaatctgaaagtattttcatataaaaaaagcaattaaaattataaatccgagccctattaataagtagggatgccatttctaagaaaaaaattgctaaataggcacccaaaaggcagaaaaaaatcgtaattaaattaaacaagtgcttaattcaaaaatttggtaaatcaaacataattaattagaatttttatcagaatttcgattttaatttagtattttataaacaaggaaataaaaccattcaaacattggtaggaaataagaactaaaaaagagttgctcggtttctataatttttttgacaagaaaatcaaataaaaatggcaaaaagtgtaactgttttttttggtaagaaaattcaattcgaagaaagaccctgaaattcgatgtttaagcatcatattttggatttgtccaattatgtatttaacg

SEQ ID NO: 43442 - DNA, 1346 bp, Heterodera glycines
  misc_feature (1341)..(1341): n is a, c, g, or t
tatagtttcaaaaaaattttagggctttctactatttgcatgaatttgatttttaattttctttgacaatattaaaaattaagaaaaaagttctaattatttttttttaatttaacatttttttactagaaaaataaaaaaaaattgaaaaaattttgttctcggcgggttggatggggaaataatataatagcagccatcacctctcaatgccagatgttaattttcatgtcccaaaatatttttaaaaatcttaaattttttaggcacccctcagccgcgcattgaatggtccaaaaacggtgaaccgttggcgcagagtgacaatgtgtacttttggtccgaggccggccgagactatttggtggtcgaaaaagcggggccggacgatgtgggaaaatattgttgcacagctgaaaacgcgttgggcatggccagctcaagtgcccaactgttgctgagacgtgggcaattaaatcaattaaaaaaaagaaaaattttacaaaaaaataaaagtaaaaatttacttttttgaaaaatgaatttaattttaaactttaacaaaatccaaaaaattgtattccatccgtagtattattaattttttttaactcattataattaaatatatttttaaaatataattagaatgggtgcaccccaaaatatcgccaccgaaaatatcgccgagacaaaatatcgccgcagaaatttaaaaagaaaatttttcaaacttagaaattttcaagaaaaaaaccttaagaaattttttataagaaaattttaacaaaaaatcgttgaaaaattttttttttggaaaatttttgaaaaaaacttagcaattttcataaaatttcgaaaaatcgttcaaaagtttttcaaaaaatatttttcttgaaattttcttactaaaaatttcctaagaattttatgaaaaatttctaggtttgaaaaaaagtttttttttatttcggcggcgatattttgtcccgtccccaattagaataggcataaaatagatataaaatcgaggaatatggccataaaatatggacaaaaaatcaagaaatatgcttaaaaaacatgcaaatacattttcttaattgagggtatggtttccaaaatttttacaaaattagtaaataattaaaataatagtatcgagaaaatttttcctaacaaataatttttttggaatatttacgcgctaatatggaaaacatggatatggaacttcgaccaagctaaagtcctgtttttaattttcagacctcccacacatttttaaagtctcaaaattaaatattcgttttcaaaaaatttcgaattttttcgattganattta

SEQ ID NO: 43443 - DNA, 1123 bp, Heterodera glycines
  misc_feature (54)..(54): n is a, c, g, or t
  misc_feature (57)..(57): n is a, c, g, or t
  misc_feature (131)..(131): n is a, c, g, or t
  misc_feature (134)..(134): n is a, c, g, or t
  misc_feature (140)..(140): n is a, c, g, or t
  misc_feature (155)..(155): n is a, c, g, or t
  misc_feature (163)..(163): n is a, c, g, or t
  misc_feature (178)..(180): n is a, c, g, or t
  misc_feature (187)..(187): n is a, c, g, or t
  misc_feature (196)..(196): n is a, c, g, or t
  misc_feature (207)..(207): n is a, c, g, or t
  misc_feature (212)..(212): n is a, c, g, or t
  misc_feature (215)..(215): n is a, c, g, or t
  misc_feature (217)..(217): n is a, c, g, or t
  misc_feature (219)..(219): n is a, c, g, or t
  misc_feature (224)..(225): n is a, c, g, or t
  misc_feature (236)..(238): n is a, c, g, or t
  misc_feature (242)..(242): n is a, c, g, or t
  misc_feature (255)..(255): n is a, c, g, or t
  misc_feature (265)..(265): n is a, c, g, or t
  misc_feature (269)..(271): n is a, c, g, or t
  misc_feature (291)..(292): n is a, c, g, or t
  misc_feature (297)..(298): n is a, c, g, or t
  misc_feature (316)..(316): n is a, c, g, or t
  misc_feature (320)..(320): n is a, c, g, or t
  misc_feature (323)..(325): n is a, c, g, or t
  misc_feature (328)..(328): n is a, c, g, or t
  misc_feature (334)..(334): n is a, c, g, or t
  misc_feature (349)..(349): n is a, c, g, or t
  misc_feature (359)..(359): n is a, c, g, or t
tattggggagtaaataaaagtttttttgtgactatttacccttcccatggatgnagnatttctaaaaaggatttaaaaataattttttgggtaatattttttaattatgttgttgaagaatttgagggtgnttntgatgngattgaaaatttttnagtttttnttgaaaagttttttnnnagaaaanggatgggtnaaataaaaaantaaanatntnanatgannaatttaaattnnnttanattttgggtttantttattatgntggnnnataaaaaaatggagtttttnnggtgnnaaatttttgtgaattttntttnggnnngtnataagnggattgtttgggggnaaatgaaaanaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaaattttcagcttttcttgaaaagttttttctcagaatttatacagctttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagtttttt

SEQ ID NO: 43444 - DNA, 731 bp, Heterodera glycines
taagttaattttcacaaattgtcgttaataatcccatggaattgttgctgtttcgtcagggcgaatttgacaaattgtacggctgtgagggatttaatgcggacaaaatcccaattgaagaaagaacaaacattgtgaacggatgcattttgatgatactttttttcatttttgaggtctttttttcgctgggtgatggaattagagggctcttgatttgaatttttctactcttgaccgagacgcaaaaattcaaagaaaatcccaaaagtttaaaaataaatcgatataatttaagctactgtacattccgtgtatggtatcaatttacaaaaacatggataatgcctgctacaaattgatgttcttcattggcatattggacatggtcatcttttaacagaataaattcaagaatatttatttatttttaaattaaatttccatagttggccttgttcattagtgggttggaaactggaattcttggcatcattggtgccgtttattgtgactatccattgctgatttattcaagcggaattttgggaggaggtatgctaatatctttattataaaaatttttaattattatttgttaaattaagctttatggtttgccgaaacaagtgccgaaatgttgttggcaattaaccgatgcatggaattgttgagaccacagttggcacatgccattttcagtggtcaaattttatcactgaaaaacaatg

SEQ ID NO: 43445 - DNA, 1014 bp, Heterodera glycines
cgtttgaatattttcctgtgcgtttccattttcgtttcttcgctgagtccgtcaactttgtgtacaaatgcctaaaaactgacgattaaagactgagaagagcaaatgccacttcaaatttgatgtttttgttgatgttgtacgaatggataatggcgggcaccattttcttcagcgcttcgtcataatcggcttgagcgtcaattacgaagagaagtgcccctgtgcaaaaaagcaacccaaaatgagaaaaaaaacaaataccaaaaataaatttacaaaatatttgcggttaaaatttctagctcaaagcacaataaatgcatctgatcaagcttggacccaccgcatcgcgagaagatcgaatttgggtcgaatgatgcctcgaaagggtccacctgaccggggaattcgatggtttcaaagttaatgaacgaatcggacacggcttaaggaacgaaacagaaaaacactcatttatttttaattacgcacattcattggtcacccgagcagtgctttccacaaaaagcgtctcattcggactcattttttggaagaccacctaaaaagacaaaataagaaaaatttaaaaatttggattgacaaaccttcctgatcgacgttttaccgctccgcttcagccccataatcaccttaagtcggagattaagcaaagaaattgggttatttgagctgacaatggtaggacgatagccaatcgaacattcggagtccgactcatcgtccttcagcccgtagtcgtaatccccttcatcgtcgcgataatacgcctttccttctgtcatttctaatataatgtaaggctattaaccagcaattaataaattttgttaaaaacattgtaatggagcttgcatattgaaacttcaaaatcattgacaattaatttatttttgttaaaacaaagttggcaaaatacaaatgcgatgatcttataataattagacactgaaatgtaatcagaataatttgtatcttcctcccacttgt

SEQ ID NO: 43446 - DNA, 729 bp, Heterodera glycines
gtcagcttctttcttgcaatagccaaaaattacggttcgtttaaacattaaaaaaataaagtacaaaagccaagaagggttagttaactgtaaaaatttcgatttggaattataatttctgattgtactcataaagtgcattaaaatcctttttaattatttaaaaaaaaattttaactaattcaaattaattgttgttattttatagaaaggtgaaggccttgccaaatgtatgggaaagaaatgtgagaaaagcaagacaaattaaagaacagaagcaataatgttaaacgattcatttaaaccaatttatgtaaataaattacgttgcattccgattttttaatgacaaaagcccataatcgcttttctccaaaataaattaataaaacattgttatttgtaatttaataataattaataaaatcatttaaatttaaattgggaagcattagaaaactttaacgaaaaatattttaaaaaatctgcaaaaattaataatatggaatacctatgggtcttacaaatattgctatgttttctttgtttcaatgatctgtaaagaataaaccatatttaaaaaatattgctctattgcagtatacaccactcataaaataacatgacaacattaatgtttaatatttttctagaagcaaaatcgtaagttttttatgatctgtaaaccgcatagagccaaaaaatgaatttttttaaaaaataaatttt

SEQ ID NO: 43447 - DNA, 501 bp, Heterodera glycines
  misc_feature (489)..(489): n is a, c, g, or t
gtaaaatttattacaaaaaatttaaaattttattactacccttccaagtaatgcaatttaaataaaagtaggcggcatttcccttattttctagtattcaaatctataataggctcttatattgtttaggccccacaaaattttttttacatttcaaaataaatgaagccaacctataggttttcggggtcgctgatcacgaatccgacatcagtttctcccaatttcgaacccctgacccgaactctaacaaaaggtcgaaaattcacttttcaacgaaatgcacatttattgcccaaaatcgatttaaaatgcacaagaatgaacggtagcagcgactgcaaaacacaaaagagtttcaaaaatgcagagtaatggacaaatccctgcagcttttgaattgaagagtcgtgcgacaaggcaacgacctgccacttcgtgcatttaaatcgattttgaacaataaatgtgcattttgttgaaaagtgngattttcgacat

SEQ ID NO: 43448 - DNA, 1001 bp, Heterodera glycines
  misc_feature (28)..(28): n is a, c, g, or t
  misc_feature (33)..(34): n is a, c, g, or t
  misc_feature (45)..(45): n is a, c, g, or t
tgaaagtcgcaattgtcatttgacttancaatnntaatgaaattnaatgaaattcctttaattatattttatttcattttaaaaatttctctaagcgatatttaaaattttttcatgataattctaaaattttctgctgtaacttacaattttccttggcaaatcttccaattatacttgtgcttctgcttcgtcctaattgcacgtctttgttgccaacggaatttgtgattttaatttttactaaaaaaaattttctgacagaaaaaaagaaattacaaaattaaaagttcaaagcgaagcttttttttaatgaaataagaaagttcataaaagtataattttttgttgatataattttgaaaaccaaaggtgcaaagttgagttatgcgttagtaattaaataataattcaaaaaatgaaaaggcaaaaatgaagatgaactgaaagcttagccactaatccatgtaaaacataagcacttagaaaaagtttaatataaattaattgcgtgtcctgctgcgacgattacgccaaaaataaataaaacagaatttcatgctttctgtactttttttacctttatcttcgttactttgtccagaaaaactttccccctttgaagcattcccttgcgctgattttattggcaattcgtcaatggcatttttgaattttcgagtttctcgaaaagagtttcccaaatctgcaatacctaaacattttaattgtttttctattctaaattctcaatttttcattattttattccttccctgattaataataattattgcctttgtcttttgtttgttggcccatctgttccaaactttttcttttctcaaattgttcattttcctcctctattctatccgatctttgaagtatttctaaattttattattatccatatgttgttttcttttatcttatcctatttcgttctttcctcatattatgtaaattatgaattttcaaaaaaaaaaaatgtaaaaact

SEQ ID NO: 43449 - DNA, 1581 bp, Heterodera glycines
  misc_feature (743)..(743): n is a, c, g, or t
tacattttttacacaaatttgtttctttttatttacacccaccctggttattccaaacattttcaaaacactgcgcatacctttgcatatatgcgtaaccggggaccttcgtcaaatccctccattctgtgtggcctcaaatacaattgtcaatggcgttgtccttcacacaaaggacaaaaagtgtcaatttgggtgggctcttttttcgaggacgcgaattttgaactcagcaaaggaataatattggcatattcctgggcgcttggtatttaaataatgtttgagtcgatcggtaaattgggtctaggcatcgccctacacacccaaacggaaatgatcggattgagtatcaatgagctcaatgttggtacaattttttatagaggagtttgcagccgttggctaattgacaaccccattcggttgtaaattcgcgtccacgcaggcattgatgtggtccaaattgtgccggaccgtactcgttccaagctgctacaaacatccaaaagtacgtgttactcgggctcgacgattcattcagaccaatgggctgcgtacatgggcggcacaattccggcgatcccagtcatccaaccctatacccactactgtgttaatcatacgattaactttgtggaccctatcacaggcgcccatacaaattttcattcataaattggctgaattattgattaccgcgacttaattcagatgacttttatttttgaaagatgacctanagaaaatcagaattttcattaaacaattcacatcaattcaatattacaaaaacagaactggcccatttcctgtgattgaaagaattattattatttttcaaattcgcatttggttcaattacggtgccaaaaaacagataattttttgctgataggtttttaaaacaaaattttaaagcaaataattattatttttcggcaattggatagctgcaacaaaataaataccaaaaagaagcacctaaattctcaaaacttttccacgtgagtacggtgtctttatcgcaaaagcagagaaaggtgtccaaacctgaaaatggacgagccctattaacaaagcaactcgtttctgtccccgaaagtttttctcggacccttcgaaagcttggtcgacccaccactcccttttcgtgtttgcaggcaacaccaaaatgaatttgcgtgcctgcaccgtcgctccaacgctctgtcatatgcgtccgagcgcacactaatttcgtgcgcgtcgtcaatttggggtggtatattgcgcgttgctttggccacagcggatttgcttgggccaacctaaagcgttcgttcaaaaatgataattgctttttcaaacgaatcattttaacccaacgaccccctaaaaactaaacataagtgtataaattttttttgcaaatattgttaaacgcaccaatgtttccaacgtgcgcttggacggctcgggtcgtttgacaagcgtcacatttgcagttggcgcgcattctcgcttttgtttttcaatttgatggtgaatttgattcgattagagccctgctattgttcataattaattatctaaaattta

SEQ ID NO: 43450 - DNA, 920 bp, Heterodera glycines
cataaacacaagggaggttaaatgatttatttttgaaattattgtgttaataaattgttataacaccaaaaaaggttttaaggaaacattaattttcaaaaaaccaatcacattattaagaatggtaaaaatcattaattatacaattttcaaatgcgcataaatagcagtacgcacaactgctttgctcttgtcagtaaggcgttcgtccagccgcgacatcagctttttcatctgctttcgtgcatcggcagcgtttggtccataaagttctccatcgccgttgtttttttgaaacaaattcgtttaccagcattgaaatgtccagtaacgtccatccatgcgaatgttgcggtgctttggcagtgcagggagccacggcgtctcgactccagtgttcgggaaccgcgctaggacgaactcaaatttctccgaacacacggcgcatttgtggacgaggtgacgggctcgctcaagatggctgaagtagttctcgcggctgtcgtcgaacagaagtcgatacatggcgttgtttgctgctccaacagtgtctgcgatgcgtgcccgtgctcccccgggcaattgtcgtacacttgcggtgctgcctgattccaaaaaaaaatccaaaaattaatacaatcattaccattttcattttaattaaaaaatccaaaaaattcagcataaatttgagtcaattgcgcggtggactgaaaaaaccaaaatttgaaaaaaatcaaagggttaatgtccactcccaggtcaaaaaaattttcacccccctccccatcggctgtcagtttttaaatcaatcaaatttttccgctcatcaaaaaacaacatgacatttgacacacgccccctcatatgtttagggtttccttatttaattaattaattgctcaccccccctcccatat

SEQ ID NO: 43451 - DNA, 869 bp, Heterodera glycines
  misc_feature (797)..(797): n is a, c, g, or t
  misc_feature (826)..(826): n is a, c, g, or t
  misc_feature (837)..(837): n is a, c, g, or t
  misc_feature (841)..(843): n is a, c, g, or t
gatcaatcccgaacatttcgtaaaaacgatcgggacggatcccgactcgggattccgaccgaatcccgatcccgatcaatcgcgaagattttttttcgggatcccgcgggattatcgggatttgcaaaaactcaatttttttttacgttttgtgtcaagttttttataatgcttctctaatatttataattgatcaattccattcatttaacaacatagctttaaattgttttttacaatttaattaatataaatttttaatatttggatgcgatttgttaacagattttgtccaaaaaaccaaaattttttagcgattttgagcaaaattttcaggaaaataaggattttagatccggcgctgcagatatgcatcgaaaaaaaatacgtagacaacaatttctaatctaattttttgcacaaaattcttagaaattattgtgtcataatattacctaaaagttttaaaataatattttaggaattaaaaaaatttttgataattcttttttgaaaaaaataaaggtcacaaaatagccaacttttacgttaaactttaaaattttattggaattttggatacctgtggaaatttttgggatttttacggattttttaagaaaaattagcaaatgacaatattttttaatttaaaattgaagatattaattaaaaaatgtagatttttcgaaaaattatcgtgacttcaatcccgcgggattggtaaaatggtcgggagggatcccggttcgggatcccgatgaaatcccgatcccgatcaatcccgatgaatttanaaaatccttcgggacggatcccgatgtcnggatcccgaanttannntccgcggatcccgaagaaatcccgcg

SEQ ID NO: 43452 - DNA, 1661 bp, Heterodera glycines
  misc_feature (1164)..(1164): n is a, c, g, or t
ttttttttttttttttttttttttggggggggggggggggggggggttgtttttttccccccccccccccccccccccctcttttttttttttttttttttttttttaaaaaaaaaaaaaaaaaaaaaaaaaaaaaaccccccccccccccccccccccccaaaaaaaattttttttttttttttggagagaagaaaaaaaaaaaaaaaaaaaaaaacccctttttttttttttttttttttttttttcccgggggggggggggggggggggccccccctctctttttttttttttatatacaccccaggggggggggggggggaaaaaaaaaaaaaaaaaaaaaggaggggccccccaccccctctccccccccctccttttttttttttttttgtgttggaaaaaaacaacccccccccccccccccgggggggggggggggggggggggggggcggggagcaaaaaaaaaaaaaaaaaaaaaaaaaaaaaaattttttttttttttttttttatttttaaaaaaaaaaaaaaaaaaacacccattttttgtggttttccccccccaaaaaaaacaacaaaaatattatttttttttttaaaaaggggggggggggggggtttttgggggggggggggggccccaaaaaaaaccccccaccccccgcgggaaaaattttccccaaaaaaaaaaaaagtgggggggaataatcgcgggtttttaatattttttttttttttttaaaaaattttcacaattttttttccaaattttgggaaaaaaaaaaaaaaatttttttttttaaaaaattttttgaaaatttttccctttatagtttttaaaaaaaagatttttttaaaatttttttgggggattttttaatttggggggggggccctttggggcgcgggccctttttgggccccccaaattttgaaaaatcataaccttttttttttgtccagtatactttaaccaatttggcatccatttgaaagttttatgggggcttttatatttccaggtaaaaattggaaaggaatgatttcaaaaaataaaaaaagttaatgcccgcggcgccgaaaaaagcccaagaaaaaggtaaattttggaggttttttgcccatactttttttgtgaactgacgacattttttgaaatnttacaggctaatagagaatctgaagagctatcgaatgataacaaaaatttttaatttggttgatcaggaaaaaagttgttagcaacggcgccgaaaaggccggcgccgaagtgggcggttcccatttaattatgctttacgttgttgtcggaatattaaaaaattgccaagccaaatgttatgacgttgtaagtgttggcataaatataagggagtcaaagtcatcataaatttaacatttacctatatgcaaagtatggcgaattttaattttaatttttttagaaaaatgaatttatttcttattttattattgctcctaataattattttaaataatgttttattctttgctaaagacacgaaagagcagcaacctgtgcccgatggtttgtcttatctttgaattgaattttctcaattggttggcctttctctgcgggattttgcttcgggaatgtaaacattggccaagggaaatttaaattttaaaatcg

SEQ ID NO: 43453 - DNA, 891 bp, Heterodera glycines
  misc_feature (17)..(17): n is a, c, g, or t
aaaaaagaattttttgnaacatggctttagcgccaaaaatgaaaatttcaattttcaccgaatttaattaacaaaaatcaaaaacaatttcaaattaatctctcaattccacgtcttttcatttaaagaaaaggtgggcacagataaagtacatctgcgttaatgtgctttggttgttaggcaacgattggcggcgaggataaataaattcccaacaaattgtctggaatctctctcatcttttttaataacttcttggcgttgtgtgcaaacaaatgttgggatgggatttagagggttcattagggtgtgattgatgagtgaataaaatatgacgccctcattccatggcactctgaaagggattatgaaagtctaaagttcatttagattcaaaataatgttcaaagacaaatattgggacacttttatttacatattttaaaagtgatattaaaaaattaaatttaaaatacataaaaaattattttaagctatttaggtcccccttttttagcattttgtgcttattcagcgcttttctaagatttttttgtccaaaaatcattttaaaaaattgggggatttttgtagataattctttcatattttggaaattttattttaaatattttatgcacatatttgcgatttttcttactataattcccaacagcccttgtgatgagtgagtgaataaaatattccgtcctcattcgtggcactctctgaaagggattataaagttaaaattcacaccacataatgttcaaatattcttttaaatcagtatttaatggaatttgagctgataaaaaatagaaaatatttttagtttaaaaattttcaaaatattttaatattaatttaatacctaaaaaatctaaaatg

SEQ ID NO: 43454 - DNA, 1203 bp, Heterodera glycines
  misc_feature (142)..(142): n is a, c, g, or t
ggggcaggaaacagagaaaaaggggcgtggcctatcagacgcgtacgccaacaatatcgattaagcgagagagtacatgaaagagagagagttaggtcagagaagcagaggaaaaggggcgtggactatcagacgcgtacgncactagtatcggttaggtgagagagtacactgacagggaggtttagagatacagagacatgggtgagcagagaagcagaaagtcagagacgcagagtggcgtccttttttatcgattggtgagagagcaagcaaagaagagaggttagagatacagagacgcaatgagtggcggccattattatcgattggcgagatagtacgcagagatgagaggttagagatgcatagacaagggagagcagacaagcagaaggtcaaagacgcagagtggcggccattattatcaattagtagagaccacacagacaggagaggttcgagaagcatagaatataaagaacacatacaagggatacattgcaaaataaatatgcgggcatataccaaaaaaaaggtggttggctgccttataaaggcattgcgcatcaggttgttttatatttattatcctgattgggattgcgcaggaaaggaaattgctttattaatatcaaccaatcttggcctgatgagcagcacactgccacccttgaagcacaagacgacagagcacctgaaaagtctcgtaacttagcaagataatatgagagacctcaaggcctaaaacacaaattgaaaatgctgccaggataaacggagttcattaattagacctaccgccctggttaacagcaaacgtggaataattgtcaaaaggtaaccaatcttggcctgatgagcagcacaccgccacccatgaagcacaagacgacagggcacctgaaatgtctcttgagattagcaatgcatgtggaaccacctcaagacctaaaaagcaaattaatttttgttgccaggataaacagagttcattaactagaactaccgccctggttaacaacaaaaaaataacaattcaaaagaatatagaagtatgaaaaaacgaaggaaagtgggtgacgcatccttttatatgcggcccgccctcaaatctaggtcaagtgttactatttttagaatatacaagccatctttgaatttcccgccaatttttgaatttgaattttcccgccagttttt

SEQ ID NO: 43455 - DNA, 1135 bp, Heterodera glycines
atttccgtctttgtcaacagaattactaaatttggcatagcttaatgtcacatgacaaaattcacgctgcacgctgattaagataaacaaagtcattaataaccggatattcacaggaaatggtacctcattattgagaaaggcatatcaactgttttgaaaattttacataatcaaaacattatggttggtatttattaaccaacatttattagtcatcgatgtaaataccaaaaattaaaaaatttttagtcttttttgtattttaaattagtaaaatatattttttaattcgtctactacgaaataagtaaaaatgaggcgaattattttcaaatttttgctgattacgattgttaaattatttttatttatctaatttcacattttttttatgaagaaactttttactctctctaataatggtaaatgatcaattgtaattgcggttccaaattgttggcgcaaattattttgtggaaatggtctcagggaacacagaccatccaaaaagtagtatttgatttactaatagattaaacacgattaattttggggctttgatttttaattgggtatatacgcccgaccccgacgcttccaaccccgacaagccctgaccccgacccttaaccctgactcggggtcggggttaaaaatacacccctaagaatggcataatcgtttgacaaatttttatgaattaaaggaaattttgcttttgttttttcaatatgttctggtttagtggtcagtgctttaaaattaatagtactttatgagttcgttgccggttgacgttttctgttgattttttttctgattaatagaaaaattttattaaaattaaaagtccaattttccttgactaaatcatgaaaatttaatatgctttaaatattttaacaaaataccgaagaagaacaaaattttatcggaaaaatcttcattttttggtgattacctggttcaaaaatagagcataaatttaaaaattcgctcggcgacacctatcggcaccgccgaattcaatttcactgatcatttaaataattttaatgatgattatgactaacttttttttttgaattttttgcttgtataaaattttaaaaaaatacggaatataaaaaaa

SEQ ID NO: 43456 - DNA, 1068 bp, Heterodera glycines
tttagctaacaatttaacaaagattttcttttcgttttctgattaatttgtcactccaattggtgcccaaaaagccaaatacctaggtgatttttgggatctattaaacagagattatcgtgaattgtagatgaaaaatccacccaaaaagggattaatgggaacagtgaaaaatggctgggcagagctttcggattagatatgcgtaaattgggtctgaattattgggttaatccttaacccaaaagtaatttgcaattattgacagatacatatatatatatttttgattttgttaattaaatttatttttattttttattattttttatttatgaatttcttttcttaatatttaatctgatttttactatttatcgattgattagcataagattgccagcaacatttaaagatttattaatttttagtgatggaattgacgcttattatattttttattaatatttttttcgaattaatctttttacgtttacaatttatacaatttcgaaaatcgctattaataccgtaattttgattactagaccccattatgattagaagatcccgttagattataagacccctttttgcgaggggttgaacaataaaaaacctatgtctaataatcgaaaaaatacggtaagtcataaaacagctcattaaattaataatccaaaattattctaacaaattgctacctaaaagactcagttccctaattgataatcctaattacagggtgaggaaaaagtttccgcacttttttaaagttcattttttcatacccatttaacattaacaaacaaaatttcttgataaaaacaaacaaatgtcagtacaataagtcggaaaattacaacaaatgctcgaaattttcctcattggccgagctataagcataaaagcgcttctgaaaattggcaataatggtcgcacccaatttatgccatatgccatgcctattaaaccatgaatgacattttttgacagactaaaagcctggactaaacagacaactaggcgataaaaggtcataaaattttagaactgggccaaaattgg

SEQ ID NO: 43457 - DNA, 1232 bp, Heterodera glycines
aggttttgtccggtttctaatctgtaaaacagcgaacgagaagtgaccgtaaaaactccgagagagtttccaaaacttggtaggtttgtaatttattctaatagcatgaaaatttcgaatataatatttaatttataaaattttaataaaatattacaatgctcctgcacacaattgtttgaaattttccgtcgtctgtggcacagcagcaaccatgaggtcaataattatacgtcctgaaattttatacttttttccaaaaaaatttagtattttattttaagcgccgaactggccacgactcattttttcgaaattaattaaacaaaaaattaccgcaagaagccgagtcactttcaatgtccttaaacataataataaaaaataagagagaaaggaaaaaagaaaaaattaccagaaatacgactgggtctgatggatgagccaacgatgcattaaattccatccatttgtactgtggtggcatatctatatgtaaataaattaattaggtgcaaatttgctcgaagaaagggattagcgttacatttatttttccaaatatttttgacaatttaatttaaagaaagaatttttagtgaaaccaaacgtattataagtaattaaactgatttcttcgccctcctcttcagtgggggcggtgagagaagcatcgccaccacttttggcattggcatcagaatctgctgaggcggcactgcttttgttgttctccttcctcattttctggcaatggtttttgacgtttgaagttgaaagttgaaaatttacaatatttcttcacttaaaatattggtatttaggaaaataagggttaattaaaacaaatattttaactctattaaactttatgagtccaacacattgtcaaatatggaaatatggacaaaaatctgaaatatggaaaaatatggaagtaaaaaaggatcctagaagcatcaaacaaagctaaaaacactatttacgtggtttgtaggcaaaaaaaaaaatggaaatccatacaaatccagtcccaactgataagcgcaaaaaacaaattttcttcgaacacttttcgatatatagcgacttttttagcactattttcaactacagtattttcgcttatgaaactttttaataactcttttgacttgggaattttaaaaaaaaactattttttcaaatattatgaaaaaggaataaaaaaaaaattaaaaaaatatacccct

SEQ ID NO: 43458 - DNA, 546 bp, Heterodera glycines
ttctccccataaatctgggggcatcggttcggggggactgccccgaaaacaaaaaaatcgattttttcaagtgtccgtttgaggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaataatggggagcaaaaatccaacgcagaattaaagtacaggctatagggaaggtattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtcagactatagggaagctatttccgaaggattcggtctccccataaatctgggcgcatcgggtcaggtgtactgcccccaaaacaaaaa

SEQ ID NO: 43459 - DNA, 770 bp, Heterodera glycines
ttttaaaatttttaattcctttttaaacaggccaaaaagtttaggcttaacttttttttcagaaactgatcagaagcgcaccaaactttgcagggatactgaaaggaagagaaataacatattttaaatattatctagtcagttcatttaaataatttttatccaaaaaatttttttttgggttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcgggggcagtccccccgagccgatgcgcccagattatggggagaaccaatccttccggaatagctttcctatagcctgtactttaattct

SEQ ID NO: 43460 - DNA, 1300 bp, Heterodera glycines
agcaacaattggatgaaaaaataatgaaacaaattgaggtatgtatgattcatttgtcaatttatgaaagggttactctattttaaaggttcgataagaaaacctttgaaccattaattcaattttgtatagctaggctaaaatcttgaacccctttttagtattatttcggtgatataaatttgccgcgcgacaaattcctccaagaagagatgaagaaagacgatggctgtatgttttggttttgtacacaattgtttgaccttttaggggtttcgcttacgacgatgctaaaattcaaccgactggcggcattaagcactgatttggaccagatcacctcagccctgaaagattcacatctcatcgacgtgtcggacgataacgtaaaaatccgtcgaaaccccgaagaaccgctacccgaaaacactttggaatattggcaggagattaagcgtcgtaccgtttacttggtaagttaattttatttcaatcacaaaagttataccaaaacattgtaccgctttagaaaggattcccgcaagagagcactttggacgaaattgctaaatttgtaggaaagttcggcgaagtgaaaaacattctgatgcgaaagaccagagggagcaaagaaacgcccaaagtgttcaagggatcagtcttcgccacttttgtggaccaggaacaggcgaaaaaattggcgtcggttaaggacctcaagttcaaggtggttgagctaaaaatcaaatgaaacaaaaagagaaaacgggcatttattgttttaaggacgaatacgcaatggtcaacaaaatgcaggaggattattgggcggaaaaaaacaatgaacgacgacaacagcgggaactgaagaagcaaatgcgaaaggagaccatcgataagcaaaatcagtcgcattttgtcaagggattggtgctgaaacttagcggtctgccaatgcaaagcggggagacgaagaaggaagtgagcgtgcacaaactcaaagagttctttgaaccgtatggccaaccggcgtatgcagtgatcgaaggctcggaggtgactgactgacaaaagagaggggttttgtcattttttctttacattgttaaaaaatgggtgtttctaatttaatttctgtgctttcaatggtgctgaatcagcttgattttgtgagatgacgccgtttaatctaagattttcatcagttgactttggcttataactctaacatccatccttttaattgtgtcctattttaaaagaaagcttctctttaagcgctttcgaatgatttaatagt

SEQ ID NO: 43461 - DNA, 1227 bp, Heterodera glycines
gtattttcagcaaaaaaaaaatactgaaaaatttttacaaaatatctttttagtaaatacttctcttccatttcgcttactcaaaaggctaaaattttttaaaatttctaaaacttaaagtttcaattagaagaaaatatcttggtattatgtataacagcccttaaataaatattaaaatttattttttgtccatgttttatcgaatgattaatagggcttatactgttttacctattttgttcctgagctctcacgaaaaaaaaattgttttttttgttggttattaagctattttcgagttttagaacaaacctgaaatcctaaaaattttgaaaaaacctattttgacctatttggcgttttgccaacattaattaacaaaaatacaattgaaaagaacaatacacccctaagaatcgaccctaaaatttcagaaaacacatccctaagaaacaaaaattttcttaaaaattcatttatttattttcttaacaaaaatttctgattttaaaaattgcgtatctcaatactggtttggcttaatattgttgctaaattttatgattttacaccccctaaatttgaaagtttttggcacctattttcacatttttagcacttattttggcagtttttagcacctaaaattactaatgttttgctttggctccctgtgaatgttattataatttttttgaaaagtacgaatcggatacagtacgaatgggaaagtacgaatcaaatttgtagattggtaccgtaaaatttaaaaatttcaaccgaatttgtacagtataaattaaaaattttaaacaaaggtttgtctcaacggatgagttcccggcggatgtgtacccaaattatttgtcgggctgcgtttatttgtcaacttcgccagcaatcgccgccattttggcacacacccacgaaattgatggattttatatggacgacgtgctgttcaccggcattttggccgagcgggccaatgtgacgttgttcgaccaaagggcgcactttgtctgggccacttcggtgagcgaagggccaattaactgctaattacaccaatatataaaattgttaatttacattcattgatttgttttagtttgatttaaagagtgctttctgtgaggacggtgtgccgacggcattttccctgtggggcgcagaagtgccggaagattttgaggaacactacggaagaattaaggagaaaaa

SEQ ID NO: 43462 - DNA, 567 bp, Heterodera glycines
cccgtttctaaatttgttgggctattaagaccgcttcgcggcctcagacgggcgcttcgcgcccgttttttagcttgttaggccgcttcgcggcctcagtcgggcgcttcgcgtcggtttttcaatttttgttggccttggacgggcgcttcgcgcccgttttttaaattcgttgaactcatacgggcgcttcgcgcccgttttttagcttgttaggccgcttcgcggccttggacgggcgcttagcgcccgttatttaaattttgaggtacaaaagtgattaaaagaggtacaacaatgattagaagaggtacaacagtgattggaagaggtacaacagtaattagtaaattcattaaattaaaatgaaaatattttttaacaaatttaatttaaaaaatacatgaaattctatcaattaaaaaaataattcatttaaacttataaaatttattcattaaaaaaaattaatttaaatataattttttatttattaactcaaaaaatattttaaatgaataaaaattgacaaacactaaataaatggtatagaaataatgtacaccg

SEQ ID NO: 43463 - DNA, 1318 bp, Heterodera glycines
ttggagcgatggcaacagctaaattaaaatattgggttctgcagaatgaggcacaaatggaaccgtattgtgagcggagtgtcgcggcacaacagaagttgggctattcaacaaaagattctgaagagatggtggcgattccaatggcattccgtgccaatttgaagatggcggcgattcaaatggcattccgtgccaatttgaagatggcggcgattcaaatggcattccgtgccaatttgatgggtgtgcaccgtattggaagggatttggcactcgcggtatgtttagttggaggagtggcttttgcgcatgcattaaaaggcgagtgagcgaattgggccgattgtgaactgccgacgcatttgtttggtacatttcgttgaatggcatttgttgccgcgggggcggtgggcccataatttgccctgtgaaatatgcaacattagctgttttttgatttattcaataattcaaaattgcgtaaatgaagccaaatgacggattactgtcagtttgtacggtagggacgggttccatttgcgaattcattgaaaatgcaaagtcgtccatttggccaacagtggaagtcggtagtggcggaaacatctgagagagggaatgccaatgcctagtaatcatcgcgaatggcacttccttaaggcgttttaccccgctgatttggttggattgactggccgaaatttggtgaccagcagcagccgcggaattgtcggcatggccttggccaattccgagagccatcggaaggagtacatcatcgaaagtttggccagccatttggtcggaggaggacccaaatggtagcgacgagtggtacggaagctgatcactgtgctgctgccaatggtccgacgaaatgaacgcttcggtctgttgctgaaacagttggtcaggccacagcatttgttctgaatgaatgcgaatggcacttcatcaataggcctaagcctttttttgtcagtctgaaaagctcaaaaaccgtaccaaatgaaagtgtttcaaaaccttttggcctatattttaacatttttttccgcatatcgcatgatttccaagaataattaatgaatttggtgcttctaagtaaagttacgataaaatttgtcaaattgactttttaactaaatttcattgcgtttaccccaatttcaaaatttaaatgcattaattttaaattttattttagcctccactcacccctcgttttgccttcgttcgccgtcgttcgttgttcgtctttgcctatttgcagatcgaatagaatgtttgttttgatcggctgccaatgcatcgg

SEQ ID NO: 43464 - DNA, 1214 bp, Heterodera glycines
agattttacttccttttcatcatcgccttattattttttataatactagaagaaattgtaaatttttattagcataataatgcgtaataggaaaatattcagataatttacaaaaagaaaattgataaataataaataaagtttaattaaaaaaaggaattaaatttggtgggctttttttttggggggggggggggggggaggttaaagcaattatattttgtggctttttggaagggaggaggccggaatctagcactgatcaatgatcacgaatgtaatccatcaaaaaggatccttccatgatgtcgtccatgaacgcctgacgcaattccgatttaagctccgtcgatggtgccgactgctgccgtttgatcaatgcggcacatttttttttatgtgcgttgaaacgccggccaaatttcgccgagcccgtcatattattgctggttaaaagttttgattaaaatttttgtttaattaataataaaaaagtacgacggattgcaggtttttttcaacgcgcaaaaaagcggaggatcgttctcaattttgccaagatttggcgtcgttggcaaagtctaagaaatataaaaaagaatttttctgaaaaatttaagggttgttaccgttgtggtggtcaattcctacaaaaatataaattaacaaaatactcaaggactaattttttgaccattaataaattttttgaaactcaaccaatttaaagattttcatttaacatatttaatatatttttgataaaagctatgtccaaccggcgtcactgtcgtcactgttgacatttgaattgtttgctaaatgaaataaaaaaataatttaaaaaattcttgtaatataattttatttattttgtcattttcccattacattgccaacatggcaacagacgaattcgtagtcactcgggcaacagccgaatccacgatagcccttatttggccggcaccagtatgtgccacagccgcataagtccatgatttttttggtttcatttgcgcaatgcccaggatgcttcaaaattaaaaatatttaacaacccaattaaacttaagcattattttggtctcattcgataatttgtttaaatttgttttgagtatacccaagaatatattgaatataatttattttttactaaattaacggtaatacacattaaaaaaaatttctttacccagttttggtaaatc

SEQ ID NO: 43465 - DNA, 1310 bp, Heterodera glycines
tgccattcgtgctttgtaatcgtcccacaattttttcaaatcttccggcggtgttgcgtctgccgtttcgaatgctcgacaaacttcgccagcaattttctcctgcccaacgggcaaaataaaggtgtaggcccatcctttattgcccgctcttccagttcgaccaacgcggtgcacatagtcttcgtaatggttgggcgcatcataattaaccactagaatcagtttcttgacatccaacccacgcgcagccacagaagtggccaccttaattttgaaaaatggtgaaacttattttgacgaagcaataataccattagcttcaaacgtcccgttttgaagtccaaaatggtaaagtcgcggtcgtcctggtcaatgccgccgtgcaatggggcgcagttgtacccggcgcccatcagttgggacaccaaatcatcggctttttcttgcttttccacgaaaaccaacacattcccatgctcccaatattggccaagcaattccaacagtttaagaaacttttggtgctcttcaagcacaaaagcgtgttgttcaacttccttgcaaacgacacttcgtccgccaaccttaaaatgtcatgttaaaagactaaacaataagattctttaaatattttgaagtattgaatggttatttccaaaattcactgaaaatatcataaattactaactaattagtcacttatttatgccgttaatgctaatggagattgtaaaaatatatccacctgaatttccaccggcctctccaacacttttcgcgccaatgcttccatttgtttgggaaatgtggcagaaaaaagcacagtttgtcgatccggacgaatgttattgacaattttcatcacttgtggctcaaaacccatgtcgaacattcggtcggcctcgtccatgaccaaataagtgactcgccgaagatttgttacttttcctgaacaataataaaataaggaatggtcatttgcgtttagaaaccattgtttgcggctaacatgtcaatcattctaccgggtgtacacacaattacttcggctcccttcttcagctctgcaatttgctcggaaataccgactccaccgtatacacaaaccacgtgaaggccgaggttacgagcaaatttattagcctctttccatgtttgaagagcgagttcgcgagttggtgacatgatcagggcttaacagtgccattaatgcaaattaggaacgaaaaaaaaaacgaagaaaaaagaccggcccttaccaattggcccatccatttcttcgagatgcggctgatccatcacatggc

SEQ ID NO: 43466 - DNA, 1250 bp, Heterodera glycines
agaataattggtaaatttttttttacctcccaagatatttatttattaaattaaggcaaaaatttgcccctccattccgtctgcttcttcatttgctgtccacggcgttcaaaacacgccactcggttcatctccatcggtcattccaaactcattgcaatcggataattcaccacatcctgtgcccgacgaaagtaaaatttattttttatttttttttggaattatttatttatttattttattgcgcaaaattaataaaattttatttctcgactttagatgtgtgtaggttgttatcttgcgatttcaacaatggagaaagtatgtgtttgtatagcaggtacttttttaaattaaatatttatttattttaattatttttttttttttgctaaatgtttcttttttttaatttgcccttttgagtgaataaaaaacccttttttgtccatattttcgaagttgacttaaaaatgctttcaattttaaattcacagttattaaaaactttgtataaacagcaaaatttttatctttttcttactaaaatcttctcatactttctaaattttttgaaaatttggctaataaattaaaaggattaaattgaaaaaagaggtcgccaaagaaattaatattaatttttttaatataaattatttgagttaataaagccttttgtttgctcattcttaaaaatcttgcgaattattctattttgttttacttcttttttagtacgcgtatttcttcttcgctgtccctttttcgttcttttaatcggagtgctttttcaatgctttttggaaggaatcgcgttacaatgattgaggcaaacgaccaaaaataaaaataaataaaataattaattaattaattcaaattcaaatttcagtcatctcagttccatttgaacgcgcctgctcgactacattttgacttctcaattacggtgcatatttgctcgaaaatattaaatttcatagtttataatcctgctgatcctgtctgagctcgaataaatcctcaccgggataaaatttgatgattttttagtgaaaatctgttaacaaattatattcaaattttcaaaaattttcccgccagccccctcttctctaaattttttttggaaaaagcgcgcttcgcaatttcgcgttttttggaatttcgcatttatttttatttcgcattttttactttcgcaaatttcgcgtttcgcattttattttccgattggccaatcc

SEQ ID NO: 43467 - DNA, 990 bp, Heterodera glycines
  misc_feature (91)..(91): n is a, c, g, or t
aaattttgaaatcatgtttcccactcctttctcgcaggggtattatttgtaaaagtcttttgttccacaataaacttgtcaaaccgcattnttcgcaccgtgaatgttatttttattgacttctgaaccgttttgagtagattagactagaaaacattgaaaattttgaaatcatgtttcgcactcccttctcccaggggtattattttgtaaagtctttttttccccaataaacttgtcaaaccccatttttcgcaccgtgaatgttatttttattgaattctgaaccgttttgagtagattagactagaaaacattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcacaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaaattgaaaattttgaaatcatgtttcccactcccttc

SEQ ID NO: 43468 - DNA, 850 bp, Heterodera glycines
acacttgaaaaaatcgatttatttttgttttcggggctcttcaaccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaatttctgcgttggatttttgctccccataaatgtttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcgggg

SEQ ID NO: 43469 - DNA, 280 bp, Heterodera glycines
tataataacgctgcggacatctacatttttgaattgaacttactgaggtaattactctttctttttctccatattgaccaccttactcatactccccccaccctttctcctccttcatttttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 43470 - DNA, 944 bp, Heterodera glycines
atgaaatttgattaaattttccaaccaatatgccattcccattgtttcgccaaaatagctggcaatggaagaaattgcaaccttatgaccatggcccgcagcttccatggcaggcaaaaaggagcgaattgtctgaaaaattttaaattaattattcctaattaaaatttctaaatttaaaatcagaatttttacattaattgtgccaagaacattcacatccaacgcctttctgatctgatcgtctttcaaattttgggtcagctcaaaaaacaaaatggcagcattcgcaataacaatgtcaacattgccttaaaacgataaaaaaaataatttatttttttttaatttaaaaatgaaattttaaaatttttcattataccaaaatgttgtcgaattttattggcacactgtcgtaattcctcggcattcacaatgtcacagcaccaactgttttttaaaatttaattcattatttcatgtataaattaaataaaaaatttatcattatttttttaattctaaattttatagtaaacccctgatttttttagaattaaattatatatatttaaataaatttttatatacgcttttgcaattccgccctttccacaaattgtttctgctaccttctcagcttcgtccttaaatgataaatggataaaaaagtacatttaaaaaatgccgttaatcaccaaatttcgatcaattatggcaactcttgcccccaaaccggacggatcggcaaaaatttcgctcatccgaagccccttaaacgtgcaaatttttgaaaattcaaaattttaatagcagtcaatttgaattttgctttttcttacaagcccagatgctcctccggtgatcacaacacattttcccttcacacttttttggcgaaggcacaaccaacgaaagaaatccttaatttatttaattttcat

SEQ ID NO: 43471 - DNA, 975 bp, Heterodera glycines
atcagctgtttttccatctctatattaattttgaatgactttatgattggacaacttttaatttgattgacattttaataaataagggaaaacaattttattcaaataccgtatcaaatggcatttaaattatatatcattttgttgttttaagtttcataaagtccttatttttttattttttgaaaattcatttataatttccccaatttgcttaaatcaattcgttttacaactttgtaaaatcctccgtatctttacttttgctttatattgccgaaacactatttttctttctttgcttttaatctttttacttttgtttatttgtctattttaaattaagttatgaaaagtaatttcatttaggtgggaggttaaaccaatcattgaaatagaagagttcaagttgaattgccaaatgtaccgtaaataaatttttaccgtgtttccttatattagaattttatttattttttagactttccttcccaaagggcatattttgttcctttaattcattttttctttcgagtttttttcattttgctttctttttaatgtgtcccattataagcgatccgattgatctttatttttatataaaaatggagaatatttacatttgaaaagtcaaatataataagcagaaaatatactttacataaatctaattacatttaaaaaatttatgttgaaacatttgtgggcttcgcgaaaaaagacaatttaaattagaatttaattaaaacattgcttataatcaggatgagaataactgaaaaatatataaaataatgacaaaaaattaaaatataaaaaaaaacaataatctgaacaatatagtgtaaaaatacattttgtaatcaaatttactgtttgactgcaagattactgtaatcaaaaatatgaattcttaattatttgaataaatcatttcaaaaaattataagtaaattattaatattaagagtt

SEQ ID NO: 43472 - DNA, 1594 bp, Heterodera glycines
ctcaacgcgaggaggtagtgacgagaaataacgagacccatttcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggttcggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggtgcaaagctgaaacttaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcgg

SEQ ID NO: 43473 - DNA, 807 bp, Heterodera glycines
cttttgggaaatgggcgaggggagagggtccggcggtggcgataggcgccgccgaaaaatttttttttgtaatttcgttctgatttgataacagcttttcaccaaaaaaggcattttttgcaattaaaagccaagcgacgatttttttttcgcttttaaaaacacttttttgcggggccattcttccaaaaattttggaggacaggggacccggcggcgccgataggtgccgccgggaaaaatgtgtgattttagtacgatttgttaacagatttttgtccaaaaaatgaccaaattttgccataaattttatatttttttgtaaaatagtgacattaggccataaaattttaaaattatgagtttgtttaagaaatcagaacaaattttggtcgctaccccaaaatcagaacatttctgacaaatcagaacatttttattttatcagatttggaccctccaatgataaatcagaacagatccgaaccctgttatagccacagtttatcctatttttataaaaacacaactaatgtgacgttttattttttactgcttaaaactagggctgatatttataggtgctaaaaatggaaaataggtgccaaaaagttccgaatttaggggtgtaaaaagacaaaatttattcaaaaaagtaaaaaaattagcccaaatcagtattgagctaaaaaattttaaaatcacaaattcttgtcaagaaataaataaataaattttggagataaatttttgagaaatttttcatttcttaggggtgtatttttgaaaattttcgggtcgattctt

SEQ ID NO: 43474 - DNA, 547 bp, Heterodera glycines
  misc_feature (21)..(21): n is a, c, g, or t
atttatgtcaatatacataantttctgttccaaaaatccccggttctcccaatcttcagtcagtcaatttttacctttttacctctcaaaattagttcatccgcgtacagaccaaactgggtcttttcattgtacccaatgtacagccgttttggatcaatcggcaccggacacgagccacattcgcccaggcattcacatcgcacatcgcacggcacaattagggaattccatggcacaatttttttcacattatattcaactaattttccatcctggcaatttaatgaaaaaaccaaaattatgaatattattttgcaaaatcaaatttttcacaaatttttcatctattttctcatcaaacagaaaattttttacaaaaaaaaatattcataaccttgcccaagattaatcaaattttcaaaaatttagagctattgaataagaatttaaaaaatggttgctttctagcaaatttgtaagcaaataaattttttaataacgctcattttgatggtttttgagtaacgtcataacaccccccccc

SEQ ID NO: 43475 - DNA, 1042 bp, Heterodera glycines
  misc_feature (956)..(956): n is a, c, g, or t
ccattatgagcgctaaaattatcagagtgccgaaaatcgcatgtgatctaagcctagcaaaaatggtgtaagtaaaaatcgtgaattacgctcaaaaagtttctcaaacaattttaacgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttaacgcttccaattcttccttctacaatcgcctttatacatcccattatgagcgctaaaattatcagagtgccgaaaatcgcatgtgatctaagcctagcaaaaaatggtttaagtaaaaatcgtaattacgctcaaaaagcttctcaaacaattttaacgcatccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaanatcgcatgtgatctaagcctagaaaaaaatggtctaagtaaaaatcgtaattacgctcaaaaagctttctcaacaattttagcgct

SEQ ID NO: 43476 - DNA, 1020 bp, Heterodera glycines
taaacactttcttcaacccgagcatgccttacctacagcagtcggcgaatcattagctgctcattttctaatatttttagaaatctcctcttcattttagaaaaagcactattttcgtgtctttttcagactgaattcatgacaaaatccgattaaaattctctcaattacatccaaaaccaattgcatctatattaactgctgcaaagaccaacctgcgtatgaattctgataaaattatgacgatcaaataaacagcaatttaaacccgagcatattcacttattgcatccaccggtgtataatagctgctcattttctaatatttttagaaacctcttcttgcatttgtgaaaatgctatatactcgtgcattttgaaaactgaatcccagtcaaatcccaacgaaatttcactcaaatacacacaaaacgaatttattattaatcgagattatgcactgcaacggtggttattttctgtcatataaaatcacaaaagttttaaagttttctcgacgacgctgcttaagggaaaaatataataaactcaccagagctgatatcgaaaataatcaaatcaaatcgtttctccgttttgagaaagcatgttgtttggctgatgtgtttttggtaaaattatgatgacccactaaacactttcttcaaacccgagcatgccttacctacagtagtcggcgaatcattagctgctcattttctaatatttttagaaatctcctcttcattttagaaaaagcactattttcgtgcctttttcacactgaattcatgacaaaatccgattaaaattctcacaattacatccaaaaccaattgcatctatattaactgctgcaaagaccaacctgcgtatgaattctgataaaattatgacgatcaactaaacagcaatttaaacccgagcatattcacttattgcatccaccggtgtataatagctgctcattttctaatatatttagaaacctcttcttgcatttgtgaaaatgctatatac

SEQ ID NO: 43477 - DNA, 1644 bp, Heterodera glycines
  misc_feature (1421)..(1421): n is a, c, g, or t
  misc_feature (1427)..(1427): n is a, c, g, or t
  misc_feature (1503)..(1503): n is a, c, g, or t
  misc_feature (1550)..(1550): n is a, c, g, or t
  misc_feature (1599)..(1599): n is a, c, g, or t
aatatttaaataaaattttttattttttggttaagttggccatcaattagtctttgattactttttgagaagccgttttaatgatggtgaaggtgccggtggaggaatgagcttttcatttgcatatttatcaccgaatgttattgaaggcggcggcaaaccaacatttgaaggacgacgagaaggcgacctaattgctttgataattaattttgaataaaaaataataaaattttctttagtgatttaattttcaaaattggttttttactttttattgatagagagacttttgaggcataatatgccttttttctgcgcaatagtttcgatatataagcataaaaaaacgcattttacacttcatttgaagctcctacgttgacttttatgtccttttttttttgcctttttcggggtttttgtgccgtaaatgccggctacctgacgtttcgtcactgaaataaatttttttaaaaatgccaaatttccagagctttccagggtcgctgattacgaatccggcatccatttcgacctatatcgaacccggactcaaaatcgaacaaaaagtcgaaaaatttcagaattcacttttatgttctaaaatagattaaaacagcaaaattaaatagaaaccattgcaacattagaaaataatcattctgcacagattcgaacataaaagtgaattctgaaattttttgaattttcgactttttgttcgatttcgagtccgggttcgatataggtcgaaatggatgccggattcgtaatcagcgaccctggaaagccctggaaatttggcattttaaaaaaaaatttatttcagtgacgaaacgtcttgccaccttaaatgccttttttggcattttggtgccttttttggcgttttttccagaaaattctattaaagatgcacctaagaatgaaaaattttctcaaaaaaggatcgtcaaaatttaattttttttttcttggtaaaaattttaggtttaaaaattttccttattcgaaaataaaatttaaaaatatttaatctttttttgcaatattttggtgcctattatagtgcctttttcacgatttttggttcctttttagtcggtctctatttattactttaaatgactgtgccttcgccgttttcgcaaattattcaaagcattttctaaatggtgatcatctgaaaaaagtattcaaaatcatattaaaaatgttttttatttaattacttgttggaaattcgccctccgggtatgaattgctccttctcaactcaatgcattcgccgccaacaaaagaaacccacagggactggaccaattcagtaccaaaaattactgaaaaaagattttggcaaataaaacaaaactacaagggcagtgaaggatttttaggtaaatagttattttatgcgnaatganaataagcaagaaaatacacattttccacatgatttgaggcttctagactaactttataatccaatttcttattaanttgtcttctacatattatttaaaagtacatatttttcaggattttcnaaaaattgcttaacaaaaattcaaaaagaaaaaagcactcctaaacttnatctccgaacaaaattttggctatttaaaaatttttgctcctttc

SEQ ID NO: 43478 - DNA, 1093 bp, Heterodera glycines
  misc_feature (1084)..(1084): n is a, c, g, or t
aaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaacaaagatgtaaataaaatttggtgcgtttcaganaccctttct

SEQ ID NO: 43479 - DNA, 908 bp, Heterodera glycines
cgctccacttcgcccatcaccgtctcctggcgtttaatgctctggtcgattttctctttcaatggtccgaataattctttgattttctctgagctcattttctcttcattgattacgccattttcactcaatgcttttgcaaaatcggagctcatatcgcagcgaatctgaatggatataattttatttatttttaatataatttcggaaccttcttcaattccttttcaatgttttctcgctccattttgatttcttgcacttggtccagcaaatttcgtaaggtgtttactgtctgtgaatttgaattccctttatttgttccaatgcctggaattgtgttcttcagttcactctaaaataaaactaaaattctggaaaagtcaattagacagaaatgcctcagtcatgctcaacagttcaatgccacggcgattggcctcgaatttgctgcgcactaaggcatccgaatttgacgcggtgtgcataatcccgcggtacttccccaattcctgcatgagcggcgccgtgagattctccgaagggactcgcgtccatttcgaatggaattgagcacggagactgtcgtcattttccttttcctctttgataagtcgtgaagtctgacaatgaatggggagatggcatttgttttagcacggcttctacctcattcaaaatctcatcgtttctcttataaagcgatggaagttcgtttatcttcgctgacattgcagagattccgccgttgtttttcaccttggccgacttttcgcgaatagactcgggacactgctcctgttttgtcacgtcatccaaagcagcgggcaaattcaaagatgacaaacatctaaatatattcgtatttttactgtctatgaaaaatgcgctgacgcatcatcagctga

SEQ ID NO: 43480 - DNA, 906 bp, Heterodera glycines
aaagctcttcaatactccgaaatctcgaatcgccatccgtctcacttttacttatttacgcacgtttttattttattttcggcataataaatcgtaaatttccacgagaattaaattttaatttaattttaaaaaattaaaatcgtgaattccgttcataatctgcgtatcatattttcctcctaccgcacaccaagattttttgaatgataccaagatttagttggcaaaaagcttaaaaatatttttaaatatctcatttttcggtaggcgccacttgtttggtggctccggaaagagcattatttcttttgggggcttttttatggtaaaataatatttcgtgacaaaatttcctattttccttggttgatgaccccttccaaaacctcgcgcatccaaatttctcaaaaaaatttcgcaattttttccaaaaatccacaaaaattagctaaaataaaatttttttgtaatttttaggtgaaaatctgttaacaaatcacatcaaaattttaaaaaattttgccggcggcgcctatcggcatcgctggcccccttgttcccgaaattttatcggactctgcgacccccctaaatccatctggtgtcgcatctattcgacttttgatcagagaactggtcctgacatgatcaaatggatttcctagatccccaacatgggaaatttgggaaatgcgtaagtatttttctgggtacaagtcgaaatgacgttttgccttgctgcaatttcatgcaaaaagggaaaagcttaaacgagaaaagttacggtacatttaaaatattggatgtttactgcaaaagtgtatacatattgtttcgacacgaatggttttcattgagaagtactggagtgtactttctgtggtacgactgctgatagactgc

SEQ ID NO: 43481 - DNA, 1168 bp, Heterodera glycines
  misc_feature (18)..(18): n is a, c, g, or t
  misc_feature (35)..(35): n is a, c, g, or t
gtggatcaacactttatntgaaacccgaattttcnatatatggatattgactcacttttgttgcaactttttaggggataaatttttctacatcttctgcgggataggtatggaccgggatccccgctcccgaggatgagaaaacgacggacatcggtaaaatccgcgaatcccctactctgtttgacctgctgaagatatttcgtccaaatcatccgtatccaattcatcggtatcataattctgatcatcgctttccactcaagaagctctcacaaatgccacccaaccagtgcaacaaatagaattattttccacatagctaaaaattgaccatgatttttttgccattaaatttgatttttgatataattttttaaaactgttcatgccattttatttaatatcgaacaaattaatataagtgaatttatttatttaaatgctatttttctaggttttctttttttctttttctctgctgaggttccacctctcatgatatcatttacaaaaaaaaatttttttgatgcaatacttttgacctgagtgtattttttcaattatcgaggcggaaaagtccaatttaattgacaaatttcaaaaatttttaccgacgcatattgaaaaaagcttctcaaggatatttggaagacgaattttatttaaatcgaatttaccgctttcaaaatttcaaattcatcactgaacaacaaacgatcattatcgagaagattgcacaacattttctgatcagtttgcaaaaataaatgccatcaccgagtaaatgaatctcaactttgaacgctgctggttcaacgtcggggacctccaccataaggcaattagcagaggctaattgaaaattaactaaagtaattaggatagactaattggagaatgaaagatgattaaatttttcttttaaaacaaattttttaccgttttcgatttgttttttcttggcgtcaaacaggaacattgcctcaaaaacatagaaagcattcttcaaaatgagttgatgtgaaggctaattaattcaaattgaaaaataaaaattttaaattagactcgccttttttgcgtctccgttcaccaccaaaaagtgcaaatccgaatgtttacccgagcgcaacaaatgattcatccgtcccattaataaggaaaa

SEQ ID NO: 43482 - DNA, 903 bp, Heterodera glycines
tggtgtagtaaaatttaattctcgctgatcgatcttcttcgcgagtttggcccctcaacgaattttttgttgctcccgatggatgggttggtccgtccgattttcccccgagattgggtggggttgggcttcttttgtaagttggattatgcgcacccaaagttcgtccatataaattgtttaatttggttttccctccattttcccatgttttcctccggcggtgtttccgttgcccttttttggcttttgtctttctctttttcggcggatgggctcagttttctcttttttctcatcggcaccaatcagttcgaacgtcacacttttgagtttatggcacaggaatttgcgcgaagggctcacaaagtgatgacggtgaagcccattttggtgccggaggaaccgcgattggtacaaaaaagcagaggaaagggaagaaatgaaacaccggacaaatgcccggggggatttaaagatgcaatggttaaatctccgaccaatttgataaatggggaaaaacagcgaacatttgccatttggttccctccctttccctgaaaattattaaattttcggttttttttgttaggtaaagcccattctgcacatggtcaatgagaaagtactcaaagatgtgttgccgaggtgaataaattggaaaatcgaattgaaaaacggacaaagggaaaaaagaattgcaaaatgtccaatgactaatgatacagtaaccaccaaaaaaaaaacagtaaccaccaaaggagccgctgaagcaacaccatacactcagcagagagcataaaaacacgtgctaattaatcactgttcccttatcaaaaggcgtctctccgaacccctggcgcatgtcggacaaaatgtgccctgggcgaagaaacggacgcg

SEQ ID NO: 43483 - DNA, 1411 bp, Heterodera glycines
tttattaaattataaaataaccgatttgaagaaattttaaaaacgtcgattttgaacaaaaaatcacatctttcgatctttaagtttttttattttttaatcgggactaaccgcaaattcggggattccccagcagttagttgcccggtttcatcgttacgtcgtcgaatttgtgctggaaatcgcgcacatcgctcttttgtgagacaaagcgaagagttgccgaacaaatgcagcccaaattggagtcttcaaaccaattaatcagttaattagcacttttaattgcccaattaattttcatttaccatcttttggagcgtcgtacaataggaaaaagcccagctatttctcacagccagcgatttccctccactttttgagttcttcccatttttttttgcgttcattattgttttcatcgttttccttcaattttttaccgttttcttccaatttttcatcaatttccaacaatttcttactgttttctatcaatctttcaccgttttcctctattttgttggcattttccattaatctttcaccgtcttcctccaatttttggcattttccaccaatctttcacccttttcatccaatctttcacccttttcatccaatctttcaccattttcatccaatctttcaccgttcctccaattttttggttcctctaatctttcaccattttccttcagtttttcacaggtttccttcaatgtttcactgttttccatcatttcccgggcattttccttcattttctcaatgtcttccaataatcttttagtgataaatttttcaatgttctcctccattttctttgtcttctccttcagttttcaatgatcccttccatttttcattgttcctccaattttcccatgttttctttccattttttattattttccatcaatgtttcactgttttccttcattttctcattgttttccaccaatttggcattgctttctctccatctttcactactttctgtccatttctctctgctttccatcactttttcggcatactctttcttcatttggatttgtgctattattttccatggaaatattttgatcttcataacttcactatgtcgcttatttccaataatttgtcgcataaattgcgacactttttcaatgcccatcacaattgtgccaaatgtcaacattcgccaatgacttggaaattgcagtgggtacaataagccaccggatgtgccactaatgttcgggaggcaaaggaactgataaacgccgaccacttcttccattgttaacacaccggaagaaactggaaaaacaattttaattcattaaaaatagtaaaaaaaaaaattgtaattttcgcccgggaaaagaaacacgattttgagttcttagtttttaaaatagca

SEQ ID NO: 43484 - DNA, 1019 bp, Heterodera glycines
agtctattggaaatagtcacaaacaaactttttttcactcccaatatctaccagttatcatacaaaaaggcaatagttaagcaccgagatataaaaaaatcgtctagaataattatctaaacaatttgtcgggaaagctcgtataaattctagggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaacttttttttcactccccatatctacccagtatcatacaaaaag

SEQ ID NO: 43485 - DNA, 1076 bp, Heterodera glycines
ccttcagaaaaaatttgaggatggtggcgatggtggtggcggagatttttcgaggaggaattggtatagctccttccgaccaaagaagactggttatcaaacatccaagggggagtggctcgattcccccgtccccggctggcctttgtagcactatcaatacaatggggaataattccagccaaaagcctttcggggtaaaaaggaacatccgaaatactgaagcgagatttcattttggtgtagtggaattgggcgacatgttcaacagagctacccaatttctgcacataatcctttggagcttcttttgaaggtgatgtatctcctcctccttgttggacaacacccaaaatttgattgatgactaagtcttggcggggttttttgggaagaatatcaacgaatggagaattcgaaggacgtttttgttggtaatgttccattacgaataattgatttttttttttttttgtaaaatttatcaaatgaatggctaattttactaggtgaagaaatgacggctatttatattaattgtgacaaactttcgtttcaatacatacttttggcgctaaaaattaaattcaaattaagaccatagccgaacaataatttgtttaacacgcaacgccagcttattttggtgccaaaattaaattcaaattactataaattgtcttacaatacgctatacacaacgccaatttcgtttcaataacatagtttttggtactaaaattcaatcaaattactcaaattgtctaacaatacgccatacacaacgccaaattcgtttcaataacagggtttttggcgctaaaattcaattcgaattttgcgctaaattttaaagtcaaaaactcatataaaattagtttcgcaatgatattccatgagtggcgattaaattctaactggtacaaaaagttaaacaaataaatttacagaacgccatttttatggaaagccaaaaatggcggaatcttaaatttaaaccgagtcaacatgcttgcgccaaaagtaaatttacataacgtcaatttcgcatgatactctatgagtggcgattaaat

SEQ ID NO: 43486 - DNA, 1045 bp, Heterodera glycines
  misc_feature (1026)..(1026): n is a, c, g, or t
gagtgtgtgtgaatttgcaaaatggtgggttactttggttatccatctctccccttctccccccccccccccttcttttgtgtacctttcgttcgttcgcttaatcaatttttatcttctgtgaagggatgactcactctcatcgttcgcatttgtcacattttatttttccgagtttactctttaaaaaatgtgcagcttatttttcattgtcagaatagcaatttaggtaaaccatcaaagtaagtgatgaatgactgtacagagaattcggaaacggcactccaacaacaattattattatcagaaaatattcaacagaaagagaaaaaccaattccaaagccgaggaaatcactgccaaacaattttcacaataaatcaacttttatcacgactaaatacgatttggataagagcaatttggtcccaattcacaatcagccaattcaaatagccaataccaacagaaacaccacttaataactcccacccggccactttcgccacctccgttaccgccgcggccttcgctttccggcatggaacggccgctaccactgcctcagttgattgaccacggcggtgccctttttcacacttcggccattgataaaagcattatcggagaaaagaaaacgcagcggatttacccgattttagacgaccttttttacacaaacacaaatgagatggacaacgagaagtcgaattcggcactcgcacagacaatgagttgctcttcgaccactgccagtgactcccattcttcagaaaacagcacttcttttatcgcttcttcaattggccttgagattgcgccttctccttccaatcccttctcgtcgtattgcgagcctttcgatggctatttaaaatttgatggtgaatcgatttgcttctcgggttgggtccaactgccccaaggaatgttcaaacatcgcaaaaggggttgggctgttgtgcggaacaacacattctcaatcagccaagacagacgaagttttcccggaaaagcttctcaaantgttcccatttgacctgca

SEQ ID NO: 43487 - DNA, 995 bp, Heterodera glycines
  misc_feature (929)..(929): n is a, c, g, or t
  misc_feature (932)..(932): n is a, c, g, or t
gaaaaagaagaagaaaaaaggggaaataattggaaaatattataaaatcaaagaaaaaatcaagcaaaaagggagaaaatattcaggaaaagaatcgaataaaattgaaagaaaaattgcgaaaaaattggggacaaatcgaacgaaaatttatgaatggattaaagaatttggtcttcaaaaacaaatacagaaaagctataaatcaaaaactgatgaagaaaaaaaatttatgaattaattttgcaaaaaataaataaaaacgaaagactcagattttcgaaaatttttttagagccagctaactcggcgctcatttcagtgtaagttagtcctttaccggggagtatccctgcaaagtttggtacgcttctgctcaattagcaaaaaatatgagtgatcgaattttcactaaaaaagttaagcctaaattttttggcatatttaaaaagcaattaaaaatttttaaaattttattcacctcccttattgatagaaaaagcatcagagagccttatttaacttgtaaataaaatttggtgcgtttcagagccctttctgaaaaaatatttatgaattaattttgcaaaaaataaataaaaacgaaagactcagattttcgaaaatttttttagagccagctaactcggcgctcctttcagtgtaagttagtcctttaccggggagtatccctgcaaagtttggtacgcttctgctcaattagcaaaaaatatgagtgatcgaattttcactaaaaaagttaagcctaaattttttggcatatttaaaaagcaattaaaaaatttttaaaattttattcacctcccttattgatagaaaaagcatcagagagccttatttaacttgtaaataaaatttggtgcgtttcagagccctttctgaaaaaatatttatgaattaattttgcnaanataaataaaaacgaaagactcagattttcgaaaatttttttagagccagctaactcggcgctc

SEQ ID NO: 43488 - DNA, 660 bp, Heterodera glycines
atcagtagggttgtaaattatatgcttttgcatattttttctgcgcatatgctatgaagaaagggggctcaaaaatagcatttctgcattaaaattttttgatttggtgcaggtttttagtgcatataaaagcatattttgggggtttttgagaataagtgcatatttgaccatttttgcatttttagagcatattttggtcattttttggaaattttcataagaaaaatgcgataaaagcgaaaaatacacccctaaggatcgactttttggaattttttaaaaaatacacccttaaaaatcgaaaaaattttaaatttttgtaagaatttttggaaaaaaaatttatgtatatgtaaaatgtaatgttgttttagcatataataaaatttataaatttggaaatttcaatatttttgcaattgtctaaaaacgctccttagccattgttttggtgttttaaaagtcaattcttaatttatacacaatttttggcattttttgagggctaaaagccatttttggcagttttttaaggcatattttagtgcatatttgggcatttttcgggtttttagggcatatttgggggatttttagtgcatattttatgcgcatatttgccattttttagtgcatataacttataaccctaattat

SEQ ID NO: 43489 - DNA, 1686 bp, Heterodera glycines
  misc_feature (87)..(87): n is a, c, g, or t
aaattcccgtctttttctttctaatctctcttcactctttaattttactgcatcaatttcgcggtttttgtttaaaatgctttcaanacgcaacggaagctctgttcaatgcggaccgtcgaccaaaaaatgggatttccgttcaatcgggtaagcgttaataaaatatttaaagaaaatattaagagacaacgtaatcgttttctaccaattaaaaaataaataaattttaggaacaattttactgaagaaatggaaaattataaattgctggattatcaaacgactacttgccaaaaatttggatttacgaagaacattacggaatttcgtgtcaacccggacgggggacgccctgatgaagcaatgagggaagcgatcgacgacatgataaaggtggcttttaagactacggaagaaaaaatgaagcgaaaagtgcggatgtttggagtggcaattacgggtgccgggcttgctttcccggtatgggtaccgtacagggcgtacccgcagaacaatgcggatgttatcatgcaggagattaataagctggggcagagcggggacggggatgaaaataagaaaatgcttttattatcggaaccagttactatgaaaattacttgcgtgaccatgcccagtggagaggggccgaggaatgtccacaaatttgactttggattgaaggaacaccagcggatagggtaagtgtttttaataaaataaaattaaaatagaaaaaaactaaaataaaaaaaaatcaataaataaatttaaaataattatttctaaaaaatttaatgaagcaaaaaaaaatttttttttaaagaaaaaaatgaaaaaataataatttaatgaaacaaaaaaaaacacagaataaaattaaaaataaagaaagtaaaaaataaatttaaaataattattttaaaaaattttaatgaaacaaaaaaaaaaaaaacttaaaatatttatttttaaataatttaattaggcaaaaaaaaaaaaaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtggaattgatattaacgaatatagctatggtgtggagcaattgccgaatgttcagaaatattgggtgggttaaatgaaaaaatgcaaaattaataaatttttcaggatgagatttaccccggaaagtaccgggttgttgcgtttgagaagtctgcagatccgcggaaatcgatccgtgttttgtggaagggccctatgggacgtgaaaatgtagtgccgatatttttggagaacggacattgggatggtctgaagaattatgtctgctttttcaaccgggggaggaagttctgcgttgaatgtgaatgcttttacgatcaggatgtttatcatacgatggattgccgggcgagatgttattactgcaatagagttggaggaatgccgtgtcaaaaggagagtggagtgaagattgaatgcccgaagtgccaccgttacttttataattgggagtgttacaactatcatcagggacatcagacttgcaaattatggaggcgttgcgtgatctgtga

SEQ ID NO: 43490 - DNA, 1432 bp, Heterodera glycines
  misc_feature (162)..(162): n is a, c, g, or t
  misc_feature (1087)..(1087): n is a, c, g, or t
  misc_feature (1120)..(1120): n is a, c, g, or t
  misc_feature (1161)..(1162): n is a, c, g, or t
  misc_feature (1176)..(1176): n is a, c, g, or t
  misc_feature (1189)..(1194): n is a, c, g, or t
  misc_feature (1196)..(1196): n is a, c, g, or t
  misc_feature (1204)..(1206): n is a, c, g, or t
  misc_feature (1209)..(1209): n is a, c, g, or t
  misc_feature (1223)..(1223): n is a, c, g, or t
  misc_feature (1234)..(1234): n is a, c, g, or t
  misc_feature (1246)..(1247): n is a, c, g, or t
  misc_feature (1255)..(1255): n is a, c, g, or t
  misc_feature (1279)..(1281): n is a, c, g, or t
  misc_feature (1290)..(1291): n is a, c, g, or t
  misc_feature (1296)..(1296): n is a, c, g, or t
  misc_feature (1299)..(1302): n is a, c, g, or t
  misc_feature (1319)..(1321): n is a, c, g, or t
  misc_feature (1323)..(1323): n is a, c, g, or t
  misc_feature (1333)..(1333): n is a, c, g, or t
  misc_feature (1409)..(1409): n is a, c, g, or t
  misc_feature (1427)..(1427): n is a, c, g, or t
gaaggaatggatttaattaaattctctccttcggggattttttcccattaggtcgtccgttagcgttcgattgctctagtcaatttttcaaaatttttgttgaaatatttgtcgtgctctgaagggcgtgggagggggggggggcgaagggcccaccacganggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaaaaacattcacggtgcgaaaaatggggtttgaaaagtttattttgaaaaaaagactttacaaaataatacccctgggagaagggagtgggaaacatgatttcaaaattttcaattttttctagtctaatctactcaaaacgggtcagaaatcaataaaaaaaaccctcccggggcgaaaaaagggggttgacaaattttttggggaaaaaaagactttacaaaatttttcccctggggggggggggtggggggcctggtttcccngttttcccttttttcttgttttttcttctcccnccggttccgggttccctttggttttccttcccggtgcgggnnttggggtttggccngttttttgggggnnnnnngncttttccnnnttnttcccctggggggngggggtggggnccctggtttccnngttttccnttttttcttgtcttgtcttctccnnncggttccgnnttcgnttnnnnttcccttcccggtgcgnnncntggggtttgncccgtttcttgaggaaaaaacactttacaaaataatacccctgggacacgggtgagaggaaacaatgatttcaaanattttcaaattttttctnagtct

SEQ ID NO: 43491 - DNA, 874 bp, Heterodera glycines
ctccctcccaatgggcatatacccaatgactcccccgttgggcatatacccaatgactccctcccaatgggcatatacccaatgactccccccattgtgcatatacacaatgactccctcccaatgggcatatacccaatgactccctcccaatgggcatatacccaatgactccctcccaatgggcatatacccaatgactcccccgttgggcatatacccaatgactccctcccaatgggcatatacccaatgactcccccaatgggcatatacacaatgactccccccaatgggcatatacacaatgactccccccaataggcatatacccaatgactccttcccaatgggcatatacccaatgactccccccattgggcatatacccaatgactcccccgttgggcatatacccaatgactccctcccaatgggcatatacacaatgactccccccaataggcatatacccaatgactccttcccaatgggcatatacccaatgactccccccatcgggcatatacccaatgactccctcccaatgggcatatacacaatgactccccccattgggcatatacccaatgactcccaccattgggcatatacccaatgactccctcccattgtgcatatacacaatgactccccccattaggcatatacccaatgactccctcccaatgggcatatacccaatgactccccccagtgtgcatatacccaatgactcccccattgggcatatacccaatgactcccccattgtgcatatacacaatgacaggccccattaggcatatacccaatgactccttcccagtgggcgggacccaatgctccccccatcgggcatatacccaatgac

SEQ ID NO: 43492 - DNA, 1025 bp, Heterodera glycines
tgctctggatagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacacaagtattatttttttttaattatttttttcattttatcacccaacgttctagactgatcagaagctcaccaaattttgcagggaaactgctgagaacccttcaaatgcttataaattttcatagaattttttgcctggaggaacacagttcttcacacttgccacaccagcattatttttttttaattgtttttctcattttctcgcccatcgttctaggctgttcagaagctcaccaaatgatgcagggaatctccagagaacccttcaaacgcttattaatttacttagaatttttagcctggaggaactcagttcttcactcttaccacaccagcattagtctttgataattatttttttctttttatcacccaacgttctagtatgatccgaacctcaactaaatctacagggaaactgttaagacccctgcaaatgcgcataaattttcttagaattttttatccgttggaacacagttcatcacactaaccactccatcagtatttttgtataatcacttaattcggtttatgcgtaaaaacgatgtagcctcatgaaaatatcaacataataacggggcaccacaaatacacaccaacagatcacatcaataataaatataagtaataatagggagccatgaaggtgagagtgagtgcgctgcttgcagagggtgagcaggtggttcatcacatctccaagaattgttaagggtgcgcacgcggtcgacaagactaaaaaaacaattgaca

SEQ ID NO: 43493 - DNA, 1256 bp, Heterodera glycines
  misc_feature (1243)..(1243): n is a, c, g, or t
agagaagggaacccttttttagtagggaaatgtcgtccgattgacctccttgcccaagtcggggaaaaggcgggcgaaagagtcgggcaattggaagtcgtagacattgggttgagcaacgaacaattgctgacctaaacaaaccaatggacaaggaaaaggtcggaaaaaagaccgatttccttaagcgctgtgctcgatagagtgatgcaaagcatcgattgaccgtttctcttcccgctctgtgggtaaaggtaatcggccccagtgctggcaggaaacttaggcacagagtgcaccagccaaaagccggaaatgtcgtcgaagacgagcactccctaaagcgggcccattcgatcgccaagggatggatgccctcgtccgtgcccttctcactttcatatgcgctcgatttgagtccgttttgccattgtttgggttctcatcattaaacaaggtaaagaaatcgccctcaaatggaaaacggttcagaaggcagttgagacagttctgcttgccttttttttctttgctgtgaacagttgcgagacggtcagtccaattgctgaacttttgtcctccacatttttgtcggaaaggcgccaagcggcggtgttcgcgtccgaataaagaaaggcggtgccgtcgccatcggaccccaaatcgggcaatttgtaagcgacaaacctgtaaaatggcaagggaagcaaaagaaatctaaccaatcagtcgaactgaccaatcgacctcctttcccgacaacgatttgcaagaatacccgaagagattctgtgggaaaacggagaacagcgccaaaaaggaggcgagacagacaacggcacccattgaatactttaaaaatgttcgatgcaatgttcacaaaaattattaggttgtatttgaacatcctatgcatatatttactagacaatgaaccaataaatcaaattttatcatcaattgtatacacagcggtccaagttcagaggtccccagacgcacttttactctaaaacattggaccgcaagtttgagtaatatttgaaatcgattgatcagagatttgtgtttaatatccataaaatacagaaaggagtttgaattacaaattacagaatgggatgaaaaaaagcaatcctaagtattatatatagcaaagacaatgaaggacaaatgacggcgccattccattcggaaaaataagtccacaaatttttaaataacaaatgcaatggatggaccncgtaaaaagttac

SEQ ID NO: 43494 - DNA, 877 bp, Heterodera glycines
gaatttgcgcagaatttgtcgacaaaaaagagatgacagagaaaggagcggcacaaccgaacccaatgcttagaattgagaatggcaattagcgaatttgaagaagacgattttgggaatgcaaaaaatgacatcgaaataaaagggaaaagagggacaatcggtacagagaaatgggcaaaagtgcgcgaaaaaggcattgacaaagtgccaacccaaccatttgacaaatggaaacacattccatgtcgagaaggggagacagacaaattttgatttgaaatgccattttgttgagaaatgaaaatgaaaaagggcatcccacttaaaatgtttaaaagtgatgggacggcggcgatgacatttgtacggttatttatgcttaatgatgaaaatgcttaaaaggttttacgagacaaaacaacacattgacatttcttaaatgatgcaatgaaaagccaaaaaagaaaaagttgcgggagggagtgactgagagagattaaatgcaaaaagtgatgtgaggggataaagcggatgaaaaaaggatcgaacattaacagggggggggggggaagccgaaagaccgaccgatggacagccaacggaaattagccattaaaaagggcacagcagcagtgccaaaagcatggcgtgggttgggagcagcgcgcggcattattaagttacggatgaccgaacggtgacaaattgggggtcaacaaacagaccgtaagaaggcgtaaagcgtaatccgagaagaatttatgatgagttctcaaaaatttcacaattaaataaattcgctaattgaaattttaaccgaatttttaatggcttttcaaattgcctcctctcgtcacaattggggggggggggg

SEQ ID NO: 43495 - DNA, 539 bp, Heterodera glycines
attatgcaaaaaacaaataaaaacgaaagactcagattttcgataatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactaaaaaaatatgagtgatcaaactttcactaaaaagttaagcctaaac

SEQ ID NO: 43496 - DNA, 987 bp, Heterodera glycines
ggataaaaaatgtcaatctgctatacaacagcgatgctatgtggcgcatcacgctgactgatgttcacacattcatgcgcacgggagagacaacaatagagctgatacctgacgcattgccattggcatgttttgaatatggcaatcacaacttttttattttcgacctaaaaaatggagcaaatgaagtggcagtgatgcgtggtcaaaaacaaaaagttgcacatcaactgacctcatatggacgcgtactatttgaccacatcgatgctcggctgtatttagtagacaagagagaacggcgcatcaatgagctgtccatctcagacttggcgcgatggtggctgatgaataacactgctgctgctgctgttacaggaaatggcaataacaacgctacacaccaggttcgaagcacttttgtcggattgttgcccgagcaaaaaacggattatttcattgcttcaaatcatgtgtacctgattaggagaagacgtgtgtataagttccgagtaggcggctaccataatcagtcattctcacagctccagtttgtgaccaactccagcgacactcgtttcaattttcttctgtttgaagaaaagaagcgcgaacgtggtgacggccattttgcacgatcagctgcaacatccagtgtagttcatccctcatcaaattgggcagaaaacttgatgtttacattaacctacctgcttgatatggtggtcctactgatcggaatatgtgctattcgtatggtccgtcggagcaacagaaacagcgatgccgctgtgacaaagctggacgaatatgacctgattcactcaatgtctttattgcaaggtacagggggcggcccatacccccaacaatctaccgttttataattctacaacggtgacagcatcatcactatagcttaagtcgtcaggaatcggtatataaactcgccgattttgcctacagataattccattattcatcaac

SEQ ID NO: 43497 - DNA, 1043 bp, Heterodera glycines
ctgcagcatttcatgcagctcttcaaaagctgtccgaacatatttttctttcttttctaacgcattttccaagcggatttacacccatttttggacccgtattttttgtaccccgatcacattctgaaaaaaataattgatgcgctaaccctaagtctccccagttattctgcgcattgctttctccaacgcgagagcaaagccgcgaatttgtttcattttcctcctttttgtcttttttcatgccgctctcgaccctaactcagcaacgggtgggcgtacagcagcggcgactgcagcattcaatgcagctcttcaaaaggtgtccgaacatatttttctttcttttctaacgcatctccaagcggagttacacccatttttggtcccgtattttttgtaccccgatcacattctgaaaaaaataattgatgcgctaaccctaagtctccccagttattctgcgcattgctttctccaacgcgagggcaaagcagcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggatttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggatttacacccatttttggacccgtattttttgtaccccgatcacattctgaaaaaaataattgatgcgctaaccctaagtctccccagtta

SEQ ID NO: 43498 - DNA, 963 bp, Heterodera glycines
  misc_feature (910)..(910): n is a, c, g, or t
  misc_feature (912)..(912): n is a, c, g, or t
tagatcggcccaatttctgtgaagaccagcagcttttttgtgtcggcatcagtgactgctcggagtttgatgaagaattcgaagcgctcctcccagattttccatgccatctccgctgtgtagggtcccggcccttttccaacttttgcttttggctcggccatcctttgtgaatgttgacgaatttggacgctgatgatttgacgtgggaattactttacccttttgtgaaacttcagctttgtagacagaattactttactgagctgacaaaacgaattcgtgtttactttcacgtttttaaattagctttttgagcttttcgttggatgaagtcggcagttgaacgctttactttgcgtattttatttaactccgattgtgcctcgtcgctttgttttgcactgctgactgcgccagtgaactgttgtgtccgaccaacagccaatttattttatgcagtgaagaaataacaaatatatgcggaggtcaaagttgatgaggaagaacaaaataataaatgaagaaagactgggaagactgcggggagaaggagggaaagacaacatttaaatagacagcaatgacagttggggattaagaggtaaaatatgaaatgtccatttgagtcccatcaaataagtcctcatacacgacaatattcccactaatttaatttttggttgcaatacacacgtcggagagtgcaaatgtcggcaaaaccattcattaagattaagaaatgtccccatttacataaacaaaaatgatgattaaataatgtatttaattgatgggatggctcacttttcataagagaaagtaataacaaagggacgacgaaacagtaatgatgcccaaaaaatgtcaaaatgggaaaggaaatgagaagcatttacatatcaaattncngcattttatgcctgcttcttctgctgacaattagaggcgccgcttaactct

SEQ ID NO: 43499 - DNA, 946 bp, Heterodera glycines
agaatttgaaacgagtaataacctctgaattatatattttggtacaatttgtcggatttaccctccccccccccccccgttcctttttgggtccggaaaatccgtcagtagacaattagtcagcaaatttttttaagcaattatcgagaagcttggtatttaataataaaaaaaaagaaattggatgggcttttacaacacttcttaattaaaaaaaatccaatttatcattctatagaaataatcttttaaaatggttattcgttacttttataaaataaaacaaattattatttaagtttttccaatttaattcatttttacatttttatttaaaattttgcggttcaaaataaaattgctgatggattggccaggggcacttcattttcaccatttcctcgtcaacatatttcccatggatttggcggcggggcggggatggaatggctttgggtcctcgggcggtggtcgctttttggcggtaattttaacaaaaggccgggggccaatggggggggcaattgaaaaagctggaatgggggggaaataaaattcagtgatctggccgcctctttctgctgacgatggcgatttagcttttacttcttctttatggatattaaattactattaggtgctaattaacgcgaaattgtcgattaactttgctcacatcgctcatccgcgccttcagccgataattgtgcttcatcgtgtccagcttcgccttgcgcagtcccttctccgtggacataggcgaataccaccgaaattatgaaaaggcaaatcaaccgctaattgggcccatttagtgctttcaaacaatttccggaaggatggggccgggattttttcgaggtttgtgcccttttttaatgggagggattttgcaggggatttccaggggaaagaaataatcgcgcagcggcccacaaattaaagg

SEQ ID NO: 43500 - DNA, 1118 bp, Heterodera glycines
agaaaagctggcattgccaaagttatgaaaaataaatggggcatcgattggataatgaaacgatgcaaaatgggggaggccgtattcgttcagcagcagaagaaagatgaaaagtggatcaacaatttaacaatgtgatcatttggcatgttggtggcactaatagcattgggtgagcaattagaaaagacatttaattttgtttaaataattcgaattgcgcttaattaaggccattgtctcctccaccggcagaagaaatgaattaattagaaatgaccgatcgaccataattatatcattgatcaaatgcattttatgaagaaaaccctctcaatttcggtaaataaatcggatgtataaaaatgggttttctatatatcgaatgtatgaatttcggtacttgtgcagtttacatgatacttttaactagagaccggaggggatcgggactcccgcgggattttacggaattcacgctccggtaaattttgaactcccgatcccgctcccggaaattttacccaaaaaacgggagtaaaaatgcactggtaagaattgagttttttggtaaaaataataatttttgattgaaaaatctattgaaaatatagtccaagccattcttaggggtgtatatttaaccccgaccccgagtcggggttaagggtcggggttggaagcgtcggggttcgggggcccaaccctacttttttgccccaactcgttttgagtcaactcctttttattaccccaactcgttttctgatgggaaaatcgaggtcgaatcaaagaatttcaaagattttttggtacttgtccgttatctgtggtgcagattttcaaaaaaaaaatttgttttaataaacttgttctaggggtttttagagccgggaaaaccaattctggcatctattttggccaaattcgaaccccaaacccggattcgaacaaaaaaaagtcaaagtccgtttttttaaattcacattttatataccagatttccacgactaagaccacagaaccaaaaaaatgccccgaccgacgactcgtatgaccaaaaaacccctagaacaagtttattttcaaaaaatttttttttgaaatctgcacacaga

SEQ ID NO: 43501 - DNA, 914 bp, Heterodera glycines
tctctccgccggccattcgccgtttttaggttcagtcgcgttatttgagcagccgccgtgccgaccttctcagtgcgtgcactttccccagcggcaccgccgggggcagccaccactttgtgtcgacagtgccgggctcagcccgccgcgttgggcttttccccatcggcaacgatgctaatcgcccggcaaattcggcagcaagtttcggctcacgaacattcccttccctcgcgcggtcattggcgccgtttctgttaagcggagccgacgcggggccaccgccgtacgcgcccccgggacaaagaggtggggaaaggatggagaaaaaggaacagacactaacggcacaatgccaaattaccattcgaatattttgacagttcgtcggtcacgcaacgaagcgttgccgcctttgccttcttatgaagacgcgaccaaacttcccgcgctgatcccagcggcacaagaaaatacggacgaacagagacacgggattgaggagagagcaggaagagagacagaggaacagagacaaaggaacggagagagagcaggaagagagacaggggaacagagacagaggaacgaagagagagcaggaagagaggcagaggaacagacagggggagaagacgaagcagtaacagaagcagcagcaggacaggcggaggaaggagccatcggccgaccaatcccccgttaattttgatccccctccccatttgacacttatactttactttaaaagggtcagccgaattaaatgagtggcgatctctaaccttttgtattattaattagtcttgttaatgaatggtgatgctggcgctatttaaatagaggtccattttgaattttatcaaaaagtaaaaacaacaggggggacccttttgctttgcaatattttttaa

SEQ ID NO: 43502 - DNA, 1398 bp, Heterodera glycines
  misc_feature (1245)..(1246): n is a, c, g, or t
  misc_feature (1320)..(1320): n is a, c, g, or t
cagaatattgcatggggagtgaatcgatctgtcaaaaaataaaattatcatactctggctagttgattcgaccaactatagtagttgttctgtgtttgcatatcgataagtttccagcgttttgttccggattttgtcctgaccgaggcacagagccggccgcgattctcttttatcagctttccaatcttttttggttgctgtgtatgccgctccatttttgggaatgaatacaaccgttctttcgtccacaccccgctgatcgtccttaaatatgttggttcgcaaccgtaacgatggatctgatgcagcgtgcatatcaatcttcaaattcctatagggacggccggtcgcttagcggtaaccaccaaggaaaaagtcgagctgtctcggacagagcaggacaccaatgaggtcaatggacaacatggtattaggggtctgcatcagcgccagttatcgagcgttcagacggcccacattgagcaacgataggagcggggaactgatgatatctccgataataaattaatccgcaaagtcatcacctttgtactcctcacagtcaaacagtcgggcactgggtagaggccaagaaagcattggacagctgaggaattggaatttgcaaacattcattaaccaatccatcgatgcaatactttttagctgaaaacaaaaaaataaatattattgttgttatgtccgaagataacaaattaaataagtttatttgccgaagaaaataaaataataaataaatgcagagaaaataaattgggaggtcaaaattggtgggcacaataacaactgaatgaggggaatgggagggtgaagatggcgaagtggcgtggggtcatacacctaatcaataattacttccttctctaacacaatttaaaaaataattaaataaaaagggaaaaatcgattcgattacttaatatcaatgcataataatcagtcaagaagagcagtttgaaaaaattcaatttaatcttggcataacaattaataaaataaatgaaacattttaatttgttaggggatacacctgctttcaaatggggccaaaaattgactgaaaagaaaattatttaataaaacactttaaatatttaaagattttttattccaacaagatatattatattattgtgaaattattctccatataaactattaatttttgaagatcataaaatttttcgaatatattgatgtatttttactagaactgagcgnngccgggaattttgacaaaaacccagaccgggacttaccgggccagaaaagtcgggaaagtgtgaaaaacattanaaaaataaaatacattgaagggagccgaactgtcaaaaaagcaatcaatcattttccaccttgctacgcagcaaatct

SEQ ID NO: 43503 - DNA, 273 bp, Heterodera glycines
aaaatgaaggagaaagaggagcattagtgtccctcaggacagaaattcccccgagacttcactggagcgaaacatggcccaggaatctaggctcgagaatccgagaccgtaattgccataaccaatttaacactatggaggacaatgccgaccgtgggggcggagcttgtgtacttttgcgaaaatggggcggtgcaaaggtgccgaggtcggaagatggcacgtgaagaaggggagaacagggcggattaatgattaacacctgacgagcgg

SEQ ID NO: 43504 - DNA, 1019 bp, Heterodera glycines
  misc_feature (962)..(962): n is a, c, g, or t
  misc_feature (966)..(966): n is a, c, g, or t
atttctaaaacggttataccaacccccagatttttgaatccggttttcagaaaaaatgccttgtggtgaaaacaatatttcacatttcactccataccatggtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataacattgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgnaagntattcggtatcataatgccaaaacaaaacgaaatcgttttaaaatattccttt

SEQ ID NO: 43505 - DNA, 974 bp, Heterodera glycines
  misc_feature (56)..(56): n is a, c, g, or t
  misc_feature (74)..(74): n is a, c, g, or t
  misc_feature (90)..(90): n is a, c, g, or t
  misc_feature (96)..(96): n is a, c, g, or t
ttttgctccccataaatgtttgataccccaacgggacactgaaaaaatcgattttntgtttcggggcagtcccnccgaaaccgatgcgcncagatntaggggagaccgaatccttcgggaatagcttccctatagcctgtactttaattctgcgttggatttttgctccccataattgtttgagtaccccaaacggacacatgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatcattcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaag

SEQ ID NO: 43506 - DNA, 1167 bp, Heterodera glycines
cgacctaatggaaaaaaatccctccataacaaggctccattaaatccattccttcgggggaccgtccttttgtgccgcggggaaagcagcgctggatcgaagcatcacggcaccgaaccttttggctagtcagcaatctgtttcttaacttgccagatcggacgggtgcgcatgattccactgatccaagcaccccaccaaaagcaaaacgatataaccaaaatataaggaaaaatttttaaaaaaattttttctccatcttcctattttgatactaaagcatcagagtgctaaaattaagttgtaaataaaatttggtgcgctttagagctctttctgaaaaaaatatttatgaaacaaaaaaatcaattttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgataagactttttaaaatataagcctaaactttttggcctgt

SEQ ID NO: 43507 - DNA, 1333 bp, Heterodera glycines
aaacaaatcgccagcagaacggagtgccaaagtgcctaaaatggatgcggaaaaacagcagataaatgcgggtgaaacggactttggaaaaatggcatacagtgaaggaaaccggcgcacgaaggtagggaatttaaagaaaatattaattaaataataatttaattcagtttttaaaagagatatttccgttttcatttaattaataaatttgtttttgaattttgcgtagaaataatgaaaaaaaatatttataaatttatttaaaaataatgtaaactctgccacttttttttaactttttaattaatttttattgtaagacaaaaaatattaacaaaacatgcaaaaaaataaaagaaaaaaaaccaacagaaaagttgcaagtaagaaaatcgtatgcttttgtcaaaagaaaaaaaaattcattttttgaaataaataaattatttaaaaatacaaaaaaatatatatggaagatacttaagaaaagttattagagctatagaaactttaaagaaagaacaaagataaagagaaaaaatatatagaaggttattctccgtttttccatgtttgatatttccataaaatataccgtattccttgaaatacatccctccccctgaaataaagccacccttttgagggagttgaaaaataaagagccaggagacttaatttcaatgaacacggtacttccaactacaggagaagcatgctttcattgagctcagctcacttgtaccattgccaccgccaatacgtgatcagctcgacaaaacggccacccttcgctcgacaatagcatttttgtaatttgattttttcaattactgaattttttttaaaacagaaaaattcggcgtttgttcggcactttcatttcattttccacgttggcaaatggccaatgtgttggcacttcgtcacagaatgaccaatcggccgccaaatttgaatcagatgaaaagcgcaggcattggccaaattatggcgggttttatggcatgggcgcaacaacaacaaattgtaatcaagaacaaatgacgatgcaccaattctcgtacaatttgttccaagtcagtttaaattaatactaatttatcaaaatataattaattaattatactataattagtgaacaaattaaagaagtgttaaaaggatgaatatgggtagtgtactacttactgttacagggttgttccgggacgagaaaaatatcgggtcgggattcgggtcgggtcggccgaaaaaacatcgggtcgggattcgggtttcgggacgagaaaaatatcgggattcgggattcgggtcaattaaaaatttt

SEQ ID NO: 43508 - DNA, 1083 bp, Heterodera glycines
  misc_feature (1028)..(1028): n is a, c, g, or t
  misc_feature (1046)..(1046): n is a, c, g, or t
cttttgccagaatttccctggacattggactctcattgtccatgatgtgcaatttggcactcattttgccgattctttgcctaccacatatggcaggttggatccgcaactgacggataaaattaaaaatatcatttcggatattttgccgtcagcagtgttgacagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacaggcagttgatgccattctcgcccaagcccaagtggccggtgaaaaccaagctgacacgcttggtttggtgtcggagtcttgcataccgcaagagccaattgcgcaggctgatgatgtaattttcatcagacctaagacgccaccaaggcgatcaatgcgcgttcaaaaaaggctttcagcttctgtaagccgttcgccttcaccggcgccgaaacgccccccgccagcaaattcgctaagagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaccatttgctgccggaagggaagagttgtgctgccaatgcttaacccgcatcctgatgagctcaaagagctgattgtggggaataagcatcccgtgaagggaaagaatttgtgcgacacatgtcgcngtataacaacctgctccnatttgcgagcgtttccgctggcagcaaaccagccctg

SEQ ID NO: 43509 - DNA, 1256 bp, Heterodera glycines
tgaaatggtttttcccttacgtaaatgaaataattatgaacaaaaatttatttcttacaataaattatacatattttcaaaaaataatgaaaatgtttttttaataaattattggttaatttaaaaaaaacaaataacaaaaagatttaatgttaaatttagtcaaaactcaacaataagaagaaacaatagtttatcacatttaattttaagaagatgagatatagaaaaaaaagaaaaaataaagaatcagaaaatcaaatgaaaaaaaaaataagaatttaacagcaaaggtttatgcgagggaattttgttttgtaaacctaaaaaatatttaccctaatgcataaatcaccaaaatgtatttataaaatattattaaacatggattaaattcgttgctaaagtatattacttttatttactattctatttatcaatttatttggttataaaagaaaacgttgaatgtcaatcgaacaaagtaatttttgttaaataaaaaagttttgctcaattttttttttatattgaagagaattatttgtttaatcatttttttccaaattttatcacgaaataaaaaaagaaataataaaatgacaatttaaaaaatcaacaataaatttttaataaaatttttgtaaattaaacaatcaaaaatactcgtaaaaaataaaaaataatagattatataatttaaaaataatatatagaaagtattaaattacaaaatattttttgtattccatatttctgaaaatatgattaacaataattctcaaaaaagttgacgactgcttttccagtgacaaaaagcggtcgtgatcatgggctgatttacttatactttccttgggttggtgtgtttcgctgtctttcaattaaaaaaaaatattttgtatacattctgttccaaaattataaattaaaattttttttctcaaatttttccttgccgaatggtgtaaataatcagaagaaatcatgcgaatttcattaaataattattagattatatttttagatatattaatgtattttcttattttttaaattaaattttaaactatttttatttaagctttaatttttatcaaaaataataatttatttcactggccatttgtttttattcatttctgttgacttcatcgttagatttttcaaaattcggattaaaatttccgcttatttaaatagacaattggacaatgagaatgttaatttaaacatttttgaataaagattatctg

SEQ ID NO: 43510 - DNA, 620 bp, Heterodera glycines
  misc_feature (15)..(16): n is a, c, g, or t
cacaatttgccgtanntttgccttggttattaaagatgactttttttgtatttaaagcattttgcatttttaaataaaaattaatttaatcataccttcgccacagaaattttgaatgattgttgtgcctttgcccgattgggtgaaatactaaaaatgaaaaattcgtgtaaatattaaatttaataaagttagaggtatatgagtttatatcgagaacgttatgtggatctctgggattatgagataaattagttaattgtttactttgtctgcagagccttggccagcgccaccaatcactttgtatgtgtacgatttgcttgtgtctgtgtatgctaatccaacagcatggtaacacagttttttatagcttcaacattttttaaaattaaatgattaaatttaaacttaaaatcaaacaaagtgttctgatagtcggtattctaaaaattctgttgaattcttatattttttatatttaaatttgaattctttttttatagttttactggaaatgggtggaaaatgattaaaagaattcccgttttgcccggtgtttgccccaaaagccgtaagtggaagccccggcaaagtcacgacgaaactctagtcccatt

SEQ ID NO: 43511 - DNA, 301 bp, Heterodera glycines
cggtgtcatctatgttactagatcggggatcgatcctctttcggccgctcgagcaggacctgcagaagctagcatgatgcagatcagattgtcgtttctcgccttcagtttaaactatcaagagagggaggagagggttggagaaggaaaggaaaaaaaaatgaaggaggagaaagggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 43512 - DNA, 1220 bp, Heterodera glycines
  misc_feature (48)..(48): n is a, c, g, or t
  misc_feature (147)..(147): n is a, c, g, or t
aaaatttttattcctttttaacaggccaaaaagtttagctttactttntagtgaaattcaatcactcatttttcgagtagtgatcagaagcgcaccagattttgcaggggcctaaaagggtcaaggaaaggcgtctctgcgttgatntagcagtagtacctatgaatttaaattttctatgaatttttaaagttttttgtaacttttttagtgaaaattcgatctctgcaaaattttttcaccgggttgagaagaagcgtaccaaactttgcaagcatttgcagtgtaaaggactacttacactgaaatgagcgccgagccagctggatcaattacaaattatttatcgaaaatcaaagtctttagtttttatttatttttgcaaaattaattcttaaatatttttttcagaaaatgctctgaaacgcaccaaattttatttacatgctagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaactttttatgaaattcaatcactcatttttcgagtagtgatcagaagcgcaccagatattgcaggggcctaaaaaggtcaaggaaaggcgtctctgcggtgatttaacagtattacctatgaatttaattttctattaatttttaaagtttttgaaatttttt

SEQ ID NO: 43513 - DNA, 655 bp, Heterodera glycines
attcgtccgcctcgcggcttcaggacgggcgcttcgcgcccgtttttaaattttttgggggacatttggccgcttcgcggcctcaggacgggtgcatcgcgcccgtttttaaattttttgggggacattcggccgcttcgcggcctcaggacgggcgcttcgcgcccgtttttaattttgttcagaacatttggccgcttcgcggcctcaggacgggcgcttcgcgcccgtcatttaattttgttgaggacattcggccacttcgcggcctcaggaagggcgcttcgcgcccgtcatttaattttgttgagaacatttggccgcttcgcggcctcaggacgggcgctcccacccctcagaatccccaataacacggggattctgaggtcttaaccatgtctaaagtaaaatctgattactattcgtgatcagcggcccaaataacccctaaaatcatatttttggaagatttttggttaaaaaaattttccactcaaaaatcatagtcacacccctgtggtcccaaattccaaaatcacttttatttctataacttttttcaaaaaagtgataaaaagctaaaataaaatttataaaatagagcaaaaaattgcggattttttgagtatattatttttataaaatactttttcag

SEQ ID NO: 43514 - DNA, 1108 bp, Heterodera glycines
  misc_feature (1016)..(1016): n is a, c, g, or t
tttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggatgcgctaaaattggttgagaagctttttgagcgtagttacgatttttacttacaccatttttttctaggcgtagatcacatgcgattttcggcactctgataattttagcgttcataatgggatgtataaaggcgattgtagaaggaattggaagcgctaaaattgtttgaggagctttttgagcgtaattacgatttttacttgaccatttttttctaggcttagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgattgagaagctttttgagcgtaattacgatttttacttagaccattttttctaggcttagatcacatgcgattttcggcactctgataattttagcgctcataatgggatgtataaaggcgattgtagaaggaattggaagcgctanaattgtttgaggagctttttgagcgtaattacgatttttacttacaccattttttgctaggcttagatcacatgcgaatttcggcactctga

SEQ ID NO: 43515 - DNA, 911 bp, Heterodera glycines
aaaagcaaatccatacaaccaaaatacaagtaaaagtgttttaaaaaattttttctccatcttccttattgatactaaaacatcagagtgctaaaattaagctactcccgaaggattcggtctccccataaagcccttaaatcggttcggggggactgccccgaaaacaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcacaattaaagtacaggctatagggaagctattccggaaagattcggtctccccataaatctgggcgcatcggttcggggggactgccccgaaaacaaaaaaatcgattttttcaagtgtccggttggggtactcccacaattatgggggagcaaaatcccacgcagaaattaagtacag

SEQ ID NO: 43516 - DNA, 890 bp, Heterodera glycines
tccccatcaagttcaagcagtgcagcaacaaaaccctcagcagaaagacacaccggcggcactttctgttaggtctcaactgccaattaagccaggcccaaagccgaaaaaaccacaaatggaaaagaaacagcgaaaggaaaagccgccaccacccccccccaaacagaaggacttgaaaattacgtgcagtccctgcggagagattggccacatgaaaacgaaccgtcactgtcccctctacggaaaagaggaggatttggcatccaaaacagtcggcgagatttgccaggcaataatattgctggttgacatcaatgtgtaacgtgcccattttcagccgaccacttccaaactcagtgacgtgcccgatgaggagggcgaccgtttgccttccggcgaactgatcgaggtggaggggacgcggctgaaaatatccaaaaaactgtacaaatgcgcggaaaaggagcgaaaagaagcactgaggtggcataattttgaacgaactgccgaattgggagagaaattccaatttccacagattgcacattccacgcaaagcattggagcggccgttgaagaaaaaaaaattgctgaaaagtgcaggcaaaaaaacgatgacattgatgccaacggcagaaacaacgacagcgaatttgggcactccaacggaacaaaatcagccgcaggagcagcagcaaaaggcagggacagcagcggggacaacgacgacagctgcagcaactgacgctgcttctgctgcggttgtaatggaagaacagagtgagtcggttgactcatattccgtataaatttcgcataattagccggggcagtgtttgttcgccaaagatctgttaaactgtccaatgttagcatttccccatttg

SEQ ID NO: 43517 - DNA, 971 bp, Heterodera glycines
  misc_feature (801)..(801): n is a, c, g, or t
tccgttcgccttctccggtgccaagcaaatataatcaatttgatagtgggacaatttagaaaaattaaatttttcaccaaaattaacaaatttttgttccattttttaaatgggaatttgggattaataagtttataatgttactcggttcgattttcaaattgtttgaaatttggtcagagttacctaacttaataatatgctcttttttaataaattcagttttttcaatgaatttttttttttgcatatacaatcttgttaattactggtattttaaactgtattatattccttgtgctaatggccaaacgaacgcacaaccaaaaaaaccattcgcagttgtctctgtgtgtcggcaccgctcgcacaaatggccgccaccgccgcagcaaaaaaccgccaacaaagggcggccacgaaaggacgccgccaccgacgccccaaacattggccgaccaaacggacgacagcaaagcgacaaaacagacgaaaaagcgatggacaatgaacgaatgccgaaggctgaaggtttgttgtgggagaagtgaaacgcccgcaaaagaggagggagctgccaaaaagcttttaaaatacaaaaaaatgggttttactattgcctacttaacaatcaatttgattgtgttttttcagcttgctctcaaaatctgcaacccatcgaccgactcggaatgggaggccatcagcaggtcagcagaaccaaatttcataaaatagggatcgcatttgtaatatcaatggaatttctaagaattggtaatttaaaaatgaatgccgtanatgtttatggagaatcaaaagaatgtaaatttcgttttgttgttcacaggtccatcggcgggctgcgcaccgcgggagaatgccgtgccaaggcgatgaaaacagttcggttgggagcagccgtcgttggtctcgtcacagtcgcaaaatgccaccacctcaaaatcatc

SEQ ID NO: 43518 - DNA, 956 bp, Heterodera glycines
atgatgatatatgtttcacgatttagcctttattttcggcaactaaggtcatttaaagtcaccaaaaaagtcttaacttaaatttacagtcctaataatcatgtttttagcaaaatgtctgacaaatcgttgtatctcaacgcgcaattcaacgtggactcgaacgtggcgttgcctgtggctgacaatacgaacccggctgggcctgccaatccgaatccggctgggcctgccaatccgaatccggctgggcctgccaatccgaatccggctgggcctgccaatccgaatccggctgggcctgccaatccgaatccggctgggcctgccaatccgaatccggctggggctctcaatctgaacggtgccgcgttcgatgatacgctgagcctttatggggaagaacgccttgatcgccattaggcgagtccccgtgaataaaaaggagattcatcttttgcttattttaggtgtggttctctacaaagaaagaggagagtggctcgaagtttatgctttcaatgcaagaccaatgaatgttaaggaactcaacccgtgttagctctgtctcatattttgcgtccgttaaatgaatgtacgaaaatgtattaatagtaatctgtcatattatattgtgtttatggtatttatatgcaatggagattacttttttgtatttgtttcggctatcttttgttgacactcataaaagccatatttccattaagaccattgtaatattatatattttgtttaaaaaagcaataaaagtggaatggacgtatgggcggacattgcgaaagcggattttatggatgaacgattttcgagggttattacggctaataaggcgtacaacctcttccaggtctgttctgaataattgctacacggttgacatttgtcaaaacaagaattccatttgctgacttgatgaacgttcgttccgggctcag

SEQ ID NO: 43519 - DNA, 782 bp, Heterodera glycines
  misc_feature (691)..(691): n is a, c, g, or t
caaaaatgccaaaatatgtacaacttatgcgccaaaaacacgaaatatgtgccatatgtttttatgagccaaaatgacaaaaaatgtgtatttaggacaatatgagaaaatctacatcaaaaatcgctcgcagaaaatgttatttttgggcttctctcgacataactaagccacataacaaaatatgacaaaacatgaaaatcccatccctaataataataatagataaaccgaaaaaaaaaatgaaaatggaaaggacaaaaacaaagtaaaaatggcgagcgacggacagaacgacaacggatgcaaaatgatccaagctgatcagcaaaacaacaacaaaataacagtaacacaaaatgtgatggtatgtgtgtggctggggaggtgaggggagacggacgaaataattaggacccattccaataattcataaattgaatttgggatacggttctcaaagaattgtgccaaaagcagtttcggcacgcactttgtcatgaactttctcttatttttttttgccgtcaaattgcggtatttcattaatgttttcgcatttcaaaactcgaattttaaattcacattccgttaccgaagttgaaatgtgcttttcgactggccattcatcaaatgccgaaatgataggaagtcgatttttctgtcggaatcgggaacacggacggttcgncccgtggtttttcgttgcgaccattcgccgcccgtagaaaaatgtattcttttggccgctataatatttcacaaaaaattttgattcattt

SEQ ID NO: 43520 - DNA, 1346 bp, Heterodera glycines
tgcatgaaaattcagcaacactgccgaatttgtgctcacaccccggaggtgagagcaaatgacctccactgaaggtcgttagaacgtcagaaccattcgaattgccccgacatttggggacccgacttttagggacccgacatttggggattttaataaaacaaaaaaattattaaaaaatttaattttatgttcaaaatcagacaaatttacgtctgctttagccagttaattctaatgcaagaaaaaatataataatattttttaaaacgccttttccaagggccaatgggaacagacgttcttcaaggacattcaaaaagttccagacggttttgctgtctaattgcgtacaacaaatgccgaaatcatcttttctctttcttatctttcgagtgactttgtgcggtgctttaaattaatttttttaacaaattaattgttatgtgactcacttgcaaagcaaatctcagtccggaaacagagttaggtatttaaaaaatattattttgtcttttcttgcaatggaattaactctggctaaagaagacgtaaatttgtctaatttttggcataaaattaaacttttaaatatttttttttgttttattaaaatccccaaatgtcgggttacctaagagttgggtccccaaaagtcgggtctccaaaagcgcattttttaaactttttcaataaatgttaactagttttgtttactgcaatcatttatatgtttttatatttgaatgttaccttttaactggttatttttttgtaatgccctgctaatgattcatagaataaataccttaacattttttgtacatccaggattggagttaattccataattttttgagcaactgaattcacttccgatttctaaaatttttggaaaacttaggggcttcagaaaattggagtttcattgaaaattttcaacttcgcagaagatgaattttggcagttttgaatccatattttggccatttttgagcttgctttttagtcaatattttagggcttttttagtaattgatgttttttcgttcacaaatttccagtcatagaaatgatgcaaaattgtaagtgattgagcgctattttaactttttcactttaaaactgtatcaaaacgcaagtactcccatattcttttttttacccatttctttctagcttttaaggtcgcttataaccatttttaaccaattttaaacttgggaactatgagaaatattttcccatatccataaatcttattcattttgggtaaacaatattcataatttgaaaaagtggcaactcaagaaatacataattaaaagaattttagggtcgaacat

SEQ ID NO: 43521 - DNA, 943 bp, Heterodera glycines
gtcccattgctaaaaaattgaataagttgctaacgacaatttcttacatattttgtctccagtgattaaatgaggcccatttacttgtgaatgttaaattagaaaaaagaattattactggaacgtcaaaaccgaaaatattatacagtatgcctaaagaattttcattttgtgcaagttcaataaattttcttataattataataatttactggtattttattttttaattatattttttaaatcagtaaaataacccatttcctgtgaatgttaaatagggttgcacccccaacccccgccatttttgaccattttttggggttatacctgacccgaacccctacgcttccaaccccgacgaatcccgaccctgacacttaaccccgactcgggttggggtaaaatatagacccataagaatgacattttgtgtaagaaaagggaaaaaattaataaattttaaattttttaaccaacttgacaatttttattataagctttaaaaacaaaaattaaatatttaattttcaaaattttacagtgcagcgaattgagacacatcactgaattttgccttgttgttttcttgccgggttgaacatttggggttaagagatcagtgaatgctttttcgttgacaacaacaaattcgtcaaatatgtccatagcaatagtaattctaataactagcgggtgtgtgaaccgtcgggtctggtcatgggataaagcgcttcgcgcttcttgagcttcgctacctaggtccgatcatgaattatagggagagattgtcccaaaggtttaccacgggtggattaggtacaaccacgggggaatattgtttaaatttggtgatttttaggccgcttcgcggcctcgaacgggcgcttggagcccgttttcctattttgttgagctctgaagggcgcttcgcgcccgtttc

SEQ ID NO: 43522 - DNA, 802 bp, Heterodera glycines
ttataatagtgattgaaaggtttctcaggttaaaaattcgagttcaaactttagattttcatgatcggatcaattttttgaaaatccgatgatcgatcggatcgatcagtttgtgtttaaatgaccaattgttaagtgttctgaatcggacgtgctgccacacgacgacattgggcgacataaccgtggagaagggcaccgccgtggtgtgcgatttgctttcgctgcaccacgacaaagccgtgtggggagaggacgcggacgaatttcgaccagaaaggcacaaaaaaaaacccaacaaaataatcataataatgggccaaatggaattgaaatggcaaatttgtgcacctttgttcaaacagggggacacattaggcattttggttttggagaataagatttttgcaattttttaatcaaattcactgagactgaagccaggcaaaagccattaaaattggaagtcgtttaaatccaaaaattgtaatccaattgaaactgttttcaggtggctcgaagcagggcatcaattgccgccgttttacgcgttcggcggcggtccgcgcatttgcattggcatgcgattcgcaatgattgaggagaaattggcattggtccgaattttgcgcaaatattccattgtccaaactgcggacactgaggtgatcaaatggacaatcaaagcggtggtacaatcatttcaaatcgcttacagaaagagttggcattctccggacaatcggtgataacgccaaaatcggtcactgttgggcttaaactgagggacgaagaacggcac

SEQ ID NO: 43523 - DNA, 1115 bp, Heterodera glycines
  misc_feature (977)..(977): n is a, c, g, or t
  misc_feature (1046)..(1046): n is a, c, g, or t
  misc_feature (1058)..(1058): n is a, c, g, or t
  misc_feature (1085)..(1085): n is a, c, g, or t
  misc_feature (1088)..(1088): n is a, c, g, or t
  misc_feature (1106)..(1106): n is a, c, g, or t
acgacaatgaactttttgacgaaaatacggcactgattgagacgcttgaaaaaatttctgatgagaaatttagagaaatgaacgctgaacagaagtggatgaagctttttgaggcaaaattgcccaatcttcttttgcttgtcagcaaaattctttcaattcccgtgtccaatgcatgtgtggagcgcgttttctctctttgttcagcgcaatggactgatgtacgcaattcattgaaaatcgaaactgtgaaaagtctggcacaatggagggggaggaggagagcaccgacgggaaagaagaccttctttccctcccttcggacggagaggaggtggtgccggaaacgccgccgccgcccgccgcaatgtcgcgaaaccgcgacgaagagttggggtgaaggatcgggccagttgtcctttacccggggctcgggcgggcactacaatgcccgtaaaatcgatgaggaggaggagaaccgatgggccaccccaggcgcatggtttactgcacccccacgagtctcgggcccgaagaagaagccgtggtaccattgatgatcgggaacattcccgttggtcggtcggtcggagcagaagatcggagagatgacgaaacccccgccaatctggcttttttccttccttttcgtccccttcttttttctccctattatttaaatcatcattttccatttcatttctcattatccaatttgtctaccatttcacatctgcattttctccatcttttcttcgccccatttgcatttttcacattcattcacattttcaaattccttttgttcggcccgattggacatccctttctcaaaatgtttaccattatttttttgcccgccatcccctcttttcatccatttttctgtactctgattcccccaacatattcagcgatgcctttttccctttgtctctcaaaaaatacccacttttctccttattcacctatttttncatactttcctcctaaactatttaatcacaacaccccctcccttttttttcttctcctctttttctacntccactttttanttaatccatccccaattttcccttctnttnacctatttactcttatcnccatttttt

SEQ ID NO: 43524 - DNA, 630 bp, Heterodera glycines
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagaccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatatgcctgaactttaattctgcgatggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtacccca

SEQ ID NO: 43525 - DNA, 733 bp, Heterodera glycines
attgctgaaaacctaaaaaagggccaaaatatctagtcctcaacatagttccaaaattaaaatcaaattgatcaaaaataccccgaattttgcaaaaaaaaaatttaattaaaatatataaaaatcggatccttgataatttcgatggaatttttggaaatcggcgttaattttaatttgcattttattttaaaattttattttccccaagatgctcaaacaataattgttcccgatttggttatggaaatggcaaaaatgcttcagaactgggactggaattatgtccatttcaatattacaaaaatgacggaatggcatttgttggaattggcacttctcgaaaaagggcaaaaccaaaaatgggaaaaaattgaacaattaaaagaaaaatggaaagaagcatttgatcatcatttaataaatcgagaagaaaaaagtcgaatctttaaacaaatagtggagaagctcaaagtgatggtgacattttcgattgattgttcaacgacattatacgaaagtttaaaaatggcaaaaattgttagcacaagtcgaattttggtgcgcccatcggaccccaaaattttactttcagttttattgcttttgaccgatcgaaatgagcaatttacggaagaaacgcaaatttcggtggaagaaaattattgtattttgacacattttgtgaaaaatttattggacaaagcaaaagcagcggaatatttgccaaaaa

SEQ ID NO: 43526 - DNA, 435 bp, Heterodera glycines
caaccccgaccccgccccgaccccgatatttttgaccattttcggggttaaccccgaccccgacgctttcaaccccgccccgacccttaaccccgactcggggtcggggttaaatatacacccctaagaatggcattttgtgagagaaaagacaaaaaattatacaaaatttgaatttttttaatagtttgccaatttttattaaataaagtaatttgcattttgttaacctatatgtattgtgatgtagtggttagttcttgaacactaacactaccttggtcataagttcgaacacgtttgactgtttcttttttaatttattttcatttgattaataggatttttttaaccaaaaatacccatgaaaatcaatcatccttggcataatttattgacattgaaaatcaatcatccttggcataatttattgac

SEQ ID NO: 43527 - DNA, 979 bp, Heterodera glycines
  misc_feature (964)..(964): n is a, c, g, or t
tgattggagcacgtacaaagtggtcttttgttgaggtatcggcgactttttagcttctttcttctccacatcgacattcatggccttttcaccttcccttctgaaagcgtccaataggccaaaggcatccaacatattcccaaaagattgagtgatccttttgtgcgacttcgtccagcacagtcaaatcggcacccgagtcaagcacaaattgatcggaatgtcattcacccaaatcgtgacttccatcagtcgtgttgatccatttaggatattcaccatgaggccaccaattcgcagggcattcatcttcttgcctagctttggtcccttttgctttgtcagccattcatggtgtgcggcgcacatactctgcacatgtccaactttttagcattttcgacaaactgtcttcaaatgcggacaatgcgatggagtgtgctctctgccacaacgccaacatgattgctgcttatagcccttttctccaaaattgtccttcttcggttgctgcctgcgctttacagccaaaatgatggagttcgatggtctctccatcgctttcgcttccgaaatggtcgacaaacatttgtaagtcgttcacaacatttccatatgttgctctgtcaccatcggccgctaactttgacagtatgcgctttcgcaattcagcatccttcggcgatttgagcgccacgaggagcatcaagcagttaaactgctcttcgttgagctttttaaactcaaaatcgcttaacagccttttgtggcggttgatgaagccgcgaaattcctcctcgtcttgcttttcagcccgtaagcactcatatctgccgatccacactgatttttgcttcgcgaataagcttaacagcatttccgaagtcttagcaaagtcaaactctgttggctttttcggcaaaaagtgtttgctatactcggcgtaggccgtctcactcagctntgtcagcaagagctt

SEQ ID NO: 43528 - DNA, 1418 bp, Heterodera glycines
  misc_feature (34)..(34): n is a, c, g, or t
attaaaaaattttaatatttatttaaaaatttcncgattcttctatttccaatgttttttggtcggaaacaaactttttttttgatggcttttatttataacgacataactccttcgaaggttgcaatacatagacttatgggatttttaaaaacatcctatttaaaggaaaaatatttcaatttggatgtcaagtttaggcaaatttttttttgtgtgttctgtaaaatcgaaagagtcgagtgtcatcttatctatgttagtaccgattttttcatttccgaaaaaaccctagcagatttaaaaaattttttaaaattgctttactcattttttagtttcgctaaaagcgaattgaataaaatatattttgcattaaagattagtagaccaaacttacacattgttaagctaaatttagcaaatttataatacaagatggcatctagaattttcaaaaaaaaaaaaattcatttagccaaatttttgggaattttgagaaatcatgcaaaattaaaatataaaaaaacaactttaatttgctgacaaaagaagctgatgaagacgttctcaaaaagcgtgcacatgattttttgagtagcttcatctcccgacttatccgcgaaaatgccaacaaaaaatggtctttccaattacctaattggttccggtttgaaattaaattttaagcttgtgagttgtgatcatacggggattaacagcggcttaaaaaaccccaaaaaataattttaaaaattttttacaggcaagtggatttgaacccacgcgcccaaaaccatttttaaccatccgagcaattcgtctcccttccttacgttaagtcgagaatgggcccgcagcaccaaaatttccgatttttgaggccctgtaacttttgaactaggcgcttgacaccgctaaaattaaaatttacaatagaagtcgatcctgctctatccaatgggatataacacatgtgcattttcagacttacagctcggaatgttcccttgtgaagtgaaagacgagtggactgttcggtggtctatcgctttgaaaaaatgttcgtagccaccaaaaattgaccaccttttacccatagaagtgtcaacgccgaagctctctctataaatctctgccaaacttcgccaacgctcaagaccgagaaaacccctatcaaaaatagaccatgtcgtgcgcgactcagcgctaccgttgcgcgctgactatctgtcaaaaactcggaattctcagagagatttccctcacgataactagacctagttgtcactacaaccgtgatgtcagcctcctgagcctgatattcgtcctcacttaccactaaaatgttaagatctaaaagatctaagtcttcaaactcactcttaatacattctttctgtagcaaatacagacaa

SEQ ID NO: 43529 - DNA, 939 bp, Heterodera glycines
ttaaatcggttccagtctgcataccgaccgaagcccttatttaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccaccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaacattatctcggtcagcaaaccaataaatcggaccgaatcctctctattattcatgcacgaacttcaagcgaaa

SEQ ID NO: 43530 - DNA, 933 bp, Heterodera glycines
aaagacaaagaaaagcactgctatgatgctactccagtactctgaatttaaatgttctataatttttaaagcttcactattttattttttgcataattaattcataaatatttttttcagaaagggttctgaaacgcaccaaattttatttacatgttagtttaggcactcagatgctttcactatcaaaaaagggagatgaataaaaaatctaaaaattttaattgctttttaaacaggccaaaaagtttaggcttaacttttttttcagaaactgatcagaagcgaaccagattttgcgagagcatcaaaaagacaaggaaaagcactgctatgatgctaacaccagtaattctgaatttaaaattttttattaatttttaaagcttcactattttatttttttagcaaaattaattcataaatattttttcagaaactgctctgaaacgcatcaaatgttaattaaaagttaaataaggcactcagatgctttttatatcaaaaagggagatgaataaaatttttaaaaatttttaattgctttttaaatatgcgaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaacaggccaaaaagtttaggcttaactttaaagtcagaaactgatcagaagcgcacca

SEQ ID NO: 43531 - DNA, 1236 bp, Heterodera glycines
  misc_feature (1167)..(1167): n is a, c, g, or t
  misc_feature (1198)..(1198): n is a, c, g, or t
  misc_feature (1208)..(1208): n is a, c, g, or t
  misc_feature (1210)..(1211): n is a, c, g, or t
ttcttgataaactttttgttaatttttaaaaaagattctttcttttacaaaaaaaaaaaatcagggacaaaaaattttttctttgaaatttaagccttagatttttggtaccttaatgaaattctcttatttgtcaaaaaaaaaaattcaattctttgaaaatttcccggttatttaccacctcctctgtcattcggctctctgctgtgattagcttcgaaatgtccagacgaatataagcctaaactcatagacaattaaaaatttcattaaaatgttataattattctcaacaatttgcagaatatggtattgattgtcatttgaagcttttcttccacaaatattttattcatacaattaaaataagatccattcaaagagaaaatagtggaatacaaaaaatggctaaaaatgaaagaaacataaaagagtaaacagacaaaagagtccttttggccgaattgtcgcggctaagttcaagactttccttgtgcctgcgagcgtcgtaacgataaggctaaaatttttgcatatgtagaaaaaattttagattggtagaaaacatacaaaaaataaatatatatatatttttttattaggctaaaaaactcctaagaaattaactaatttgaaggaatgagggaaacaaattcttaatttgacgaataaaaaagacgtagcagcacattcatcaaagtgaataaaaaaaaatgagacaaaagagacacttataaattccataagagagaaaagaaacagcagatcatcaacagacagttaaagagtttggagcataaatttaagaaatttttgttgtcgacggcacattcaattgttcaccgagtaaagagaccatctcacgaagtttggaacattcgcgaccactaaaaaattaattaaaaaaaaacaaaaatataaatttaaaaaaaaaccgatgcggactcaaaaatcacgaaatgactataaaatttcgttaatatcaaaaaatataatattttttgccataaagattttttgaaactgcgatttttttttgttgttaaaaattttaaaggctaacaattagcaacaaaaaaccacttttttgagagcataaacaactgggccggaatggcatttgccgttgttattgaagagccatgcgaagaaatgcacgcacacggngccgagatgaagggacactgctgctgatganagtggtgttncnnggtgtgatgatgatgattaggagca

SEQ ID NO: 43532 - DNA, 1084 bp, Heterodera glycines
  misc_feature (112)..(112): n is a, c, g, or t
  misc_feature (116)..(117): n is a, c, g, or t
  misc_feature (123)..(123): n is a, c, g, or t
  misc_feature (140)..(140): n is a, c, g, or t
  misc_feature (147)..(147): n is a, c, g, or t
  misc_feature (175)..(176): n is a, c, g, or t
  misc_feature (187)..(187): n is a, c, g, or t
  misc_feature (191)..(191): n is a, c, g, or t
  misc_feature (213)..(213): n is a, c, g, or t
  misc_feature (215)..(215): n is a, c, g, or t
  misc_feature (230)..(230): n is a, c, g, or t
  misc_feature (248)..(250): n is a, c, g, or t
  misc_feature (257)..(257): n is a, c, g, or t
  misc_feature (261)..(261): n is a, c, g, or t
  misc_feature (283)..(285): n is a, c, g, or t
  misc_feature (295)..(295): n is a, c, g, or t
  misc_feature (297)..(297): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (332)..(332): n is a, c, g, or t
  misc_feature (338)..(338): n is a, c, g, or t
  misc_feature (368)..(368): n is a, c, g, or t
  misc_feature (382)..(382): n is a, c, g, or t
  misc_feature (388)..(388): n is a, c, g, or t
  misc_feature (401)..(401): n is a, c, g, or t
  misc_feature (423)..(423): n is a, c, g, or t
  misc_feature (435)..(435): n is a, c, g, or t
  misc_feature (442)..(442): n is a, c, g, or t
  misc_feature (453)..(454): n is a, c, g, or t
  misc_feature (486)..(486): n is a, c, g, or t
  misc_feature (507)..(507): n is a, c, g, or t
  misc_feature (521)..(521): n is a, c, g, or t
  misc_feature (523)..(523): n is a, c, g, or t
  misc_feature (553)..(553): n is a, c, g, or t
  misc_feature (580)..(580): n is a, c, g, or t
  misc_feature (620)..(620): n is a, c, g, or t
  misc_feature (691)..(692): n is a, c, g, or t
  misc_feature (1043)..(1043): n is a, c, g, or t
atattgaatgggatacgaaaattttatacaataaataatccccacctgccacaaaaaatgaagtaaaaatttttgaaattccccccaagatatttttttgagtttgttaaanaaanngatttngaaaggtaagatttttnatttaantaagttgttcaattttaaaaaatatttnnatgggttaggnattngatttttgtggatgattagagntnttttgagagggattnaggaaattttattatgtnnngaatttntggnttatttaatttagaatttgggnnnagaaaaattntnatganttntnttttttttggtttgttaaagaaagngatttngaaatagtttaaattaagatttttaattanattttttagttgantgattnataaatgaaaagnataaaaattttggagggagtanaaatattaaagnataaaanaattaaaattnnagtaattagtatgaaaaatgttagtttgaaanttgagtaaaaattggaaaatnataataaaaaaagntnttaattttaggaaattagaaagtgttaatnaaatttaaaaatataaatttaatattnattgagtaatttaatgaaaattaaagaaatatagatattntaaaattaaaattaaattaataaaattacaatggtaaaattaaatgaaaaataaaaactataattatatgnnaaatatttttaaatttcagaagatattaaagaatgatattttcaattaatgaaattcgaaaaaaataaaacgaaattacataattatttttgaatatgatagatgaaaaagcacataagagttaataattttagatataaattaatttatttttaattatatgaaatctttaatagagctctaataaatgtgttttataatagactacaaaattcagtcaccggtgctgcttttgctgtggtggttgtggaatggcaagggagtaaaaaatagggaaaaataaataacttagcaaaattaaattgaaaccaattgaaaaaaaataaatgcagttttatttatactaattanattattacaactgctaaataaaaattattctcattatttat

SEQ ID NO: 43533 - DNA, 572 bp, Heterodera glycines
ttttaatgactttaattaattaataaaaaaatgaaaatatctcagtcaaaaaatttttatgtttataataataaattttgttttctctttcgttttcgttttccttttctttttcaacatctcttctttctttctttctttctttcattccgtttaaatttcggcccaacaaataattctttggcaatttttaaattttctcatttcttcagctcattcctctcgtctctttctctgttttaattaactctcgagatttattaaatttaaaaacaaaagcaattaaatttaaatcaaatcaaatttcccccaattcattccctcccccccccctccttctcttctcttttcttggctgccaattcactttttaatcccgtccgttgtcagcacatgatcattcaccttcaccttccttccatcaatccgctcaatgtcacttccgctgaccttcatccgccctctctcccccccctcaccccccctctctctctctctctctctctctctctctccctctttctctgcccataattttaccacctttccctcgtacttccccccctctcccc

SEQ ID NO: 43534 - DNA, 845 bp, Heterodera glycines
taactagccggtgcgtgaaccgttggcattttagctgagaaaaagcgcttcgcgcttcttgagcttcgctacctaggctgtgaagcgattcaaattgattgaatttgttggagagattttttgaatttctaaaaaattattaggggcttttagtccacatcgaggctcaaagtgattagaagaggtaaacagtgattaaaagaggtacaactgtgattagaagaggtacaacagtgattagaagaggtacaactgtgattagaagaggtacaacggtgattaaaagaggtacaacagtgattagaagaggtacagcagtgattagaagaggtacaacagtgattagaagaggtacaacggtgattagaagaggtacaacagtgattagaagaggtacagcagtgattagaagaggtacaacagtgattagaagaggtacaacagtgattagaagaggtacaactgtgattagaagaggtacaacggtgattaaaagaggtacaacagtgattagaagaggtacaacggtgattaaaagaggtacaacagtgattagaagaagtacaacagtgattagaagaggtacagcagtgattagaagaggtacaacagtgatcagaagaggtacaaaagtgattagaagaggtacaacagtgatagaagaggtacaacagtgattagaagaggtacaactgtgattagaagaggtacaacggtgattaaaagaggtacaacagtgattagaagaggtacagcagtgattagaagaggaacaacagtgattagaagaggtacaacggtgattagaagaggtacaacagtgattagaagaggtacagcagtga

SEQ ID NO: 43535 - DNA, 684 bp, Heterodera glycines
  misc_feature (673)..(673): n is a, c, g, or t
cccccccccccctccagaccatttcgcaaaaattttggttgaccccccccccccctttttaatgtatggaccggaaatttcggcatacggaaattttagcatttttcggcaccaatcattgcattttttcagtagttgcttcgtgctccggtgccgctgcttcatcatcaacggttggctccatggtggtgtcccatttacaacaacagcaacaacaacatcatgctcaagcagttcagcaacaacagcaatacgttcaacatcatcagcaccatgggacaaatgcggatatgacggctactgctgttgttgttcagtcaccaccaccaccgccttattcggcaggtgttgtttctgttccgtcgcatcaattgccttccgggatgagcggcactgctgcgcatgccgtggccggcggtgccgtgccgattgcgtcaaacgccaccgcagcaatggttcagcaaacgcagcaggtattttctgaaatcaaaatttaacggcccggcctacctgctcgttcgagaggaataggaggcataaacaaactcctcctgaatggctgtgattttgagataaaattggatgtatctgggattttgggaccaatttttattcgatttaggaaattttaatgaaaatttattactaacgtttaaaatcgaacatacatttntttagggggcg

SEQ ID NO: 43536 - DNA, 1323 bp, Heterodera glycines
taaacctaataatccaataagagaaaaaggggacgttaaagcctatttagttaatataagatcaatttacaacaaaattgatgaaatatctttaaatttagtaaataataacatagaaatttgtctgttaactgaaacgtggacaaaggagggaaacccaatcctctttagtccatggataatcgaaaattataactttattttttgtcatagaaaatctcaaaaattaacacgtgggggtggttgcggtgttttaattaagaactaaattgagttttttgttaaattttctgaaacaaaatataattgcgaaattttggtttttcaattacaaaaactaaaatcaattagatttgtgcttgtttatcgaccacccaagacaaaatatagacaaaccaaggaactttttaaatttttagaaacattctatagccataattgtgttgtgttgggtgattttaattttccgaataaagacctggtatggaatgaagggcagcccatttctatgagtaaatttggtgaaattttttgccacttttttagtaagcttacttttttcaatgccacgagtggacccaccaggggaaattcgtggttagacttagttttgccggcaaatgatcaaattgtaaagcaatgtactattgaagatggtgttttttcatcggatcatttagcgcaaattttcacattgtctattccaaaaacactacaaaaaacaaacttcttttacaatcgacggttttttccgtcgaatgtttctctttttaatattatggtttcttctagaattagcgctttatctaacgagcattttagtgtgaacgaaaaatacaacgcctttaataaacattgctagaaaccttaaacgagtgtattccaatgaaaaaaattaccaaaaaagatttgacccctaaatatccaacgcatttattggcctccatcaaagagaaagccagactgtataggcaatgtaaaactgacccaacaaaaaaagcactttatgatagcattagtttatacataaaaatacaaacaaataaatttcacttgcaaattgagaaaaaggctatttcaaagggaagaaattccatttttaaatacctacaaaaatacgatgttaatccctttgaaataccgaatttagtctttgaaaaaaaatgctatcatgatggtgatgaaaaatgtgaattatttgccaacttatttgcaaattcgtttaacaattctgatgttgacccaggctacctaaacttgggcaatacttttgttaatcaatgctttatatcagatatagactttaacatcatcgagacacaa

SEQ ID NO: 43537 - DNA, 851 bp, Heterodera glycines
attattttgtaaaaagtcttgtttttccccaataaacttttcataccccatttttcgcaccgtgaatgttatttttattgaattctgaaccggtttgagtagattagagtacaaaaaattgaaaatttcgaaatcatgtttcccactcccttctaccaggggtattattttgtaaagtctttttttccccaataaacttttcataccccatttttcgcagcgtgaatgttatttttattgaattctgaaccggtttgagtagattagactacaaaaaattgaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagagtacaaaaaattgaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagagtacaaaaaattgaaaatttcgaaatcatgtttcccactcccttctcccaggggtattattttgtaaaaagtctttttttcccaataaacttttcataccccatttttcgcaccgtgaatgttatttttattgaattctgaaccggtttgagtagattagaggacaaaaaaattgaaaatttcgaaatcatgtttcccactccccttctcccaggggtattattttgtaaaaagtcttttttttccccaataaactttt

SEQ ID NO: 43538 - DNA, 1216 bp, Heterodera glycines
  misc_feature (1127)..(1127): n is a, c, g, or t
  misc_feature (1139)..(1139): n is a, c, g, or t
  misc_feature (1182)..(1182): n is a, c, g, or t
cgtttatcaactccatacttccgcaacacttatacagtttatttttgagggggtaatgagctgaaattgtaagaattatacaattcttgacaaaccaaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcgtgaccatccttgtgaaattctcaaaatttcagctaattatcttctaaatataaactctaactgcgttgcggaaatattgagttgatagcgccaataatctccgacttattattttcacgaccatctttgtgaaattttcacattttcagctcattttcctccaaatgtatctgtattaatttgtttaagtaaattgtaaatcggagattattagcgtttatcaactccatacttccgcaacacttatacagtttattttgagggggtaatgagctgaaattgtaagaattatacaagctggccaaaccaaaataataaatggaaaattattggcgcttatcgactcgatccttctgcgacgcctatacaatttatatttccatgataatgagctgaaattttgagaatttcaaagtgctaatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaactgcgttgcggaaatattgagttgatagcgccaataatctccgacttattattttcacgaccatctttgtgaaattttcacatttcagctcattttcctccaaatgtatctgtaaaaatttgcttaagtaaatgtaaatcggagattattagcgtttatcaactccatacttccgcaacacttatacagtttattttaagggggtaatgagctgnaattgtaagaanttatacagctggccaaaccaaataataaatgggaaattattgncgcttatcgactcgatccttctgcgacgcctata

SEQ ID NO: 43539 - DNA, 746 bp, Heterodera glycines
ttaattctgcgttggatttttgctccccataaatgtttcgtttaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtaaaggggggggggggggcgaaggcccaccacgaggccgcgaagaggccgagtgagtaccttcggtgcaggaaaattattacattttaaaaattttttaattgctttttaaatatggcaaaaaatgtatgcttaacttttttagtgaaaattcgatcactcatattgtttgctaattgagcagaagcgtagcaaagtttgcagggatactccccggtaaaggactaacttacactgaaat

SEQ ID NO: 43540 - DNA, 991 bp, Heterodera glycines
aaatgtggtgattaattatgcaatatttacatctttcattgcttaattatgctatttttctacccaaaatcgacaacttccaattgttaattttattcaaaagtaagttttacaatgtgtgaccaaaattcaaaacatcaaaattagagttaacaattccttttcctacatatggcctataacatttctgaaggggtcccgacaccactttccctccatctttaatgcttggtctcaggaagttgggatatgtgacgatgattggttcatagtcacccgtcgcagtgaagttcagcacctgctgcttgaatcgtagcgcagtccttggttgttgatgacgtcgtagttcagcgtcatccctcgcaccttcagcacatattcaaactccgcatctgcaggtgcgtacagcctcctcagtttcaaaccatactaaaacaaaagctttaatttacctttgaaaagaataacacattacctgatatacacccccactacagcactccacaatttcatgatcagaaatactcataattatttttgtgcattttgattgcctagatgtaataccaagcatttttttgctgcgatttttatttatttatttatttgtcaataaagaaaaagtccacaaaagggaaaaatccgcttacattgaggacaaaacattaattaaaatgtcctcaagaaagcgcataaacaattaaaaacgagatcgccgccaaaaaataaaatataatgtgagatcaataaaaaataaaaataatgaccaaatcactttttgtttaatgaattaataattcgacttttatttttccggtcaatcttacagaaatgaaatagttttaattttatttttaaattgatttaatgagtttattatttcgataaggtttttatcgagttggttccaaatttttgttacccgccccgcaaaaggtataaattttaaacggtaatttatatttcgagttaagtctataaaagggaatgt

SEQ ID NO: 43541 - DNA, 928 bp, Heterodera glycines
  misc_feature (42)..(42): n is a, c, g, or t
  misc_feature (134)..(134): n is a, c, g, or t
gattaaagctatccattgcctgccggttctcggcacagcaangcactaatagggtgttgactcacttcaaaaaataattcattacccaaaagttttttacaaccacttattgccaatctaatttcttgcagatntaaagctatccattgcctgccggttctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgattcacttcaaaaaataattccatacacaagttttttacaaccacatattgccaatctaatttcttgcagattgaaagccatccattgcctgccggttctcggcacagcaaagcactaatacggtgtttgactaacttcaaaaaataattcattacccaaaagttttttacaaccacttattgccaatataatttcttgcagatttaaagctatccattgcctgccggttctcggcacagcaaagcactaatagggtgtttgactcacttcaaaaaataattcattacccaaaagttttttacaaccacttattgccaatctaatttcttgcagatttaaagctatcaattgcctgccggttctcggcacagcaaagcactaatacggtgtttgactcacttcaaaaaataattccatacccaaaagttttttacaaccaccatattgccaatctaatttcttgcagattgaa

SEQ ID NO: 43542 - DNA, 667 bp, Heterodera glycines
tgttttacatattttttttgcggcttagttctggcccatcctagcccaaaaatagcattttctccgaacaatttttgatttagagcgacttataaaaacataaaaacacatattttggcgttttcgcacataaaaacatatcgcacatatttcggggtttggcaaatattttgcacatattttggcatttttgaaaaaaatatctaagaaaaacacaaaaaatgcacccctaaaaatcaactttcttgccatttttagaggctttttcaaaattttctttatttatttcgtgtaccgaaaatcgaattcttcattaattcgttactggatatcgaagtttcttgctggcacttactcaactgatggaaaaattatctttaaaaacaatttatcaaaaaaggactaattttatccccaaacacctccaaatgttttttatttgcaattgtgcgggcaaaaatgataaagaatgagttttttggaatttttatgcaaaaataccattggtttttccaatttttagcacatattttcgcacatattttggcattttttaacacatatttaggcctttttttggttagcacatattttgggtttttttagcacatattttattacatatttcaggatttttagcacataaaaatcccagccctactcatta

SEQ ID NO: 43543 - DNA, 1208 bp, Heterodera glycines
cacaaatctctcccggcggattattgtcgtattccctctttactcctcctctcggcgccgctccgtctcctccggcgccgtttccgccggaatcggtgccggcggcggtggtctgacccgctcagttagcacttgccgtgccaatttcagagcttaactttaggttatttccctctgatccgtcccaatttactttcaatcacttcgcccaaagcctcgcttaatcctgccatttttttcacttcactttcctccaaattaagctcctccatccgctttttgaactcctcttcaattccctgctcgtccattttcggcttgcccagcatttcttcccaatcgctgctcaacagaatttccgtggcctttgccaccgcattttgcacttgcgtcgcttctttggcacttatcagacgctttttgtccgctaccagaaaatagtttctaggttcacaacaagctaattagttgattaattgactaattatataagaagtttatttggatcaggggatcaatacaccaattatcggctgaacataccgtgataaacctgtcaaatgaacaaattgtacacctttttattttctgcccgtattttcacgttgttttgccatttccgatcgcattttgagccctttgtaatccaccaatgaagccgcatccgttttgatctcctcaattttgcgaatatattccgagtcaaatccttcaaagtccgaaggggtgccgaataagttcagatcagcttttccgtccaattccgccagcttttcccacagcgttttcggctttccgttgatcagtgacgtttttctttgcacaattatgtcaaaatcattgtttaattctgaaaagcacagcccaattggcattttgctttcccagctgacttttgatggcttcttccattctcttcctcagcccaaaatgtctttttaaatggtcgttcctggtaattcgttcggccctttcgaggtattgtcggtccaaatcgagtatattttgcggttccatcctcaacccgaaagtgtccaaatcgtacaccgtttgttccaccaatgccattgctttgatgccattttccaccaatttgtattcggccatgtctttgctcagctcaacataggccatgttaatccctgaatagtttagccattcaatgcacaagaggacaaatgatcattcacttctcagtgtgattagtc

SEQ ID NO: 43544 - DNA, 1529 bp, Heterodera glycines
tttttgggccatttcagcgccggccgaaatacctcgccggggtttgaccggaggaggtcggtgtaagcggcttttttgtacagctcgacgagctctatccaaccatgtttttggatttctgaaattttcagaaaattttcgagctaggccccctcaaaaattttccgtttttgaattttatgattttttacagatttttccggggaaaacggagaccactttcaagcaaccgtttttcatgctctatcgattggtgtcattttcagaaaaatttttcaaaaattttttggaaatagaaaaattttggttgctaggcctcaatttcagttctggcgcaataactcgtcaggagttgattttatcaaagaatcgtctaagagcttttttgtagagaattttaagcccaatctaatgtgctttatctcatgtttttaccatgagtttaaaaaaagttataaaattaattgtgattttgaaactcaaaaccataggggggaccccatggttttgcatttcatgaaaaatttttttactcctaaattagccaaaatgcatttttatggcataatttgaggtgctgaatacgtatatacgctttatattgcgttttggattttttggaaggtgattaaaattttttgaaaaatcgtcaaaatttgagccccggaaaatccagtgaaatttcgaaaattcataactctcttcgtttttgatcaaatttagtgaaataaagtttgaaaaatagagaaaaatcaggagaattttatgagatttatttggaatttctatcttccaaaataaaaaagttgttccagaatttctggaaaaattcgatttttcagaataaaattcagaactcggttctgaaaaagtattttataaaaatgatatactcaaaaaatccgcaattttttgctctattttataaattttaatttagctttttatcacttttttgaaaaaagttatagaaataaaagtgatttttgcattcgggaccaaaggggtgtgaccatgatttttgagtggaaaaattttttctccaaaaatcctccaaaaacatgtctttaggggttatttgggccgctgatcacgaatatgtaatcagattttactttagacatggttaagacctcagaatccccgtgttattggggattctgaggggtgggagcgccgtcctgaggccgcgaagcggccgaatatccccaaaaaaattaaaagacgggcgcgaagcgcccgtcttgaggccgcgaagcggccgaatgtcccctaaaaaatttaaaaaagggcgcgaagcgcccgtcctgaggccgcgaagcggccgaatgttctcaacaaaattaaaaacgggcgcgaagcgcaagtcctgaggccgcgaagcggccgaatgttccccacaaaattaaaaaacgggcgcgaagcgcccgtcctgaggccgcgaagcggacgaatgttctcaacaaaattaaaaacgggcgcgaagcgaccgtcctgaggccgccaagcgtccgaatgtgccctaaaaa

SEQ ID NO: 43545 - DNA, 1120 bp, Heterodera glycines
agtctcctattatattatttgttttactcaactttcgcagtcggtggggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagatttttatttacatgttagtttaggcactctgattgctttttctatcaaaaagggagatgaataaaattttttaaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaatttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacgaacacttgaaaaaatcgatttatttttgttttcggggcagtccccccgaaccgatgcgccacagatttatggggagaccgaatccttcgggaatagct

SEQ ID NO: 43546 - DNA, 420 bp, Heterodera glycines
aaatgagcttgggaagaccccacattccacattatcaaggcgttggatctcgaaaattaactaataataataatgattataacaaattgccaaatttcatcactatacatcacaaatcgttacatagaataaactagagtgccacgggaccgggacctggaagcggacaactgagtaccaaggtcccggttttgaccgggaccgggactagtcccggttttttcccggttttcccagcctaaaattcccggtttttcaaaccgaaaaggtaacggtatagtgtatgcgataaaaatccggcaacgagccttacaaatctttcaaaaaaattgaatgcaattaaaataattaaattagatttattgaaattttttaacttatttattattagctttttaataatttatcacattctttttt

SEQ ID NO: 43547 - DNA, 1459 bp, Heterodera glycines
aaatattctacgacaacaaattggtcacttatcagttgacgaaaaacattcacttgcgccaaataataaaccaacaaaatggtaagaaaacgaacagacatttccgtccctaataataatgtacgaatttcggctgatctctcctctggtcctttgtcctcaaaacaaaaatttctgatcgatggtccgcttgtgctcatcgatacggtgagctatcgcagagacatttcgggatatttcgaaattggaaagcccacttttcgcactgagttgaagcattttcgcataatttgtaaattctcagcaattttataaagtagaatcattcccgattaaggacaaaggcatttctgacagtaaatggcagaaagtctacagcttgttcaagttgtggtatcccctctctttccgcgagggtcagaatgagcacacgcactccttccacaacattggttggtttcccattcttttcaatttaactttttgcttaaggcgaggctttctgtgccgtccttcacctccacgcgttgaatttattcggcggtttggatttgtcgaaaatcggttgtattacgccgtactcggcacaggcggaaaagattcaaaagttaatggccatgggaagggacgagggaccacgcttcgaagtcagctctgtcgacgccttccaagggcagcagcgagaagccattgtgatgtcattggtgcgcaacaacaaaatgcgcgacatcggtttcctgagagaacaccgtcggacaaatgtgagccattctgacgggtaaacccaaccaacggctttcaaaaaaggtggcaattactcgcgccaaacgccaattccttttgatcgcctcttcacgaatgttgaatgtggaccggcttcttagagaactgtacggtgtaatcagaaaggatggcctggtggtggggcccgacgctttgctgccaattgctcatgaaatttggcagtgtcatttggaaaggaagtcgtcgaatgctttatctatcgcttcttagtaattttttaatttcatgcattgtttatatatagtttgctcaataaacaaaatgccaaaacagtgtttgtgcttctccatttgatctgttccttatcctctgcacagactgaactccgtttcatagtcgtagacgaactgctcggcgatggtgcgatcggcgccgcttattttgatctttcctttgagttcgtcgacgtgggtggcgattgggtggcccaatcgcttttcacaatacgcgcgaaggtccctctcgcacgccttttgaaggggggggggggggacattggaccaggggaagtaacaaattgcaagacaaatctcacaaatacgtcgccgtcgatgcccgtcagaatgaccaattccacatattcgaagtccattgtctttgggttcagttcgtcgcgtcgccgttccaaaaaaatgctaggcaaatggttggcctt

SEQ ID NO: 43548 - DNA, 949 bp, Heterodera glycines
  misc_feature (936)..(936): n is a, c, g, or t
ttattaaaaagttgcaacatgaacactaccaaaaagtcagaatttttgcatattttaatttataacttttttatatgtcggtacatctttgtgattttggacagccgatagagcttgttaagagctttcgaatgataccaacattgttggatttggtcaacaaagaaaaaagttatgatgctctaaacttggctcagacgcaactggcccgtttcgacccccagcccctctctctctctctttctcctctctctctctctctctctctttcttctctctctttctctcccctttttttaaactttgaacaaacttatggccaaaagtacacaaggaaccaggtttccaaacatttttagtcataaattttgaaacttaacgaaatttttttaaactttgcaggctagtagaaaacacctagggctatcgaatgaagcgataaataaaaaatatacagtttatatttcaaattttttcatgagaaaaagtgagtgaactcatgaactcggcacggaacagattcttactatttaaaatgctaagcatattatactgatcagtagggagtaaaattatatggaaatccatatttttttcctggactctgggaggcctgaaacgtacgaaaagcatgtttttagcttggtttgaagcttctaggatggatttctatatccatattttccatatttttccatatttcgcgatttattccatatttccatatttgtccatttccatatttgtccatattttgtcatttttatccatattttatgtccatattttggcattttttcaaaaaacctctattagaactgcccccaacagataaattggctttttgaccccgaaaaccggaaaatttttcaaaaaatcagtttttagcaaaatttttttgaaaacttgaatggattgaaattttattaaaaattngtaaatttatatc

SEQ ID NO: 43549 - DNA, 1286 bp, Heterodera glycines
tgcgtttcagaaccctttctgaaaaaatatttaagactttattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgcaccctcgcggtgggccttcgccccccccgagctttttatcagtctagaacggtgggggatcaaatgcaaaaaataatttaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcctccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataatttaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatatataagcatttgaagggttctcagcagtttccctgcaaaatttggtgagctttcgatcagtctagaacgttgggtgatcaaatgcaaaaataatatataaaaataatactggtgtggtaagtgtgaagaactgtgttcctcccaggcaaaaattcta

SEQ ID NO: 43550 - DNA, 910 bp, Heterodera glycines
agaaatttttcagggacaaaaaacttatttgaaaaaacccactggaaatctatgtttttttttgaaactatgggggtgaaggacgtagtgctcctcaaaaatccaatgccttccgaactagaaccagaaaaggtggacagggattccaaggctaatcccggttgtcgggaggaccccgtgcaactctattctaaggatttcctctcgtcattcatccacagagcgcaaaaatgttttttcttttcaccgcagaattgccggaaatggaacgcaacaccgacaaaaccaccggcgcaaaaaccatcgccaagaagtgcagcgggaaagcatcagccctggctatgtgtgcttgtccgactcgtggttcatctctacagtggtctccatgtccatggttagcggttgcataatcaaaaacttttttgtcgatttctaaaatttaaattatcgcccgtctgggatttggagaaggaaaacgcggggatttttgaaatggaccaagggacctgattttaggggcattaaaactgaattttctaaaaataaaaattcccatcccaaaaggtctgtctgatgttgtccgcgctgatcgtcatttggggctgccattcgttgcggaaaagcaacgcgccgccggaggctaatggggccaaatgccaaaaatgctaattgagggaatgccaaattaacaaagtgtaccaatgccaaacaaagacactgtttcaaaatgattccaaatttatttttttatatttttgtccatcaactttattttctttacaatttttaatatgtattaaatggaaacggaaaaagagaagtgatttggccaatctcctacatatattttgaaatgaactaaactttaaaagtgccaatcaaatcagaggaatgtaatggaaaaaataaa

SEQ ID NO: 43551 - DNA, 1060 bp, Heterodera glycines
  misc_feature (993)..(993): n is a, c, g, or t
agtgatcagaagaggtacaactgtgatcagaagaggtacaacagtgattagaagaggtacaacagagatcagaagaggtacaacagtgattagaagaggtacaactgtgattagaagaggtacaaaagtgattagaagaggtacaacagtgattagaagaggtacaactgtgattagaagaggtacaaaagtgattagaagaggtacaacagtgattagaagaggtacaacagtgattagaagaggtacaaaagtgattagaagaggtacaaaattgttagaagaggtacaacagtgattagaagaggtacaaaagtgattagaagaggtacaacagtgattagaagagtgatcagaagaggtacaactgtgatcagaagaggtacaaaattgttagaagaggtacaaaagtgattagaagagtgatcagaagaggtacaactgtgatcagaagaggtacaaaattgttagaagaggtacaaaagtgattagaagaggtacaactgtgattgattagaagaggtacaaaaattgaatgcaatttattataaattttaaaaaataaattagtcattccttttattaattaaaaagagaattttgaaatgtacaagaattgaatatttaaattaatatgaaattaatttttataaattcaattaaaaaaaatatgaaattctttattaaaagataattattattttttacataaattcttttattattaatttacaacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaattaaattaaatataattttttatttattaactcaacaaaatattttaaattaattaaaatcattgaaaataacgtaaaaatgcacaaaaaaataatgttacnccgtccggattcgaacctgcccctagggaaatcaaaatgatgactcagaatccccaacacacaggga

SEQ ID NO: 43552 - DNA, 1266 bp, Heterodera glycines
ataactatttttatgcttaaaaacttgcgaatttgaagtggaaaatttgctgttaatacatttaattctgcttaaggcttacttaaaaaaattgcaacggagcaaaaaaagaaaacatttgtcatttgtggggtatttttcacgtcctttttttaaatttttattcttaattattttttccacaataaaatttatattggaagaggttttgaattaggcaaaagtcattttttgaaaaaattgaaacttaaattgaaaggaatttttttttaacaaaatgagcccaaaaagcattaattaaggtaaaaaacggacataataatacatttttattaagttgaataataccaaatcaaattggattaaggatgaagaaatattagaaatgattttttttaaacagtaacattgcttataaatgaatggcatttgccgcacaaaacaaaggggggaaaagcggcaaatttaaaggggacaaaaaagaaaatgaaagaaatgaataaatgatacggataaactaaacttttcagtggacaaagatgagaagattttgcttagaatgggacggcaaaaccaatggaaatattaattatacaaaaattaatttaatatttatttaaataatatttatttttaagagattgacggcaaaaaaatggaaaataattacaataaaaaattttaatttaaaaataattagcaaatttattttttagcaaagaaaattaaaaagcataaagaaaatgggggtggacctttgtgttgccaaaaatgaaagcgttccgcgcaattaatcaaataaaaaggggtgaccgcgattggccttgggcacccattccaatttgggggacttaaattcagatttaatccatcagataagcgaaaaaacggaaaatggaacgaaaatatggaaaagttgcattttaattaatgaatataaattaaaaaatgaaacaaagcaaaaaaacggattctcaaattgacgccaattaacataaaaaacgaaagttggggaaaagcaaaaaagcattttcccagaaatgataaacattttctaacggttaaacaaacaatggaaaaggaaaaaagaagaacgaatgaacaactgatgatgaatgttcccacaattagtggagaggtcatttatgtaaattaaaaatgtacaaataataaagaataaaacatttttttaaatttattgagaaatgccaaagggttgaaaagtcagttaaaaagtgatcaattacttgggattaacattaccta

SEQ ID NO: 43553 - DNA, 1646 bp, Heterodera glycines
  misc_feature (1516)..(1516): n is a, c, g, or t
  misc_feature (1545)..(1545): n is a, c, g, or t
  misc_feature (1563)..(1563): n is a, c, g, or t
  misc_feature (1611)..(1611): n is a, c, g, or t
tctctgtcttggcaaagtggccgatgtttatctgatcgacgagcccagcgcgtacttggactccgagcagcgcttacatgcagccaaagtcatcaaacggtgtttttcttttgaatttccatcatttttatttttttgaacttttttctctctatttaagcttcatcctgcacagcaaaaagagtggcttcattgttgagcacgattttatcatgtccacttatttggcggaccgcgtcatcgtttttgacgggtgggaaaagcacagagagatcaattaaattattactactatttaattataattaaattaaatattactattttaattgtccttttttcagacaacccgccataaaagccactgcaaatgcgtaggaatcattttaatatatttttttattgcatttttttcaatttttcttagccctcaaccgctggtgaacggaatgaaccgttttctgagccaactgaacatcactttccgaagggacaacgaaagtcatcggccgagaataaacaaattgaattcgcaggtgcacaaattaattgagactaattaatttggttttatttgtccttttcagctcgacgtggaccaaaagacgagtcaaaattacttttatttggacaattgaattaccattttctctgttgttcttgtttttttggttgctgttcaattgcgccgttttgttgataatattaccatatttttaacttcttaaaagtgcataaatgtgaatggatttggcttacaattcgcgtgccaaatacattttcatgaaaaaagtgattaaaatttatccgaaactccaccaaatctttccatttctccgcctcttttttatccaaattttttaaaatttgtcactttcgcctgcgatggtttcgtctgttttctctgtgcccactcttttccgtcctttttatcttcctctactctatcttctctctttccttctctgctgctctctctctcttccccactttttcccctccccgtcacttttctctccgtccgtttcttttgtccatctgcagaaattgcacaaatatttaaatttacagaatttttggcgggtcttctttcatttttggtggactttttggcttcttaattcgatgcaccccaaaacgtcgtcggaagactttttggaccataactttgttcattgtcaatcaaattaagcattgttggtgttgttcgatagctctgtgtgtttattattaatttgctaattttcaaaaattttcattaagtttcaaaaaagttaaaagacaaatttttaatattacagttaaattttattttttaaaaaaaaatttcaaaaaaaaagatttttaagagtaaatcggtattttttttgaggaattttggaaaatccaccaagattctgtcatattttgtgaaaattgccaacaatcattttataatgttctaaaaattataaaatgtgcaacaataaatggcaaatcagaatctcaattaaaaaaacttttgtacttcatttgnggaataaaaaccccaaagaaatatataanattgatggaaatataatnaaatgttgtggatacaattaaggatttaggcataaatattgataatanattgcaattttccaatcatgtcacacaaataataa

SEQ ID NO: 43554 - DNA, 1463 bp, Heterodera glycines
ttttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggtcaacgccggggagagaccggcagaaaagccaaccaaaccagtaacacacaaagtgtgcaccggacgggctagcacagattcaacttcgagctttttaaccgcagcaataatttttatgcattttgagagctggaattaccgcggctactggcaccagacttgtcctgtcatggatactcgttaaagggtctcaattgtacgcattccgatgaccggcctcataagagatcggtctcgttatttctcgtcaatacctcctcgcgttgagagggggtaatttgcgcgcctgctgccatccttagacgtagtgaacatttctcaggccccttctccggagtcgaacccttatcctccgttacccgtcatcgccatggtagtcagatacactaccatcgaaagttgataagacagacacttgaaagacacgtctccggtacaagaccgtgcgatcagcttagttgttctgagtcaacactggacgcccggagggcgcttggttttgtggcgaacaaatgcactccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcgtaatctttgaaatgaacacatca

SEQ ID NO: 43555 - DNA, 1232 bp, Heterodera glycines
tgttttaaattttgtacattaatttgacataattttcaataaacaaatggtccatttttgacagcatatgagccacatcagtcccgtacgatttcttgaactcaacagctaagcgcagtctctttaacaaacttgaatatattgtattaattaaatgatcaaatttgtgctcattaggtatgtgatttttaggcaaatgccaaagatttttgggcatttttgcgtcgtgataatcacgaaaaacgagtttaagcagtttgaagcttatagggtgctttttataatgctttttactcgtttaggaattttttgtgaatgccaggcgcctatttttgtgcctattttgtcatttttaacatattttccagactttccgaaaacaaattctttaacaaaacgaaataaaaaataaataaagcctagaaaacagacccaaaaaaattcactcaagaactgaaaaaatttctcattaggtcaccagtaaaacttccaaatttagtggtataaaattaccaataatatttaagataggatgcttctttgaaatatagcctaacaaacagcaaatatttttttttcacttttcaggcagatcccgataagctcaaaaaaacaaattaggataaaaagattagccctaaggatcacagattgactcacttggcagtagataatattcccaatcaaattatcgatcgaaaatcaatcgataatttgattgggaatattatctactcttggctgttgctgactgagcaaatgatggctgtaatctctttctaaattaatattaaaaattttcattttctacattataaaattaatataaaaaaattcattttctaaaaaaaaattacttaaaaactttattttctttttttaataccatcttgttattcataatggccgggtataatttttccacttccttttctgcgttgaatccgggcttttccacgattgttggcccatgaaatgccaaacatgttgcgacaagaagaacaacagcgatcagaagctgagtgatcgacagaattttatagctcattgacctttttattaattaaaaaaaattaaattttaatgcaaattaaatttaagaaaaaagaaaagaaaatgaatgcccttttttagaaatatgtgactatttaaatgattgatttgaatcatgctttttcgtcgaattgttgaaaagctcgtcattgtgagcatgaaaatgccctttctaaaat

SEQ ID NO: 43556 - DNA, 1542 bp, Heterodera glycines
  misc_feature (63)..(63): n is a, c, g, or t
  misc_feature (1516)..(1516): n is a, c, g, or t
  misc_feature (1530)..(1530): n is a, c, g, or t
  misc_feature (1537)..(1537): n is a, c, g, or t
ttgtattaaaataaccttatgtataccatttcttcgaataaacctaataccgtatttccattncctgaaatagagccgccgggggctttatttttcaactaccttcaaaagggtgattaagagggggggggggcactaattcaggagggtgaggggctgtataattaggaaatacggcaaagttggcattagagatcggcacgggatggaatttcgcacggcttttacattgtttttaatgatctctaattggcatcatttaatagccctcagtattatttctcctttaattgcacaacatttttttttaattgttcacttcatcaatgccggcggtggtgaaggcggttgtcgttttgcggcatataataaatgtgctgactcatccctaaaattcaaaacaattcaagcagtgtaaatatattttatctttttatccgtttcaatccgattaatttttgttggggtttggtcagcaatggtaaaaaaaaatatatggcatcttaaacttggctgagagatcgaggaattgacccatgccacggcacgaaactcagtgggatttttctcgaccctgataaacatgttaaatttctggcttttgatgccacaaaatgcccaaaaaggcattaaatgccaaaaaatatgtatatccaatttatatgccaacaacaatttacctgacagggggcacgcgagtttggtaaatgcacaggtagaggccgagcagtgcacagaacactgatgggatgacgaacgcgcacagcacaaaccacattttttattttatgaagaattttaaatttgattaaaaaatataaatttaaaagaatttaaaaatattttattggctcaaaattttatgttgctcaatgatcatgagcaaaagttaataattggattcatttagattaagaaaaaaattaattggttaatattacagaaaatggagcagcaggtgttttacataattcttaaaatgattttcagttaattgtttgatacaaaaaaataaaaaattcaaaaaccaattaaaaacaggtgagaattcttttaattgggtttgctttataaatatatatttctaataatattaaaaattaaaaaaaaaatattttaatatcacaaaaaattcccgtgttttttccgagtataaattccaatgttcgtcctcataaaactgaatttgtttcactcatcattttaagcgaggcttttcccgctaaatttcatttggccaaatgacaaaaaatgtccattttaaaagtgactcgatttagaaaaaaaatgtgcgttaaattttattaccaaaaaagggaaaattgaattgaacgaaagaacaatttaaattgggcataaaatttaaaattaaatttttttttgaaaattcagtctttcaacagttcaacttttgcaacgcgttacagcaccggtggtcgctgtttttcaacgattccatcaacgacaagcaaattggcttaatggaaaggaaacaaaatttattatttatttttanaaaaatagaattanattttanataat

SEQ ID NO: 43557 - DNA, 1026 bp, Heterodera glycines
aagggaggggggagaggtgagggagggcagatgtcctgccagggtgttgagttcggcatcaatgacggagttatctcgtatatataaagacagctcgtaaattatttaggttagatttaggcaggcttgttcgtcctagctcttaggcttaagcttaagggctatattttgtaaaatgcgagttgccttttgtacgagttgccctggaccaccccccccccccgctctctctctcgcctctctctctcgcctctctctctcgctctctctctctctccccctctctctccccctctctctctctacattctctagttccccttttgctttttactttttcccttctaatttcgtcccgtcgtcattttcaggaaattctcgactcctgctcgctgatagaaaacccttccgaagcgaaaaagtgccgtgatggagtgaccgatgccaaagtggcgagactgaggaaggaaggaacggaggaaatgtgcgtggcggagggattttgcggaaagggcgagatgaaagagttggagaagaagatggagcggatggagaagagaatcgacgacacgaagcaaaagttcgagaagggcctgagcattattccgccggttgactcgaacccggtagactcagacacagggatcaaaatggataacaagtgaaatagcttgaaaatgagccctcaagcacacaatttcgatttttgaagccctgtacctctagaagaaagcaaaatgctactctaaacttaaaaattcacactagaagtcgaccctgctctatccaatgatatgtcatttatacgcattttcctagttacagctcggaatgttcccttgtaagtataattccaacgaaacattcacaattcgaaatatttccttgtgaacagcgccagcataataaaaaattagcggtaactgactttggagaaaatgaaattgtgaaatattcgaacgcagtcgacgtaattctgaaaagtgatggcccattttaagacggatgactgtgatttttatttgg

SEQ ID NO: 43558 - DNA, 773 bp, Heterodera glycines
ttgctcggatccatcaattccttaattgtccataattgtgatcaattaagggaaagtttaattgtcactcacagcaaacgaaatgaaacaatatccccagctgttctgtttactgtcaaaaacatggtcatcgaatactcttctgaaatccgccacatcgctcttttgagagacaattcgaaaaattgccgaacatttgcaactccaattttctgctcaatgtaaaattaatcaattgttgttaatctatatttaattgcaccttcttttggagcatcacaccaaaggtaaaagcccaagcatttctcattgccagtgctttcattgttcttttctatttttgtccatattttccatggcaatcctttgatgtgcacagttttgcttttacgttcactcaaaaagatttctcgagaaaattccgacactttttcaatttccatcgaaattgtcccagtcgatttgcgttgatccaaagtgaatttttcgacttttggttcatcatcagttatgacatcaatggccaatgtcactttgtctttgcttttatcataaaatccattattcgggtccattaattccttaattgcccataattgatcaattaagaaaacagattaattgaactcaccgcaaacgaaatgaaattttgaatccccagccgttcaatttgttgttaaaaacgcggtcacaaagtgtgccagtggaattctcagcccctttattttgcgagacaattcgaaaatttgccgaacgaacgcagcattgccatt

SEQ ID NO: 43559 - DNA, 1357 bp, Heterodera glycines
gatgcccttgcaaaatctggtgcgcttctgatcagtttaataaaaaaaagttaagcctaaactttttggcatgtttaaaaagaccgaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaataaagagttactggcgttagcatcatagcggtgcttttccttgtctttttgatgcccttgcaaaatctggtgcgcttctgatcaggttatataaaaaaagttaagcctaaactttttggcatatttaaaaagcaattaaaaattttttaaatttttattcatctccttttttgatagtgaaagcatctgagagcctaaaataacttgtaaataaaatttggttcgtttcaaagcagtttctgaaaaaatatttatgaattaattttgctaaaaaaataaaatagtgaagctttaaaaattaataaaaaaaatttaaactacgaattactggagttagcatcatagcggtgcttttccttgtctttttgatgccctcgataaatctggtgcgcttctgctcagtttataaaaaaaagttgagcctaaaatttttcgcatatttaaaaagcaattaaaaatttttttaatttttattcatctccttttttgatagtgaaagcatctgagagcctaaaataacttgtaaataaaatttggttcgtttcaaagcagtttctgaaaaatatttatgaattaattttgctaaaaaaataaaatagtgaatctttaaaaattaataaaaaaaattttaaactacgaattactggagttagcatcatagcggtgcttttccttgtctttttgatgccctctataaaattggtgcgcttctgctcagtttataaaaaaaagttgagcctaaaatttttcgcatatttaaaaagcaattaaaaattttttaaatttttattcatctaaatgtttgatagtgaaagcatctgagtgcctaaaataactt

SEQ ID NO: 43560 - DNA, 1021 bp, Heterodera glycines
agtttgattgtgaaaattttggaaaaacgccctatttctttttctgctcaacactctagacaattccaaccccatttacggaatgatagcgccaaccctaattttccggaatttctttctgggcgagtttgattgtgaaaatttgggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactcaaaacaactccaaccccatttacggaataatagcgacaaccctaatttttccggaatttctttctgggcgagtttggctctgaaaattttgaaaaaacgcctatctctttttctgctcaacactctacacaattccaaccacattttcggaatagtagcgacgaccctaatttttctggaacactctagacaattccaaccccatttacggaatgatagcgccaaccctaatttttccggaatttctttctgggcgagtttgattgtgaaaattttggaaaaacgcctctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgcaaagcactctagacaattccaaccccatttacggaatgata

SEQ ID NO: 43561 - DNA, 1095 bp, Heterodera glycines
gctatttttttcggtaatacgtatttagggaccatcaatgatggctcgatgttcactgcctcaaaacaagtttttttataactttgtaagttcacagaggcgcttgtctaggagtttccttttacatcaaaaaattttccaccccctacccaacagattttttttttgaatgggtgggttttttggcagcgcctgacgccaaaatgataaattgcactttttgcgtgtaaaaaatccattaaaatttgtttggcttttttcgaccattttgtctaatttagaaaaaaaaaattttccttttcctttaccccctcccatcattgctttgtcctgtgcaaactcaccaatttgtactccggctcccatgtgtcctccgtttcgtcaaagccttcccagcggacccggtactcccagcgccgcttttggaaccgcttcccgcacaacatctccacgttgaacatgccgggcggtagcggggacgagtcccaggcgcggaaacggctctccgcttccgtctcacagaccgtttcgtcccacttctgattccaacccttaaaacaaacaattttcattattgcaaaaaactgcccaaaaatatcaaaaatgaaaagtttgcctttttcaaaaaaaaaaaaaaatttttttctccccgcccccaaaaaatgtgtgtaaatttgggggatttatcataaaattggcagccacttacaacgtagtgaattctgtaaaaggtcactccattgttgtgccatttgtacgtaatctttgcctcgtattcaatcgcttgatgaagacatcggatccgttcgccaatttcccactcacttcccttctttgtacactgaaaaattgaaaaaggttttttatttatttatttttgggcattaggcattacccaaaatgtaaccccaaaaaatttgggggaaaaaaaatcttgacaaaatacctaaatgttaaattttaaaaatgtaaaaactctcaatcattcagaaattccgactccaacgaatgggaaaaaatatatatttttcgaattattcaaccttcattaatgatagcacttttcgccaatcccatgccaaacaacaaatgcca

SEQ ID NO: 43562 - DNA, 775 bp, Heterodera glycines
gaatttacaaataaaaaggcccaccctttgatttttgtaaaaaaaaagggcaacaaattcgatacaaatgccaaaatgagcaacataaaaaaagtaatttacaagacgggtagtaaaatttattttttttttttgtacaaaaattgccgaagaaatgccacatcacaaaaaaaacacaggcaaatcccttagaagtgaatgattaagtcctggcaaaaatttgccacattttactcttttaaatttaatttggctccgcaattcttcaaaatttaacccacaaaaaaacttaaaatttattcattttatggtcaaaatttactgaagtgccttccttctccaaaaatttttgaaaaaatgtgccgtaaaaaatgccaaatatttattaattaaaaaatctaaatttggggtcaaaatcagaattccaaagccgttctggcgaattaaaaaaacggcagaactttgcatccgattttaaataaatcccataaaaccagtgccaaaattggctgccaataacagaaaatcacacccaaaattcgtgctggtcattgcccgcggcggctgtggcggtgtcattggcattgtcgccacttttcaccgccgtcggcgcggccccgggcgatgccaacgacgtgggggaggaggcggacgacgacgacggcaccgccgctgcggcagccggcgagaaaatcaaatggtgcccgatcagtgccaaagagcccttctgcggtggccgagggccctcgcacagaaacacgtcgtccacccgaca

SEQ ID NO: 43563 - DNA, 789 bp, Heterodera glycines
tttagccttatatataattcttgtcgtggaatttgataccagctccccgacttttttcccagatagtaggggaataaccctagataactcgttcaattggatagcatttcgagatcccaaaaattttcggaaaggaaaaccgaaattccatggcacaaaaattacgggaatctgatgttggaaattgggatttcgtgcagatattgatctttgaatatggacctccaaattgataaaaatgagtactctgggattattttctctaaaattttattttaaaaaacgacaattattgggtttttcaataagtaaaaataacattaaatgaaaaaggcatccgatcaaatttttaaaattcaaaaattaattacatatgtaaaacgtaagattttttcgaaaaaaatcctccaaaatcacacacaaaatttataattaactgacaaatgaaggaataaaaataaagtgaagaaaatgtatgtggattgtgctatttatatacaaagatgggcaatggtcaagaattggtgtctcgacgaaaaaaaatgttaaaaatttcggaggtattttttctaggcttaaaaaattcgctgatcacgaatctgaactcagattttgaaaatcactgatttttatctaagatttttcatcaactacttgattttttttcgatttttaaattatatttaaaaaaagtttagcaattaatttggggttaaaaaatattctgatcatgattctagatctgattatgcatgaatcttcatgttatctattatttttcatcaagtg

SEQ ID NO: 43564 - DNA, 1458 bp, Heterodera glycines
gtcccggtcgaaaaacttggtccaggtcccggtcgaaaaacttggtaccggtcccggtcgaaaaacttggtaccggtcccggtcgaaagacttggtcccggtcgaaaaacttggtcccggtcccggtcgaaaaacttggtcccggtcccggtcgaaaaacttggtaccggtcccggtcgaaagacttggtcccggtcgaaaaacttggtcccggtcccggtcgaaagacttggtcccggtcgaaaaacttggtaccgttcccggtcgaaaaacttggtaccggtcccggtcgaaaaacttggtcccggtcccgttcgaaaaacttggcccatgtcccggtcgaaaaacttggtaccggtcccggtcgaaaaacttgatcccggtcgaaaaacttggtgccggtccctgtcgaaaaacttggtaccgttcccggtcgaaaaacttgaaaaataatttttaatagaaccttaatgaacaacacaacacaaactgcagtttgcacccttaaactacaacaacattctattggtatatcttatatttttaccaaaaaagtcattcttaagggtgtaaatattttcgtctttttttcgtccaaatttcgcctgacgaacacaaaatgaaaaaacaaaattttgaaaaaccgaagacgaaacgaaaacaaaacgaaatttcgtccatccctggtgggatgagtgaaaatttattattaatttattatgccaataaaataggatcatttgctaaaatcacccgctaaaaattaaattttaatattgaaatttttctgatttggtctcgagtgtcggtctcgggttttcatttcgctctcaaatttcgagagctaatagggaaaatggctcttttttcaatttttaagccaaaaccagggatggcacggaatcccgatttccgacatttttggggtcgaagtccgattttcgaaaaaattttggacgtcggaattttttgtaaaaaaaaattcaaaaattttaaatttcccaaaaaagaagaccttttcatttctttccttcgttattcaacattaatttattccgcgctaattatctccaaatgcattaattatcattttttatcactcaattgtcctctttaataagggcatttctctttcggcacgcattttttcgtctttttgtctcgcagcaatcccggcacacagtcgcatgagcattcacatgccattttggtgcacacctccggtttccgattgtcacaactcggctcacatccgttacaactcaattggcctggctgctcattttcgggacactgaattaattggaaattgaaattaaaaattaaattattcaatttatatttataatttcactcactttgcaacttggtttataagcagcaataaatggcgcaacaattaaaaagaagaagaaaatattgttgaacattataattattataatcttgagaaataat

SEQ ID NO: 43565 - DNA, 1239 bp, Heterodera glycines
cccccccaaattcccccaaaaatgcgattgcgttttgcgcattccctcccaaaatttgcccactgcgctttttcttcgtccccgctgatcagcgtttgattatattcatttccaagttcccatcaacacacatttatgtaagcattccgacaaaacgaacacacacatttattatctgtcagatttgaaaaataaaaatttattttgttggccaaatcacaaatgactttaattagtgttgtgttttttcatttgtatttattttttcatttggtaattaattgcaaatcttcaagttttcttttctcttcacaaacattcaaatgacaaatgtcccatcagaagatcaaaggaaaattataataaataagaaaaatattaatattttcaagggttttccatttcggagttcacaacagtgaaaaaaaacaatgggaaaattaaaggacaattaagaggcgaaataaatacacggcaattaatggatgagtcagaacaaattgtgccaattttaacaccgatcatttgtcaacattggcgctgaatgacattcggtttcgtacagcgttttgttttgttcgcattcccccccccccccccctctcccaattcccccgtttcgtctccttttgccatttattacacctttcgcgtccattcctccaattttcgtcttcatcaccacaaattctcccaaaccgccataaccgccgctgccatttgtaccaattgcttctaattggccctcttaacattccctaattcatccgttaatgagttgttggtttttcttctctttcttccgttcttccatcatctttcctctgtcgctttgtccattttcccccttttctctccgttttaccattttcctcccccccctctccctctttctctcctcctcctcctccttttctccccgccccctctctttgccttcccaaattcactcatccgttcatttcttcccatattaggcaaactctgcttgctcctaaatgcgcattttgtgttgtcaatgttttggccatttcttttcttttttgctttcttatatttttcctttttatccgttcaaatgcttttaattttgtgcttaatctcttaaaatctctcctccttttatgctttttgttttcaattatcaattaagtccttcgcattctttgccttttcttctgctgcgaagtcacagtttgccttcttggcgttttgtctctctgctgcctttctgttttc

SEQ ID NO: 43566 - DNA, 997 bp, Heterodera glycines
ttagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatggacgttttttcaaattttcagagccaaactcgcccagaaagaaaatccagaaaaattagggtcgtcgctactattccgaaaatgtggttggaattcatttgagtgttgagcagaaaagagatagacgttttttcaaaattttcagagccaaactcgcccagaaagaaatccagaaaaat

SEQ ID NO: 43567 - DNA, 763 bp, Heterodera glycines
tgttaaatcctcttcaaattttgcatattgaaagagaaaaattttctgcacctgtctatagtgaattcattattgtttatagtctaatacaaaaattataagaaaatccaaatttcgaacgctcatatcttttttctaaatcatcaaatcccttagcatttgcttagaaaaagcttcttctcaacgtgagctttcgaatgataataagattgtccaatttggttggcaaaaaccctcaaaaatgatccttgaatatcgtcattttttaagtttttctttctctgtaaagaaatagtatgccaaaatgagagaaatgtattcttctctgcactctctatttattggttcatgtctcgttttttgactcggtgtttcagtgctttctctcaacctttctcattttgtgtgttttcagtgttttgggtgctggtgcgggcatcgctgtgtttatggtccgtcgacgaagtgctgaagcagaaggaggagatgcacctgcggatccaatcgggactttcacatcgaaggcggacaaaactgatgaaatggacaacatcccagcgagcaaggacgacgacaccgctcctgccgccagcatgggggtaaaaagaagcggagaagtgatgataaaaatttatcactgcctttttagggaatgcaaatgagctacgccgccatgggagcgtcgacagcgcccgggaaatcgatggtatagagcgaaacggatgcattatgaagtgatgacacaacatatctacgatgacaa

SEQ ID NO: 43568 - DNA, 1194 bp, Heterodera glycines
  misc_feature (158)..(158): n is a, c, g, or t
  misc_feature (1112)..(1112): n is a, c, g, or t
  misc_feature (1132)..(1132): n is a, c, g, or t
  misc_feature (1159)..(1159): n is a, c, g, or t
tcccaatccccacccccctaattcacatatgacataaccaaattgttccttgggggcggttccctttaatccaactttttttccttttcccccccttttccccccccgttcagtctctgtcccgactgcgaatcgggaagaggcggtccatccaattngtataatactcttgaataaatgattgttaacaacaccgcttaccaatttgggaatgataatggacccgcctggatcctcagtattcaagcacataaatgagacggtcaattgcggtgaacaaaagcaaaagtgaagcacaacaaaacgcaaaatatgaaggggtaaggagacgaatgaccaatttgtagggcattaagtaatgtccagaaatcacagagtaagtaaacaaaaaatgaccaaactgattgatcatctcaaaaaaagaaagaagggccaacaatttgttggacgaactgtccaaattcctaatgaaatcgcattttgtaacaatcaatcagttaattattaattaatgaatgaattaattaattctgaccgtgttcgaattgtgacgtaaacaacaaagaaattgattggaataccgcagcaaatgctgtgtaaatcgatgcaaaaacagtcaatgcccagcgatgacattcatttgtcaattcggcgtaagccttaaaatgctaattgacgaattgtttaacaataagcttaagccccgacccgcacggggtacagctcgggatcagggtcgtggagcgcaaaattgtcgagatcgaggacacaaattttattttaataaaaaattcctttggctagccgtcggaaaatttaaaaattttgggaatcactcaacgatgaagaagattatttttttttaaatgacatgaaaaattattaaagacagaaaattgggaggttttaccctacctgttaaaaattttgtttaaatctcattttttgaattttattgaaaaaattaataaataagcaaatttcaaacccgcagtggtttaatttgataaggcaacttctcaatagtgtaaaaatccagcgctcttgtcggggaatacattgtcgggaatggtcgaagaggtaggccggcgaataggtagggtgagctcggngtcgggctttgtggataggnttttaaatgttttattatgtattgaancgaatgaacatcatccatttcatactgtatcccat

SEQ ID NO: 43569 - DNA, 1076 bp, Heterodera glycines
  misc_feature (19)..(19): n is a, c, g, or t
gcgtcgtcgttgatttgtntaatgcactgtttatgttgcttttttgtcttctcaaagtcctccgtttttgtctcgagacacttcacgaacctttcgtagaaaatatgctccataatccgaccaaagtcatgccaatttctgaataaaaggaatttattaatcaaatctaattgtaagctataaaaccgacatctggttcgagacgcccttcaaaatatccattttgctaaaagaaaaataatgatctgaagcaaaaaaataaataaatttaatggttcaaattatgatgtgatcataaggcagaaggaataagggtcaatatttatgaaaaaatggaaaattttccaatcaagtacttgcttttttgaaaatttttgatttataaaatttgttttcggtttcgtcatatagcataaatggcgaaatttttgcgcgcgaattcaaaattacactgataaatgccttttttgtattttttttttttttggtctgccaaaactcgcttcattcccaattaaaccgagcaaatttcaaatttaaaaaatgtttctgaaaaggagaatctccgagcctagcgacgaagatgaaaaacaacggacaaatcaaattcctatcgataacaattcatgtgttgacggtattccgctgaacatccaatgtaaaaaagaaatcaaataatttttcatcgttacgacaaaattagtcctttttagcattacgaaaaacttatgtggacagagaagagccatttttactggaaaaggacatgctttcctgtccatttgaccaattctctatttggttcggaaatgcgatcacgcaaaccgacctcaaatacgaagaagtgaatggctttgctttgtcaactgtctcgaggcttgtttatgttttctgtattaacttgaccacacccaatagtgatcaaatcatcacaaaagtacactttgaacagacggcaaaatatgctattttcatatctttaacaggaatttaacattttccaaagaaaacatattttataaaataattccctaaagttaaggaatggaaaggccagttcgagaatgctattgctc

SEQ ID NO: 43570 - DNA, 1082 bp, Heterodera glycines
ctgctccataagaggtcagaggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcacccttttctgctccataagaggtcagaggcgactgtgctcattgacgcgtagttgtccaattaaggtacttggactttccacagtaaaatgtggtgcaaattttggaactgtcccgcctcacggcggggcttaaaagcatttgtagcgcaataaaaaagttttttgttttgaatttttcacaatttatttaaaaaagccaaaaaatccggatccaattttaaaaacgaaaatagttcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatgcttagacgaaaagaggaatttttagaaaagaacgcaccccatctgatattcccatttttctgtttcacaactgggcaacggcgactggtgctcattgacacgtagttgtccaattaaggtacttggactttccacagtaaaatggggtgcaattttgggactgtcccgcctcacggcggggcttaaaagcatttgtaggcataaaaagttttttggttttgaatttttcccaatttatttaaaaaagccaaaa

SEQ ID NO: 43571 - DNA, 869 bp, Heterodera glycines
  misc_feature (752)..(752): n is a, c, g, or t
cgctgctcaactccgcgtccttctcgcgcgcgcgtcggcccagctcctcctggtgacgcttcagctccgcctccaagtcgcgcatgcggcgctccttctccgcccgctccaattcgtcccgtcgcaacagctcctccttctcgcgcagtttgcgctgctcctccaaaatttgcatctccttgctctgcaacacctgaacaaaaattattagagttttggacatttatttgccgacaaatcgagtcaaattttcaaaaattttccggtggcgcctgtctgaagcgacagatacaacgccaaacgaataccgatttttttctcatttatgtcagaaatactgaattattgatttatcttcctcgcccatcgtacgcttttccgtcccgaaaaattttaaaattttgatttagttccaaaattatagacaaatttgaaatctcaatgagtttttttaatacttttgactgaagcaaaagtccaagcatggtattttagttttaaaaatcactgatgaaataacttactgccattaacggtgctgaacccgccgcaccaccgtcgccaaccgcagcaaccgtcgccgaaccaccaccgttgtcgttggacggtggcgccactgatgagggagcggcgcccgtggtgccaccaacacttgcgccaccacccgctcctccaacggcaacttcctccaggcggagtggtggcccaaatgctctgcacgctctccaaattgggcgaaaggtgcgggtggntgggtggatggaattcgatcaaatcggacggactgattctgaacggacaaataaaaaagtgttgcagtttagtccaaccaaaacggctagtttaagtagattgccgacccacaatag

SEQ ID NO: 43572 - DNA, 698 bp, Heterodera glycines
gcaggtctaaaaaataattaaaaactcaaattcatctctgaaatttgatatgaatttggccacatgttttgattaattaattttctgtaattcttaaaattaattttaaatttaattaaaaacatttaatttttaaaaatgtttaccattaaaattattgtcaaaatgaatttttaaagaatatatttttactttcaaaaaacaaacttgtgaaattcatctctccgaaaagttgtggcgacgcacaaaaattattattaataaattaattgagtaacctcgcaaaaatataattttgcgatgtgtaacaaagacaaagagcaaaatttctttttgcttttttagaaattcccctttttgcctcgggcgattttcgaaaatatttttgcaataaaaatctgcaaaaatttgaatgtgcaattaactaattaattacccaattaattaattaccgacgacactaaggacaaatttaacgaagtgctgaaaatgaagcggtggcgccggtggtatcattctcaccccccaaatcactttattatcactatgtgattatgattgttttgttgtttatttatttttttatcgcaaaattttgcgcacgcctaaggcaaagaacgaaaagagagagagagaagagagagagaagagagagagaagagagagagaagagagagagagaagagagagagcagaga

SEQ ID NO: 43573 - DNA, 721 bp, Heterodera glycines
gcgaaaccaaccgcactcacactgtctcgaagacatctgccggcgtaaaaaataaaatgcttaatttgcatattaaactggagtttaagcccgccgcacgtcgttcttctcgcttctctctgcctcagttgtttggaacgaaaaagaaaggcggcaagggaaaaccgaaatagaaaagtggaacgggtcaaatgatggaagcaaaaagaacaaatttgatggaaaattgagatgtgttttttatccaatttttttttttgctcctatacataaagacttaactggtctttcatttgaacaattggaaatttagcccggaaattacttgacgtattcgcagtcccccccccccctctccttgttattgggggcataggtacgagaaattggtcctggcgcacccccctgcgccacatcgccctggcgcaccccttgttcatgtatgtttgtgagtgggatatatgtcaattggaagggctaaaattaagtgtacaaattaaattaagcggaatagacaaagctttccccttttcatagcttacaaaggaaggtccccgggtgtccgtgggatttccgaatggaatttggtgggtggatagagcacccatgggttcttaagaaaagtgtttttattttttgctgaatgagcccgagtgccgagttatgacgtgccaaacttttttagttgaataaataaattaaataattgtttgaatacctc

SEQ ID NO: 43574 - DNA, 1132 bp, Heterodera glycines
tccatattttatgtcatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaacaattaataaattttagcttttatgttttttttcttttaaaatgattgcacgtaattgccgaaaaaattcgagaccaatttccgaatgttgaccgactaattgcaaaacaaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatatttcgcgatttttggtccatattttatggccatatttcgcgattttatatccatataattacactccctacttatctgtataattttgaattgctaaaatgagggtttatccattagggaagcaacttttagtgatttaactatttttttttgcgcaattgttttgaagaaaggagctcaaaaaacgcatttctgcattaaaaattttcgattatgttgtcactagaaatcactattttggcgtttcgtcaataaaatatttaaaattcactatagttttgttcaattttttgactgaaaattatgtcattattcgtcactatttcttcactattttgggatttttcgtcactaaaaattgcttccctacttatcattgtattctgaacagggctggccgtgatcacggctcacgggaatcacggggtttttagggtgccgtgatcacggctcacgggaatcacggggtttttagggtgccgtgatcacggatcacgggaatcacggggtttttagggtgccgtgatcacggatcacgggaatcacggggtttttagggtgccgtgatcacggatcacgggaatcacggggtttttagggtgccgtgatcacggatcacgggtcacggttttttt

SEQ ID NO: 43575 - DNA, 922 bp, Heterodera glycines
atcatttatttaataggcgggagcagatcttcacccctgccgtttccgggtacaccccaaaacatcgccggccgaaatgttgccgggtgataacgtcgccgcaaaaaaaaaaatttcaacttatttttagcttttttgaaaatctaagtgtcaataaaaactaaaattgctgaatttctagaaaaaaaaaacaaaaaaaacttgaaaattttttttatttcgaatttttctagattttttcgtattgggctaggtatttaaatttttgagaatttttcttggttttctaaaattaaacacaccgacctgtgatcatgacagtccgaattttggccctgtaaaacgcaaaaatttttttataaaaacatggaaaaagcactacccacctgttcaactgattgataacgcccgttgtttgcttctttagccgattttccatgacctttttgggtgagaatgggaggatgaaggttaattaaaattttatttttacaatgagtcccagcatggtcaactcgcactcggcctgctcccgcttgaccttctgcaccttcacatagttcatgttcagcgcgcgggaagcaacggcgatcagacgatagccactaaaaatatgcaaaaaaattgaaaaatgagttgtacttcgaattcttccaagaaaaccgaatttgttttaatattgagagagagtatgagggatgggaaatacgccccccccccaaccgtcaatgaatcggaaaagaggaaattaacgaaattttacaaaattgtaacttctcctcaccctcgcgcctcccagaaatatggggttcggggggttcactacgtttccccctccctgccacccataatttttttcttgaaatttcaaacaaaaaaattcagcaattttttggaaaaatctgttataatttaaaaaata

SEQ ID NO: 43576 - DNA, 1459 bp, Heterodera glycines
cctggaagtagtcggccaattcgagcagcatcaggacatttttggctaaaaattggaaatccatttttaaaaaaaattaaaaatcaacccctcaggggatatagtagaataaatacagtatcatgaattacggttgggcagaaaaggttcgttcattgtaagataagtgatggcctccaaaaattctttgaattggtccatgtccacgcccaattcgttcaaagtgatcattcgctgctgcttctccttcatctccacgctgagcatgcgactgatcaccggggaaacggacatcagccaatgggcggacacggccatctgatcgggatagattatcagtgatctgaccggaatttatcaacgatttgagatttatatgatctgatcaaaatcatttgtcagtgattatgcccccaccctataaagtcgagccctccccccttccgcacccattttctaattacaaatcctggacatttgcggacgaattttgtgatagatttgacagaacaggccttaaagcttaatgttttttcttcacctgtttgtcaccaatttccaccgtcaaatcgtcgtccggtaaactgttggaagacgccgggaacgcacttaaaaaaatggggaaaataacaaaaaatggaacattaaatcaattagtgatcgggaggacccatcccaaaaattcttcagtaaaaaacgcgtcagtcacatttagtttttcaaaaatatatggaaattcgaaattagagaaagttggcattgttttttgtcttccaattgttgcttaaaatttcttatcaagtaaaaaaaacactgcacattattagagcatttgttactgataaaaacgggaaccaaaaaatcagttgtttcgaccacttttaattattattaatcacatttacttttttgtctcccgctttttgagaattcggattacaaatgatgaagcattgtcgcatctacggtaattaagctcactgcccttgttaagcgtatgggtctaaaacattttattgattaattcacttttttgatcatttattatatttcttacttcaacgattcgttgtgccccattttcgccccaattccaacgaataatttgtgccaatcgctcctcatttggcttggaagcattgccaatgtccttgacttgtaatgtgggataatagctttctggcgtaatcatgaattcactaaaatatgtaagtgatgaatttaaattgaaataaaaaatcatcttggcttattatgctacatattaaatttggttgctttttaagtattatttttacattttaaaatttaaacaattaaatttacagtgcagcaaattgggtcacatcacgaaatttacagttacagctgccacagttattgcctatgaattcactgatcgttttttcgtcaacaacaataaattcgtcaaagattgccattgaatgtgctttaaatt

SEQ ID NO: 43577 - DNA, 1281 bp, Heterodera glycines
ccccccctcataacgaaatttctatgtctaacgttgttttctaattcaatttttatccaaacatttagtgccaatcaccttccaattttgcttctcattcttttcaaatcttccggttctaaatactgacaataaatggatcccgatcccgaggatttgggccaaataacaatcagtcacgaactaatcgatggcaaaaaagtaatttctggaagtgtgctgccatttttgggtcaaccgttgccacaacgacttgcaacatttgaaagcatcgaaataaagttgaaaggatttggaattttctaaaaagcatttaccaaatttttcagattcatcaatcggatgtcattcagttgttgcaaaattggaaatcaattttcgagtcgtgcccgctgaatttgtcgatccgtttcttgtctgatcgagtttggcgcctcattgagcgcgacattttcccattgatgtcaaaaaacattgaaaatttggatttgtccgacaacatcgttcgtatatgcccaaccatccttagccaatgcgccatacttcgcactgtcaattacactctcaactcgtcgatctatgacccgtctagttggcaaccagtgcaagactggttgatttcacctcgtgcagacaatggcacgccgttaagaattgtcaatttcttgtgcgaatcagaggccgtcaatttgcagtgcattcaagaacttaaaaaggtaaataaattaaatacattcttaattttcattttaaatggtttttgctaattgctttttcgaaatttataggccttccgtttggccacttcacgtgcctctttcattatggtattttttgatcaacatcgcctttcccccttttcgatcaacaacaaatgcactggagaggaattgacgcttattcgccatgacagagttttcaacaattttaaattggtccgtcatggccgtccaaattttttgccaaaagcaacgctcgatcgtgccgctgagtggcttatggaagatgaaatgcatcggattgtagttaatttgagagatgacgacgttggcgatgggtgagaatgaaaactcatttttagggatcaatttcaatttaatttttaggctgctcgattcatttccatccgccggtccaagtgatcgccactgatcagcagcaagcgcaagccatggatttgtgtgtgcttttgcagtgcctctttttctcatctcaatatctttttatcttaaaccatatatgctattcaaatgtgacatcccattacaaatatttttaaca

SEQ ID NO: 43578 - DNA, 1422 bp, Heterodera glycines
  misc_feature (1356)..(1356): n is a, c, g, or t
  misc_feature (1391)..(1391): n is a, c, g, or t
catgactttttatttggggaaaatgtgtgggaaattatgtagagtgagtagattcatcaaaaaaaaagagtcgaaagtgatagacttagacgatttccaagtgcttttatacaggaaaaaaagcatttctgtagattagaggttgacaaaaaaaatattagggtggaaaaataagtttttcgttgctaatttaatggggaaacaactttagatttggaaaaagaattcaaaaaaaaacaaaaatgaccaaagcaattagcatattaatgatcagcattcttaaaaatgtgtttaattaactaatttcaaaaaaaaaaatttgcaaatcaagagtcccgacttaaattatcaaaagtaatcactaatcgaatattttgtcgactcaaaatctacaataagtgccggaaaatttgggcagataaaaaacatgatgcaattaagttccaatgagtggaaagagagtgccaatgtaagttacctatgctaatgacttttgagtctaatttcataaaataacaattattgcgaaaactcacatttaaaaccaagcgatggcaacagctcttccaaagttggagtcgactcaattttgaattttggcaaaaagacctgaagaattaaaaaatgagcaaaaaaaaagaacggaaatgtgccatttatcgatcacctcaactctaatcagtggtgatttttgatcattctgatcagtttggcttccgtcagttcccccaacacttttatgagtccctcgtttgaatttggcaaaccgatgaaaaggtatgcgcgcattccctcccacaaatcccagtccgatcaaccgcgatcagttgttcgtcttcgccttgttgtcaaccgtctcaatgccatcccgggggtccacccaatccaacaccgaggcgaaaaggatgttcactgctgttacccatgcccagatcagcccgaaccagaaaccggcattcaactgactgaaaaaatgaacggggaaattttaaaggattttttctccgattttcgaattttgatcaaagataaaaggcattgaaatttaactccacgagcattaaaatttcaatttttgcctcactttcgcaatttgtggttaatgctgccctccggctctttcagtgaattgccataaacgcgttccgtccgctgcgcaatatccgaccaattgtacatttcggccatctgtcgatgcttcttcaccgggcacggcaattcgccattctcacgccgacggatggcatccaaaagaccaattgcaattgctgtataaagtatttgattataaatgagtcaaataatgatcgaacagccaaattattgttaaattcaatgggaatcaacctaatttanatttggctacggtagacatgaaaaccatcatctancatagtatttgatactgtaatttcataaaat

SEQ ID NO: 43579 - DNA, 1578 bp, Heterodera glycines
aaaacgtaaaattataaagaaaagacgaaaaaaaataatataaataaaataaaatttttgcatttctcattcgctaatgcataattaaatactaattaaagcaaacaattcaaaatgtaatgagttgagagattgacaatgcttgtctggctaattaaataaatagaataatattttattacggaaattatattattatatggatttcggtgcaaaaaagaatgaaaaacaatgtgtaatcattaacaattatatgtaaaatctttaaggggacatcatgtcactactgaaaaagtaaaaaatagtgaaattaaacaaaataatttttttaaattttatataaactccactaattttttatttttttctaattattaaagttgcaattatttggatataaaacactaaataggcaccttttatatttatttttattaaagcggtcatcagcgatgaatgccttagacaaattaacttattttatataaacaattattacgaacaattaaaaattacatcaaaatacagcttaattgtaataaaaataatttcaaaaataaataaatattctttaaaattaaaaatgacatatccacttgacatttctgagaagcaatttcgttcatgctgccaagagataaaaacaaagagaaattaataaatttaaacttaaaaaaatatttaatagtcgaaataaaagtttttaaattaatgctcttattttaccagaaaatttgcattgttttaaaattttaaaatttataatataaagcaaaaaacgagctatttatcattcatactatataataaaaaaatgatacatctttttcaggtaaaagaatttattatttagtaaaattttaaaatttgcaaaattagtttaaacatatttttttttttacttttttaaagataaaccttagaaaaacaccaaaatagttgcaaattagttgttatatgaataataatttttgtttttgggtttgattaaaattattataaattattatttttgcgttaagtcaataaacgaaaagactttaggcatattacttatattaattttaacaataatgactttttttgtgatttttttcggaattttatcatttttaattttttcaattattttcatgataaattctttgagttttaattgtattaggtatttagtttcgatgttactatgacacttttgtaaaaaaaaaacaattagcaaaaaaataaccaaattcaactttttaatataaatttcatagtatttcaacgccgctgatttttttattaacacattataaaacaagttgtcattaaatataatctttgttaatagtaataaataattaaacaatgtttaaaataaattgaatttttttaaatgtataaaaatttcatatcttattaatgaaattttttcatacaaaagtaataaaattaaataaattgttattgaaattttcattataaaatttttacttataagaaaactttcatagccataaattacctggaaaatatattaaatggaacagatgaataaataataaatctaaactcgacttcatatataattaatat

SEQ ID NO: 43580 - DNA, 784 bp, Heterodera glycines
  misc_feature (762)..(762): n is a, c, g, or t
aacctcttccctaagatttaataaacaaacattggattaaatacaaatacaataatgaaaaaattcttatttaatattgagaaataaaacagatattattgtagcacctagtttcactgagctcttaggtcaaatttttaaagaaatatataatttattgaaatttaagctaattatgcgttttatggtgccaattatgactttataagggaattaaatatttattaaaagcctcattttaaccactaatcaagcaatgtttaaatcaatttttaatttttttttatggctccaacggtgaaacacaataaatttttaatattacatttaaattttattatttttttaatatatttttttcacccttttgcacttaataaaactttaatttcttttaattaagcttaaggctaatagttttgaatgaaatttatttctttagtattcctttcttcattttatatttaatttttggagtttgttaacttttttgttcccttattgttatattttaaatgttctttaaatgtaattttaacttgcgttatttttgttaaaataatttattaaatttttattatctctagcggtgtgtatggaaattctggttgttgagagttttgtgaagtttatccaaaattttgcaattgatatttgacgctttgaagtgcttcatttactcatttttcgttattaacttttacaaaatatttaaatgtaatttttaaaagttcgaaaataaataaaaatatataaacgcanattattaatatttaagttgttt

SEQ ID NO: 43581 - DNA, 893 bp, Heterodera glycines
  misc_feature (862)..(862): n is a, c, g, or t
tgtccattcccggtagggatttaatcgtgactttcacagatagccattttttgtcaagaactatttttcgtgcgttttcaaacacactattagtgttttattcagcgctacaacagaagacaaaagttggtgtccaattcccggtagggatttaatcgtgactttcagagatagccattttttgtcaataactatttttcgtgcgttttcaaacacactattagtgctttattcaccgctacaatagaagacaaaagttggtgtccaattcccggtagtgatttaatagtgactttcagagatagccattttttgtcaagaactatttttcgtgcgttttcaaacacactattagtgctttattcagcgctacaacagaagacaaaagttggtgtccaattcccggtagtgatttaatagtgactttcagagatagccattttttgtcaagaactatttttcgtgcgttttcaaaaacactattagtgctttattcagcgctacaacagaagacaaaagttggtgtccaattcccggtagggatttaatagtgactttcagagatagccattttttgtctagaactatttttcgtgcgttttcaaacacactattagtgctttattcaccgctacaatagaagacaaaagttggtgtccaattcccggtagggatttaatcgtgactttcagagatagccattttttgtcaagaactatttttcgtgcgttttcaaacacactattagtgttttattcagcgctacaacagaagacaaaagttgtgtccaattcccggtagggatttaatagtgactttcagagatagccattttttgtcaataactatttttcgtgcgttntcaacacactattagtgtttattcagcgcta

SEQ ID NO: 43582 - DNA, 1318 bp, Heterodera glycines
ataggcactattaactcgaaaagtaccttaacaatcaccaaaaacaacttgtttttcgtgtgtttcaggccactgggagctcaggaaaaaataggctaaaccctaaaaattgcatccctacttagaagcagttaattatttttacgccacatttaaaggcaccaaaaatcgcgaaaagggtaattttggacatttaaatgcttattaaatattttaataattttttccgataaggaaaatttttaaacctataatttttataaagaaaaaaaattaaattatcaaaaatgcatgaaaatcccgaaaaagcgtagaagcttcaaaccaagtgggaaacgcgttgtttatgcttaatatatcggaaatatgcgcagaaaaaaagtatattcctcaaaagtcggtctctattaattatattttgaaagaatctatgttaaatatctcgttttttgtataatattccttaagaaattaatcaattttcttaatttaatttttctaccttcatttttgggtatttttcattaatttatttaaagatagattataatttgccatttttaagtaaaaattttaaaatttgactaaaacccaaaagagaatatttttagtgcaaaatctgttaccaaatcatgcaaaattctcgaattttctccggcggcgccgcccgcctccccctaccaccaaagcttttttggaaacagtgcggcaaaaaagaagccttttttgattttcttttgattttttatggaaatttaaacaaaaaaaaatcgtcttttttccttttcgtttcggttcagaaattatttgttcgtttcgttttttaaaatcgtttttgttcgacaccactgattcaggaaggcttagactttaagcacgaagacttgggcatgaaataggaacgaaaaaagcgaaagaaggtatgcatttttaaaaaaatttcaatcaaaaatgccgaaatatgcacaaaaaaaatttgcaccatttgcctataaatgccatccttactaataattttttaattaatttttcttcgagatacttttttcagcaggtgttgtttgtgaagtgtttgcaccttttagcattttcgttgttttgaatgaaggagacgcatttgctaaacaaattgcgattttatttaatatttaataagaaatgggcaaaatgtaagcctcggatgggaatcgaacctcgtaaaccctttccgtgggcaactcaaacattgagttaccgagacacatccgccttttcttttatggatcttatcgaccccccttttccgcgttttaaccgcccagtcagcttcttccttaca

SEQ ID NO: 43583 - DNA, 765 bp, Heterodera glycines
ttaagagcgctggtgattttgtaatttgcgaccatccatcagaggtcacagaaaaaaaatcctgaccaattccctgaacaattttttgttgaatttcattggccattttgggaattacattcctccgaaaataatctttgcggagaagcttaaaaaatatgacaatagtaaaaaatgggtgaaaaatattacttggagtttcgggtaggccaaagagaacaaattctgtaattccggtgcctcaacaaataaaaaaagcgcaattcgttcttatcatcagccttgcaatttgttcatccgcctttttgtgggtcttcattgccaaaaaattttgtaatgccttggtttttctgaattttttatattcaataaaaaggaagcttgtattaccgttgacgggtcggatttttgcaaatagttttcaaattctttagcgtgtttcgctttaaaatgcccccacaatccttttgtgcacaatttcttacacgctaattggttttcacaaagccggcacttagcaacctcggaagaaattttcgtgaaaaaattccaaatatcagatgcttttgaatccattaaaagtaatcaattgggtgaaaatctattaaatttcctggaaaattgtaaatctgtgcaaagtttaatttggcaaattatatattattaatttttctaaaagagtgagaaacttttattttggcttagtgataggtaaaatttaaatgttttggttgcataacttttaaattttcaaaacgctcggag

SEQ ID NO: 43584 - DNA, 550 bp, Heterodera glycines
cggcgttttgttcattgatcagtttcgtttttcggccacaaattgcaagctaatccgattcccctccccacccaatccgtgccaaatgctggccaatgccaatgggcacttcggcggatggctacccgatcagtactcctcgctactctattcgcccgtctccgatcagtcgggcattttcgaatcgatggtgggccaaaagaaccaacaacaacaacatcagcagcagcaacaacatcaacaacaacagttgcagcagctggtcgtccaacatacaaagaacgatgtaaaaaagggggaggggagaggaaaaagtgatgggcaattaagctaaattggcaccggtttttcaacaaaatggcaaattaattaatggatgcgacgaaagtttgtgccggggctaggattgacaaatgtacattaattaatagcccaattagcctgttcagtgctcaaatttggccctgtcgccctccttcatcggcggtggtgccaatgtcggcattggccggtgcccttcccatgctcagccttcgcttgtgtcctccca

SEQ ID NO: 43585 - DNA, 639 bp, Heterodera glycines
gctttttagggattggtaatgcttttcctttgtcattgacaattttcattttctttgcgccattcactccaattttttctttaattgaaatttttttcttcaacgtccatttgcgcgttttgaattgttcatccactcggcgatcaaatcggtggctgatcatcgcaatttgaaggccaagcttagagggcggcagcaaatggaacaccgccagccaacagtcggcagaaatgaagctgaaaacggaaaatgattgccatggaaatcaatcaaactttaaattgttattacattgctttttccatttgtttatccgcttctttcggattggaagacactttttttttgttgcagtgatcaaaagcaaaaattttaacaaatagaaaaactgaacaaacgttactttcaatggtcgtataaaataggaagataaataaaacgggtggaaaatgtgtaaatagtagagaccggaattttgagatggccgggaccggaccgtgacttggaaaatgaaccgggacggtatccccgggaccgggactcccgtttttccgggactcccggtcccagtggtttgtccaaaaaagccgggaccgggagtcccgataaaatcccggcgggatcccggtcccgtccggt

SEQ ID NO: 43586 - DNA, 969 bp, Heterodera glycines
aatccagaaaaaatcactatctctttttttggcatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctcttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaatcactatctctttttttggaatattttacgtgtcaaagggtgtgcatttaagcgactcgctgtgcttgcccactgcatttcaaatagctggtaatttttatttctccgggctaatccagaaaaaatcactatctctttttttttggaatattttacgtgccaaagggtgggcatttaagcgactcgctgtgtttgcccactgcatt

SEQ ID NO: 43587 - DNA, 1184 bp, Heterodera glycines
agagagagaaaaagagaaaagagagagaggagagaaagaaaagagagaaacggcaaaggcgtggaaaaacaattagaaaaaaacaaagaaaagagaaggagagaaagaaactaatgctaatgagcaagcaatgagtgaagaagggcaaataaagcaagaagaggagagggaatggagcaatagaacgccaaacgccatttggacgttcaaatgagagaaaggggtgcgagaaagggcggagacaacgagagtgagagaggaattggaagaaggagagaaagagaggaaaagagaaagagagaagaagagagagaggagtaaaaggatggaggaagggtttggtgaagagttatggaatgtgtgcgttgtaataggtaagttggtgtgtgttgtgtgtgtgggaatatgtgcagagttgagggagttgggaatagagagagggggagagagaaaaagagagcgggagagggagaggggtagagagggagagagaagagagagagagagagagagagaaagggaggaaagagaaagagagagagaaagaaagagaggagagagagaaggtgagatggcggaaagagagaaggaaagaaaagggagagggggaaaaagagagaggtctggactaatcactaatcatccctaatcagaaaattgctttaacatttgattaaataaataaataaaagcaatttaaatgcgaaatctattaatataaaacttgatttgtttcagttttaagtcaattaattcaacaaataatttgaaaaaagaaagaaaaaaagaaaaagtgaataaaccgtccaaattagcactaatgaaaacgataagaaatgaagcgaagtttgaagaagaaagaagaaaaggtgggggggggggaatcggaaaaatgtacagtgataaatgataatttgataataataaatgacgacagactctgctgaaaaagcagccggcggaagggttttattgagtgtgaacttaaaaataataatttaattaatattctctaattgtttttctaaaagtgcgtttatcgatttgaagcggccatttacaacgcagcgttttgctttctgtcccttccccgcctaaaaaacattggcggcggcgctcaatggcaatgctattttttgggagtgatttgggggatgggggaagggacttctgctggggggggg

SEQ ID NO: 43588 - DNA, 1092 bp, Heterodera glycines
tgtgtttgcatttttcttacgcgcgccagctcctgctcataaaagctgccctgaatttctcaccgtgctcatccccagtttgtaccgaattgggcgcaccgctttcaacacatcatcaatctccaggatttcgtctccataatttggtaaatatcccttctcaaattgccctttctctctgctcatgcgcacaaattcatctttacggaagcgtggcgtccgcttttgaagggcagggtgtccgtacaatcgcttccacactttctgcgcatttgaaaagtcaacatcaatggggcgcatcccgtgaacacgagttggagcgctgttaattccgtccacaattttctgtactgcatccacccaattcagcgtctccttttgagcaaaataccggtacagtcgctgcttcacattccggatggcccgctcagcaaccgatgccttgactgatgaatgcactggctcatgcttctcaatttcctgctcatcaaagaattccttcaacaatcggttcttgaattcggtgcctttgtcggagaagatgcgatgtgggaccattggcatttggtcgatgagttgtctgaatgcctccaacatctcctcggctctcttgtttttcagcggtacaacaaacaggcgtttggacagcacatcaaccgcaacaagcaggtatcggtgaccccgattgtggcgcgaaagcgcctgaaaatcggccaaatccacttgaacatcggtcatgaacccagccgcaacagttttggctcttggaaagcgcacccttcgggagcgcatcagagtgtaggtgcggtgcccctccaaataatgctgcacatcctttttccgtaaatttttcaacttttttcgcgcttctttccacagcgctgtaacacctgcgaacgccgctggggaggatgggtcgttgtacagtttgtcaagcgtggagttgatcaactccactttttcgggcgaaattccttcttgattgtctgcggcgtccgggttgttttgctctgtgctgttttctttggaggagccgtccatgaatacaaaattggatcttgcctaagcctctcttcaaatatggccgctcca

SEQ ID NO: 43589 - DNA, 1268 bp, Heterodera glycines
  misc_feature (1235)..(1235): n is a, c, g, or t
cctttgggaaagtatataaaagcaatttatcctcaatgagtagaatgaggtagtaaatataattattcacgattgtaatcaattttcgcagttctcattcatcttgatattttcattagatccgactaaatagcttatgagataatttgggttatcataaaatttcaaatataattagaaatgcaattcatggtatgaaagttactttatatacaatcttcaattttgcgctctggaggattggttatcgcgcaccaatatttgccaaccccccctccccctccaaaatatttgcaaaaattgaaacaaacaatttaaaaatagtgatttcacaaaaattcttattttttatccctttcgttagcacaagtgtaaaccaaaatcataatgctttttggcgtaatattttctcgctccctaaggttgacttatttttcgtaattttcttcgataaaattcaaattttgccttaaaagtcaaaatgaaaataaaattttgaatatttcggacattttggcaacaatttttacttttttaaatttttttgcatcgaaaacatgaaattttaccgactttccaataatgtcctaatcttgactattctgaggtcaactatttaaaaaatatggattattggtccaattaaaagtgaagctacatattcataaaaagctactttttagcaaaaatctgtgggtcacattcgtacggctaatttttcgtgccttagatcagtcagacatacagaacccgttacagtatgtattcagcaattgacactttgctacctaatgcaatattcgccacaagttggagctgttgttgtagaacaaccggacgatttgtatgacaaatgcactcgcgtgatgcagtgcgtaaagttgcgtgaggctctcaccaatttggtgcgctgtgtggacaccgacaaaagcattcggttgcgtgctgagcacatgcgcaccatgagggggttggacatgggcaagtttaacggtcgctttaccaaatgcgaacagtggaaagtgatgtgatgatcaaaacattaatcaaacgatgaaatgtgttcattgcaactaaaactttacattatatatttttcattaaaatttgctgtatccgattaacaaataaatgttgttttgcagagtttccaggtttctttttcatttggtggttttttgaaaggccgatgagcttttatttttaaaatgagtatgattttttgttgattttanatttttagtttttgttgttttaattaattagtg

SEQ ID NO: 43590 - DNA, 1039 bp, Heterodera glycines
gattaatttccatggcgaatgcaatggcgaaattgagcaatatcaccaaaaccgtaacatttctagtaaaattttactaatcataatacaaaaatatcagtttataaaagaaaacattatttaaaagcacaaaaccttaaatgtttcattttattttataaagaaaaagtcaaataatgttaatttctctttaaattatttgaaattaaaaaacacaaataatatggcactgattttacgaactctttatttattcgggaagaattgtttaatcttaaaattaccattataaaaaataattttaactctatcaacctttaaaatatgagaaaaaatgaaataagcttaacacaaacaagtaaaacttatctgaatccatctttactaaagattacatttaaaatttcgataaaattactagcaaatatactatagcgaaaaattaaaagcaattaatgctaaaccaaagaaaaataatttaataatcattaattggatgtgaagatttttcattacgcctgtgaagaaatttcaagatttattaatttcttatgaaatttttcgaaaaatttgcggaaatatgttgcttcttttcaatgttgatttaactaagtattattattattagactttagttaaattattaactcatgttctgcaataaatgggcgcattcatatgataacttgatgcttactcaaactcttaatttaccgaggctttgagcatgttcctgccttattttcacctttataattaatacttcttttaaatttactatttaaaattttaaagatttgctcattatttataaatagaagtcacttaatcttaacatattttatgttttacaatattttaaatattttcgttttatgtttattgaatgattatttttctaatattttaataagtttcaattgtcattaattttattattgtttgtagttaattttttattctataagcaaatgatttagtttaaaaaaaaatttaaagaaaaattagtgacggttacttctcgatgatcaagccacgg

SEQ ID NO: 43591 - DNA, 826 bp, Heterodera glycines
  misc_feature (659)..(659): n is a, c, g, or t
  misc_feature (693)..(693): n is a, c, g, or t
  misc_feature (701)..(701): n is a, c, g, or t
  misc_feature (730)..(730): n is a, c, g, or t
agtggttgaaaaaagtcttgactcaagatgctaaaatttgtataattttaaatttcgactggaaatttagctgattattttttttatgtatatttatttacgaataaatatatggggcctttcatataccacaaaatcaaagcattccgctttatcattctcgtgaataagtctcctaatcagaccttgctcaaaaaaggggcggaaaaaagtcttgactcaaacttgaaaaaccaccttagagttcatttaaaaacctgaaataattcatgctagcttatcttttgatactgatcaaaaaagtcttttacacaaactttatcagatcactccttcatggtgatcaggaaagtcaaaaatggcttgaaattggaaaaattttgaaaaattcctatgcgggctgtgaaaattttctggaattttttgattggtgccagaaagagcacaaaattctctaccgaattgccttttgaatggtcgggatacgtcttgtacacaaaaaattatacttggttgttgcacttgtcgcgaaatgacgtagcacctaactatttaaaaaagagcatttccgatgtccaaaattttttcgtaaatcggaatttcgagttttcttaaatattttaataggctaaattttaaaattctcaaccaaaaattanaaagtgaaagataaaaatttaataatgttttcgngttttgtncaacaatgtttaatcacataattacactnaaaaccgttaaactgtgacaccgaaaagaaaaattaattcttatttttttcataaatttacaaaaggaatatgcattttttggatgaaataatgaa

SEQ ID NO: 43592 - DNA, 811 bp, Heterodera glycines
gaaggttaaaaatgacaaatgcaacaacaatcagtagtagtaaaagggaaatgacctgaaaggcggcaccggtttttggtcttcacaaattatgttttttgccgggaaatgactttttcaggtggtcaaatgacaggaaagtgtcattgaaatccacgctggccacagtgctattcatccttaacaggagtgtcgtattggaactctattacgaaagccagtgatcacttattaaaccagccaactcttttgtttgacccagtctaatttcgcccattttacttggagtaatgcgcagtgtcgggctcgccataaccgagtatcaaatcgtgcagccaatcggggacaacgcattcggtgttgagcagctgccgaattgtggccaaaacggctttaaagttgttagttttggggtcgcgtcggatgacgagattgaaggtgaaataaacgtcggtttccacgcccctcaacgcgtcttctctgtattggttggcgtcaaaacggacacggtaaatgcgcaaatcgcccggaattttacggatgatgtcgcgattctctaaagtatgaatcaacttccaaatttgcattcctgtgcccacccatttcgtccaaaactcttccgtccggccccaaaattccttccacctcacacccccgcaaatattcaatttcaaattgcgatttgaacggctttcggacgtcgaatttatgcccaactggatggatgggcttaagcttaagcagaaagaagacgtcattcttgcgaatgttcatccattcttcgcgcagatcggaacgcgaaggcaatgac

SEQ ID NO: 43593 - DNA, 1119 bp, Heterodera glycines
atcattagggacgtgaattttaggttttaactatttttttttgctcaattgatttgaagaaaggagctcaaaaaacgcatttccgcataaaaatttttcgattctgatgtcattatcggtcactagaaatcactattttgggattttgtcactaaaatagttaaaaatcactattttggcgacttcgtcactaaaatagttaaaaatcactattttgggattttgtcactaaaatagttaaaaatcactattttggcgttttgtcactattttttcactatttcgacattttttggaaaattctttaacaaaaatgcaataaaaccaaaaaatacacccctaagaatcgacctaaaaattttttcaaaaaatacacccctaagaatcgacaaaaaaaaaaattcaaaaagcactcctaagaaatgaaaaaaattttctcaaaaaggtattttcgtggcaagaattttaattttaaaaattatttttttatgtacctattttgtttttttgctcttaaaaatcccagtcctactcatttgcaatgcaatcagtgaataaaaattatttttgctcaatttttggctgaaaattatgtcactattcgtcactatttcggactttttgacactattttggcatttttactcactattttagttaactatttcgggatttttcttcactaaaattcacgtccctattaatcatcattaaataaccaaaaataaatttttttttttttgatgaagttttatgtgttttgctctttaaaaatccgtaataaaaattttttaatgacttttttcacgcattttcgggatttttgtgccttttcatgctttttaaaaattttttcgtgtataatgccttttcgcaatttttggtgcctttttttgccagctctaataattatgctaattttctagattatggtattaattattcatttcagtttttcttccattttttttctttttctttaaaattttctatattttgaatgtcatatccttttttgtaaattgtaagcaggcgaataatttaaagatttttaaagacaaatataatatttaaaaaaattatatatatttattaaatatttattaatgctcatgggtt

SEQ ID NO: 43594 - DNA, 1010 bp, Heterodera glycines
gagttttcttggattttcagaaaaaacagtccagccagggctaggagttttcttgggttttcagaaaaaacagtcaagccagggctaggagttttcttggatttcagaaaaaaggcccagccagggctaggagttttcttggatattcagaaaaaacaggtccagccatgggtaggagttttcttggattttcagaaaaaacagtccagccagggctaggagttttcttgggttttcagaaaaaacagtcaagccatgggtaggagttttattggattttaggaaaaaaataggtccagccagggctaggagttttcttggatattcagaaaaaacagtccagacaaggctatgagttttattggattttcagaaaaaacagtccagccagggctaggagttttcttggattttcagaaaaaaataggtccagccagggctaggagttttcttcgattttcagaaaaaaacaggtccagccagggctaggagttttcttggattttcagaaaaaacaggtccagccagggctcggagttttcttggattttcagaaaaaacagtccagccagggctaggagttttcttgggttttcagaaaaaacagtcaagccagggctaggagttttctttgatttcagaaaaaaggcccagccagggctaggagttttcttggatattcagaaaaaacaggtccagccatgggtaggagttttcttggattttcagaaaaaacagtccagccagggctaggagttttcttggatattcagaaaaaacaggtccagccatgggtaggagttttcttggattttcagaaaaaacagtccagccagggctaggagttttcttgggttttcagaaaaaacaggcccagccaggggtaggagttttattggatttttgaaaaaaaaataggcccgccagggttaggagttttcttggattttcaaaaaaaaaaggcccaggccagggtagggagttttttttggtttttcaaaaaaaaaaag

SEQ ID NO: 43595 - DNA, 990 bp, Heterodera glycines
gagcaaagcgttcattctcgcgctgccggcccaacctaagcccccgacgaatattcgccggtgatttttttaataatttttgattgaaaattagcgagccaaaggcttttcccctttaaaccgattttttaatttaaaaaatgcttttacaactttaatatttatattttttgctcttttaaattttaattgatttttttgagttttgaaaatgccgaacattttttggcacaatttttttattttgaaatgttttacattttacaaaaactcttttttaaatttatgataataattattattattattttaaattattccttccataattagcaacaaattatcttttttgaaaatggttcgttccctccgctgctaatgatgactcatttcccttccctttgccatttattttaatttgccattttattttaatttgccatttattttaatttgccatttttccaattttcatttggccccttttttgcagtttctatttttggaatcaatcaccttttttctgtatgttttgtcattattattattaatatcatttcatattcattttctcaccggcggcgaatttgtcgccgaatttcccaaaaataaaaaaaatgggggggggggggaagaatgaatcacccaccacacatcagcccaaccaaccaaacacatttttgatttgttttgggggacaaaaatagaaacaaaaagtaaaaaaagaaaaacgggggaaaattgccgaaagaattttttaaaaatcaacgaatgtttttggcgaaatgaatgaatggacgaaaaatcattatcataatcagcatatcaatagtcacttactctctgacgacggcacgggagcaaaaattatgccaattttgtttattgctttttcgatgtgccctaaggcaataaaaatcgttttttttttgcctaactggcccccgtgggacgcccaaaaaaatataggctataacataatgtttgtga

SEQ ID NO: 43596 - DNA, 1114 bp, Heterodera glycines
ttctgcagttcgcactaattatcgcagttggctgcgttcttcatcgatccacgagccgagtgatccaccgataagactagaattcattcttcaacagaagtgtaaaaaaataatgaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacgaaaccaccatccccagtcatgtgttatgtgcctgccacaacaaccgctcaacgacgcacagatgccagcacagccgttaggtcgccccacgagcgtgcatcccacattggcgcagcgaaccaaccaagcgaggcggcccgccaccgacacattgccacgcagcagccatacacaggctttcacacgtgcagcactgagcggtataccacagctccaacgtatggaagcaccccaaaagcatggatcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaaaaagttgtgcccacagaagcaatgagccaactattt

SEQ ID NO: 43597 - DNA, 778 bp, Heterodera glycines
tatgaaaataagtactatttactgtcatacctatgttaaatttgataaattagtttgaacttttgcaagctaatagagaaaaattctggctattttatgctactaagaatgtaaaatatgattgcctttaagcaaagttatgccatatgctttgtcgaaaaaattgctaaaaattttgaattaacgggatttctggcgtaatgatgatcaagttcctgatgttggaatacgaaacggccaagcaccggtctacgtcagttgggcccccacgtttgggccccagcatgttatttttggctataacttttttctttgttaaccaaatccaacattattagaattgaaaagaaaagaacaaaatggcgaaacaaaattaaatctatcaaacattttagttctttgattttatcgaataatctcaaatttagattatacacattttctaccgatcaaaaatgccaccaaagtttgacccaactgagatcaagatcggtatcctgatttggcttttttaacatttaacatgaaaatttagtttacctgcgttgtgtcggtggtgaaattggtgcaacttctgcgcttgcacccaaagttgggcccctcggattggtctgtgcattatttgaaattgtttaaaacccaatatttagtcgcccaaaaaaatcggcgaagacattgcaaaagccacccaggattggaaaggactgaaggtgacgtgcaagctgacgattcaggttcgaagaccatgccaattcaattttaactaagttaccgacgt

SEQ ID NO: 43598 - DNA, 913 bp, Heterodera glycines
ataattaaaattaaattatttaaattttctcccttttcgaacgactttctccttatgtttcttcgaaactaagaactcttgcgtaattagattttttgtttatttctccatcaacactagcgtagcagccgcaacggcttaactctggccaaaaaattgagaacatttccacgaaaatggaaataaacatttaaaaaaatgttcattacccaattagcccactaattgatgccaaagttacatgtaaattaggacatttaattaacctttttatacataaataaaattttattttttgtttattcccattttcctctctctctctctctgtccccgtcagcaaaatgtgtctcaaaattttgcacatttttctgctactgagactgatgttaagccctcatcacatttttacactgttgccgcggggggagggggaccaaaatgggtttaagctttcttcctctgagaaaagttttgcctccgcctcacccccaggccgaatgacgtcagagaaaagcgcccgagggggggggggagggcgaaatttaatccaattgggcgcccactaaagttcttccgccagacttacgacctgaagaagatggcttttgtcataatattactataatggaccaagaatattgtagccaatccaaagcaatttcattcggcttctttaaaatttggtcccggttaaaagcctcggattaattgcctcactggatttcatttggccaaatttcttgaaaatcgtaccatttttgaaatacataaattgttttaataatttatgcaaaacaggatgttcgggtcggtctttaaatagtaatttatttttatttaatctatgctctgctctcttaatacagcattttcaaattaaaatttccaaaacttttaaaaaaaaagtaaa

SEQ ID NO: 43599 - DNA, 1017 bp, Heterodera glycines
  misc_feature (921)..(921): n is a, c, g, or t
acttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgactgtgttagggtctccttgcagtgcgctcaactaagtctcttggagttagagcatttttcatggtnattttcagaaaatgtgcaaatgtgggcgacccggaacattttagacagtttcaaaccaaacactcatagtaaaaaattatttcgttagaatacgag

SEQ ID NO: 43600 - DNA, 1163 bp, Heterodera glycines
attaggaaaattttaccaacaaatatttaattaattttttaacattttaaaaaatttcaaaatacaattgacaaaaacatcaatttttcaaaaatttttatcttattttttacattatgttcagcatgctatcgccaatcccagtctttatgtgctgaaaccgcaaaatgaaggcggaggacacaattattttgatgatgaactcaaacaaaagctgctacaattcacgcgcgaagagcgagcagcacacacactgatgcaacgaatttggccggtgacagcgaaggtaataaaatggggaaacccagcagtaatcaattaatgaacaaattcgatgcttgaacgtttactcaaaacccataaaaagggctaaaccattttggaaacttaacgaaatttgttgaaattgtgtaggatggtaaataacattaaggacaacctgagaatttcttgaattaaaaattttgttgctttttagcaaagcaataaacaaaaagttttaatagttttttgcctaacatcatagcatcaatatttctatcaattattttgggacttacaaattaggattcaaactattgaaaatctgcgcaatttcattaaaatgtgcgcacattttgcagaatttcatggtccgtcccatggaggaggccgtgttggatgacacaatcgtcgagttgggtatgttcggctacctgctgggtgacaaacgtgacagaagcattgtgcgcaacaaacagcgcggctacctcgtccgcactaaaccggcgtcgtcagcggagggcggaattagcgccggaggcgtttacgactcgctgaatttgttctgagggagagtaaccaaactaatcattattttggatacctacagtattatatgatatgatgcgatatatgtttgtcattatgtctcttggtaaatatggtttataataccaacaattaaaatggaactatcaatcgactcctctcggtctctaaagcgagaatctgaaaattagcggaaaacattgcctaacgagtaaccactcgggaccagggctgggcgcaagtgcggattacggaaattccggggtttttggagttgcggaaatttttaaattttttgtttaaggggatggctacccgtatttcgatttatttatgaattaaaatcagattta

SEQ ID NO: 43601 - DNA, 878 bp, Heterodera glycines
  misc_feature (852)..(852): n is a, c, g, or t
aattgtctcatggaaattcacgtgcgattcggaaattcgccgagtaatggttgctgaaggcgtacactttggagaaaaagcacaaaaaggcacgcccatcgacagtttttttgtgggaaggaaacggagggccacggccaactgaaaagtgggaacaaattggttatttggggatgtttaggtttctccgctgtggcgcggctgtttaaagtgcagcagcataatggggcaaaatgcgaaaaacgtacggaaagagttcggcacattgggcattaaccacgctgaaatcgttttattgcgctgtttcctcggcacaaccggtaaaacggaagaatgctcatgcgccgtcttcaaagcctcccgcagatccgtgtccgtcggctcttccaattcaattaaatttttgccgctgcctttgatttctggcggacatccccagggcaatttcttcgggtccgccgaagagaagcgttcttcggaaaaaacggacggaaaaggcaaagggtcggactttttgcgcggttggaagtgaggcatttctgtacaaaggcaaacagtgaaattcggtaattaccaggcgataatttttcggattaaataataatttgtgaaacattcatttacaatgaaaaagtaacaaaaggtaaagcaaattcttattcttaatttttcttttttgaaaatgtataaaaatttctgggaaaacaaaagaaaaacacgagaaagtgccaattgaaagcaaaacaattaaactggcagaaagatcaaggaataatgacacatcacaacacagcaaagacattcgaaaggacgggtggcaattggacacttttggcattcattgctttgttncgcacttcctcacccaccgaaattgc

SEQ ID NO: 43602 - DNA, 935 bp, Heterodera glycines
  misc_feature (27)..(27): n is a, c, g, or t
cgaaaaatggcgtcggtggaaaagtancgaaaaagtaggccacttttgaaaaccaaaattagtaaagcgtaatggaactgtaggtttgtttcttccatgccaattcgtgcttaaaataacagatggcacctttcaacaattccattccattgatgctttttccgctcatttgggggggggggggacaaatgaacacaaattgattgatcgctgtcacttgctgaaggatgagagccgatcagctgaccgaattggacgaatttcgacagcgattcgacgacacggacaacgcaatgttggcacaaacaaagcacaaaataccgccaattttggcacttttccacttcccgtcactcaccactcattcagatgggctttggtgttcctcgacctgcttggccttgttctgctggtgcccattctgtgccatttctgttgccgcgcgtccgccgccaaaacagtgagcagaagttgctgcttcgccttcagagttcgtcaatcagccgaagggcattaagctgaacaaatttttcatccgctggctttgtttggtgctttgactttcccaatatttgaacacttccattgtttttgtgggcaatttcaaaaacagccgaacagatcactgatcaatcggaagggatggaaaggaaatgccgaaattaatgtccccacaatctctcctcagttttccttttatccctcccaacgcactttgttcttctccaggttcttctcgtactgctcgtcctcctctgtcttctccaacttttcctcctcctctctctgcttgacaacgcactcaaattcccttcaatcgttgacaaattattcaatttttatttggacgaagtgccgacagaaaaacgagcggaaataattgggccggcggaggaccaattttcatgcaaaataaaagtggaacacgaactgtt

SEQ ID NO: 43603 - DNA, 1000 bp, Heterodera glycines
  misc_feature (34)..(34): n is a, c, g, or t
attggacaactacgtgttcaatgagcacagtcgncgtctgacctcttatggagcagaaaagggtgaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaaaaaacttttattgcgttacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgcttcaatgagcacagtcgcctctgacctcttatggagcagaaaagggtgaatatcagatggggtgcgtcccatcctaaaaattcctcttttcgtct

SEQ ID NO: 43604 - DNA, 1348 bp, Heterodera glycines
aaatgacttttggcattttgcacttgccccgccatgcaagcattcacaaggcgtccgcctgaccaataatgggacggtattggctcgtcaaattttggcacgtttttcatagtcattgcatgcaatttcgtagggcgtcgcggtgatattcaacaagaatttgtccacttccgacgtgaagaaaatgtgggtacaattcgtgccaaaatggtctacatgccgcacaaatggcttaaaggcaaaagtttgttcagttgttggcacaatgccaaaagttgtttttggcacagagcgtggcgttgtgccatggaatttggttgtgccaacaaacggtgcctttgtttttggggcgaccaatgtttgggaaaggcactaaaaaatgaaattatttataaattacgaattttaaatatgaaaattgaactttctctttgcacaatttggtggtaccgccgttttctccgcaaaatgttgcgccaaattcaaatgccaaaacaaatggcataaaatcgtcaaaaaatgctgcagaagaaagcgcttcttgaagttcatttccaagtggttcagcatctgtaaaatggtaattactattaaaatattattattaatttggctttacttttggtcaaattaatttccaaatatttttccgtttttttcatttgttcggtgccgaaaatgtcgtcgaatccatggcttaattttaaatttaaatccaaattttaaaatatttttcatttgaaatttgcctcgattcgtagctgatcactccgtcttggtgcttggaaatgatcagaccgtcccattggtcttcggcaatctcttcggcacattccacaaatttcagtttgccaattgttcctttgcccaccccaaaacgttttccaatttttctgtttttggccatttcgctttggtagcagatgaggagcctaaaaatgatttaaaataattaatttaaaattagtttttcaattattttactttgtgcagtcattttccaccaaaattgtgccatttttgccattgcacgttttccaaatgccaacgtcggatgacaaagggctgaaaaattgaaaatttgaaaaatttacaaaaataataatttattttcaattaagaaattaccgtatcggaggagctgagcaattaatgaccaagctcagaaagacggtcaatagagaaaaggagttcattgtctaattgattaattaattaatgaatattaatactatttaattaatgaaaattaaaaaattatttgatttattttatgaataaatattatttcccaaatgattaaataaaatgaaatgaatgaaagtggtgggatggaatttgttgatgt

SEQ ID NO: 43605 - DNA, 1741 bp, Heterodera glycines
  misc_feature (837)..(839): n is a, c, g, or t
  misc_feature (884)..(884): n is a, c, g, or t
ttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacactcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttccgtgcaggaaaattattaaattttaaaaattttttaattgctttttaaatatgccaaaaaatgtaggcttaacttttttagtgaaaattcgatcactcatattttttgctaattgagcagaagcgtaccaaactttgcannnggatactccccggatagaaggactaacttaccactgaagatgagncccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctcccccataattgtttgagtacccccaaacggacacttgaaaaaatcgatttttttt

SEQ ID NO: 43606 - DNA, 109 bp, Heterodera glycines
ccgtcaacgcgggcgcggtcaacaccctggccatcaacgccgacaagctgaagccgatcccgtcggccagccagaactgttcggtgaacgtctacgccgacggcaaact

SEQ ID NO: 43607 - DNA, 998 bp, Heterodera glycines
ttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattatttcacatttccgcagctcttacg

SEQ ID NO: 43608 - DNA, 958 bp, Heterodera glycines
  misc_feature (904)..(904): n is a, c, g, or t
  misc_feature (923)..(923): n is a, c, g, or t
ttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcaggnatacgtatcggaacactancaatgcttactaattttccctagatttttaaaccc

SEQ ID NO: 43609 - DNA, 918 bp, Heterodera glycines
ttctatgccaattaattgattaatatttgtataattaattatttattcgtttataggaatcgataaatgaaaatgaaaatgaaaatggcacatccgatgagcaaaatggaggtcagtcagtcattggataaatgaatgatttaaaatattggatcagcaaaagtaaatttgtaataatatttggattacgaatttaaaatgtattttatatcggtttatctcagttgggcgccagcagatttttggattataacttttttctttatcaaccaaatccaacaattttagtatcattcgaaagtcctccttagtgtctgtcttctattatcctgcaaaattacaaaaaatttcgtcagggttaaaaaaaagttatagccagaagaattaaaaaatcatattttccaacttttttggccataacttttttgaaccttaacaaaatgtatcaaaattttgcagataattgaggacacttagggctttatttggttgacaaagaaaaaagttttagccaaaaacgtgccggcgcccaactgatgggttccgatttaaatttttatttaaattttctttttggtgcctttgtttttatgagtaaatgtttttggcacaaataaacacataaattttaacaattttaatttatttctccttcaaaaggtccaacattttgtgaacctttggcggatccaatccaagaaaaatggcgagtcaaaagattgcttttacggctgacaattgccccaatggaatcggtggagcaaaaaatgcgctcattcattggcatgcggcacgaatttcacgacggcatttttgaacaattttcgacattgaaagaatttttgcaaagggccgcaaacattgtattcaatccgacaaaatatacggtaaatggaaatcaaatataattatttaatt

SEQ ID NO: 43610 - DNA, 1199 bp, Heterodera glycines
  misc_feature (136)..(136): n is a, c, g, or t
gctgttgctgaactgacccattgggtgctcgtctccttttggacacacatttgcctctttcctcggcttcagcattgctttcctacttttcctgctgttcaccaattacacgggccgtcatttttgccactgtttntacggtgtgtggggggaaaatggcggcgattttcattggtttttggactataagatttttcattgtcaaccaaatgcaacattgttggtatcatttgatagtcctaagtatcctctattagcttgcaaaattccttgaagttttgtcaaatttgaacaaacttatggccaaaagtacatcaacagaaaccaggttttcagtcatttttggccataatttttttgaaccttaacgaaatatttcgaaattttgcaggctaatagaggacacgtagggctatcgaatgataccaataatgttggatttggttgacaacaaaaaatttatagttcggggtcaaaaggacttttcgaccctatggtttatttgttgcttttcgaatttattttcgtactatttgacctgtgtcggattccagctccctaaaactcgattccaaattttttttaggcacagtaattttgccttccttttggcagggatttcaatttttaggccccaaaattctcttcctttttttgcaggtttgtcaaattctttgcgtgctgatcacttcactgacaattatcgctgatgatgactcaaatccgtcaattggcttcagcaaagatccaattttgtggataaaatgtgagttttttttaaatttcattttttcactgttaaccaaatctggtaatgttttcacgggtactaactaatgtggtttgggtcccccttttgggtcaaattttttcaaaagcgtaaccagacagtcaggtgcactatttccttctcttcttccgcttagtcactggagaaaggaagaaatagtgcgatgtctgactgtctgtcaacgtggggctgcggcggatggagatgtagacagtaaacagccgtgtctggatcagcaatatctggacgaatcagaagttcctccggacacaaaacatccgaaccgaccagacgaatttcctttttttagaatagggcataattaaccgcaattaattatgcctaagggcacctctgtcgaagtgtcaactggcgacgagaagtggaggcgtcgaaaaagctttgaaat

SEQ ID NO: 43611 - DNA, 915 bp, Heterodera glycines
  misc_feature (874)..(874): n is a, c, g, or t
tatttgtactttgttctccacgccctttccccccttctcattgtgtttataaggagaccattcccctcctttttggactcttccctcattcattcgtttttattattatttgcatttgtccaccgaccgatcaataaatatttttattctttgtgtgttcaattggaggaacacaacaacaattaaattatttatgtcattttaaaatgaatatgaaaattgaccacgttcattttttatttttggtgctacaaatgacgaaattaaaatttttttacagaatacatttgggaaaattaattttttttttttctgaagaaaagtatattttttttaaatcggtgaaacaattgtttttagaagtaaactaatttttgtggtcttacttgaataattatgaaattgaggaaatggacacagctcagcgcaggattgccatcagaagaaaattgaaaaaggacgaggcttacgatgatgatgatcaacgcaaaaaatataggatttatcaaccaccaccactgcctcgcgcaaaagtaaaagttgagcacccgaggcctcctccaccccggccgcgtcctaacgtcaagagagaacaacaacaaaagccaaagtcagaattcaaaccgccggcgacatcaaagaaaaccggtcaccccactccggcaaaaagagtgccagagtttgttgatctcgatccacgaccatccacatcaaggcaggccgggtataacccgcctcccccgacgcccaaaataaaacatgagccgacaacaaagagacctatgccataccgtatcccaaaaagagaaccaaaagtcgaggaagcgccacaacagcaacagcctcagtagtatatggtgccaaaacggcgcgngtacaggaacgactcctccaaaatcccaagcctattgaagg

SEQ ID NO: 43612 - DNA, 884 bp, Heterodera glycines
catcctttttccctgatcagctggtaggtgccaaatttcttctaagttattttccggaatttccgggatgaaaagaccctctctttttgacctttttaaaatcgtatccgtttccaaatttaacttatttttaaaattgatcatttcgtcaaactcctcttttggaatagcaaatgcttggtcgggaattatgaattccttattttcgcagtcccttttaagtgaggcatttacaaaagtgagagcaaaatcaccactttttgcagcccaaatatctgtcgaataatcccctgaccattttgaaattttaacataagcacattgttgggtccgatcgggcttccaaataagactgagctgtggacacctacaatttccggcctgatagtcacatgctgaacattcatttattggtgtgttcactccttgggacccataacgggtgaaaacaactgttccgtacacataacaatttgcgatttcgtaagttttccaaaaaatccccgcaggccatttaacctttctaaaaattcttctaacatgcgaattgatccctcattctctccagctaatgtagttctaatcgcttcatttaaacgatttgcaaattcatatactttttcaccgggcgcttgtctgcaaatcgataatgcttggcgtgcaatggacctcgtattttcattttcaaatttccctttcaaatgattaagtgcgacacttaatgttgttgggtgcgggtcaatcgaatccaattcggcacgtgcttgtcctgtcaggaagatgtgcaaacgactcaacttttgggcttcagtcaactgggggtaaagcgaaagcatatcctcaaatttcgaaatcgatcggggaaattgagactggtgggtttc

SEQ ID NO: 43613 - DNA, 68 bp, Heterodera glycines
ttttttttttttttttggggggggggggggggggggggggcccccccccccccccccccccccccccc

SEQ ID NO: 43614 - DNA, 1236 bp, Heterodera glycines
  misc_feature (47)..(47): n is a, c, g, or t
  misc_feature (75)..(76): n is a, c, g, or t
  misc_feature (105)..(106): n is a, c, g, or t
  misc_feature (121)..(121): n is a, c, g, or t
  misc_feature (148)..(148): n is a, c, g, or t
  misc_feature (157)..(157): n is a, c, g, or t
cccaatcaaaaaagggaaaaaaatttgcagtcaaaaaattatcgaantttctccaatttgttttccatattccgnnaaagtatcggggtatcataatgccaaacnnaaaacgaaatcgttntaaaatattcctttctggactgacttnggtttctgnatatcgaagctgttttctacgctatttctaaaacggttataccaaacccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggtgataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgtt

SEQ ID NO: 43615 - DNA, 982 bp, Heterodera glycines
ctctaattattataaatgagactgagaagtgagattatgtcgagacattttgaaaacgatgggagggaaattaaaagagaaattaatttcctcatttttctgcttatggttacttcctcctgctcaaaagcagcagtggaagaagaaaaagctggaaaattggataattattgggtaaattaagaagaaataaattttctcaataaagtgcataaaattttgtgtggctttttttggcctttacattttcatatgggggcattttttgaaaattaatcggcgaaaattcgtcgatgaacagattcaataaattttcagcaatttttagatttttataaaattttatgttaattggtcattgagtttgggggagaaggaattggaccaaaacaaatgggaagtgagagaaagaataaagaggaagagagggaaaatggaaaaagaggagggcagcagcaggagaaacgaaaaaaggagtgaggtgaagggggagagggaaaagaaagaggcgaaaaggcaaaacaaaaaaaaagtctcagaaaattggcatttggaaaggattacttaataaatagcattaaaaaacataattaggtaattaataaaaggatttgccattatgttttaatcagaattttgtttattttgcccataaatccgaacctttctcattaagctatgatgtttttggcatgggaaaagggtgcaaggggaggacaaagtgtgccgagccgaggtttgctgttctgagttagtgaatttgatcacgtttgtagtttacatatccttaattacccccccccccccccttaatttgccattgcgccgtccctttttttcctttctctttaatcttctgctgtctggtattacttccttctcctcttcctccttttatgggtcattatttacagtatagagaagataatgcgagttaatccctcaaaaaattataccatttgccaaaatggggggggggggg

SEQ ID NO: 43616 - DNA, 927 bp, Heterodera glycines
  misc_feature (914)..(914): n is a, c, g, or t
tatttcctcctttttcagattagaaatgtttaaaaatctcttagtacacagcctttaaaatttttagttgatatattttttagatttaacatttgaatttttttggtacattttttggggaatctgaccttagcctatttttgaagtatttattgcggccttttctcttgataaagtaaatagtgaacatcacaagtcagcaaattacagtcatattgaagaaaaaagagtgtccaagtctcttaagatttttaaacgttaatttattttaaaatcgtagaagcagcagctgactaaatgactgactaatgatgactgacttgactgatatggatactttttaacaaattgctaaaaaccaccaataaaagtagaggaagcaacaaataattttacattgcaacaaatatttagaaatttttcttttaactttaaaaaaacatttatatatttatggtattcttttaaaataatttgataattaaaaaaaacaaataataaactaaaaaattttatagaaaatgttaatgaaaatttttgcaatctttttgcaaatgatctccaacaaattatttttgctgtctgaggagcaaatttcatccaatttttcagaatgtggcatttcgaatttcgaacctccgttcattaatatgccaaaaataaaaatcggaataaatatggcaatttatttttatatttctttcaatcaaaacaattttttaatttaatctttttcattttcgaaattataggtatacatgggacaggcggttgagaatgacaattctttgccgtggatggcctcgcttatattgagaggaagtattaatttatatttgttttaattaattatgacttatttataaagtaactattattaaactcgaataataaaaaataaataatctttttanatttttgtttcaa

SEQ ID NO: 43617 - DNA, 1001 bp, Heterodera glycines
agtcagttcatttaaataattttatccaaaaaattttttttgggttttcggggcagtccccctgaacccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttcactatagcctgtactttaaaaatgggttggatttttgctcccccataattgtttgagtacccc

SEQ ID NO: 43618 - DNA, 1204 bp, Heterodera glycines
ctgttttttggattcaaaaattttttaaaggcctaaatgaaaaatcggcctcgataggattttaagttggaatgtttgccacattttttgcttcttcaccgaacccctagggcctaccagtttttccgaaaaactgactaaaaattgcatacttttttgggccatttcagcgccggtggaataactccccggcttttgatgggaggaggtcggtgtaaggggcttttttgtagagctcgacgagctctatccaaccatgtttttagatttcagaaattttcgagctaggccccctcgaaaattttccgtttttgaattttattattttttacagatttttccggggaaaacggagaccactttcaagcaaccgtttttcatgctctatcgattggtgtcattttcagaaaaaatttttaaaatttttttggaaatagaaaattttgattgctaggcctcaatttcagttctggctcaataactcgtcaggagttgattttatcaaaaaatcgtctaagagcttttttgtagagaattttaagcccaatctaatgtgctttatctcatgttttaaccatgagtttaaaaaaagttatgaaattaattgtgattttgaaattaaaagccataggggggaccccatggttttgcatttcatgaaaaatttttttgctcctaaattatccaaaatgcatttttatggcctaatttaaggtgctgaactcgaatatatactttatttttggtttcagactttttggaaggtggttacaaattttgaaaaatcgtcaaaatttgagccccggaaaatccagtgaaatttcgaaaattcataactctcttcgtttttgatcaaatttagtggaataaagtttgaaaaatagcaaaaaattaggagaattttatgagattcatttggaatttctatcttccaaaataaataagttattccagaatttcttgaaaaattcgatttttcagaaaaaaattcagaactctgttctgaaaaagtattttttataaataaaatactacaaaaatccgcaattttttgctctattttataaattttattttagctttttatcacttttttgaaaaaagttatagaaataaaagacattttgtaatttgggaccacaggggtgtgaccatgattaatgagtggaaaatttttttcaccacaaaatcttccagaaaatat

SEQ ID NO: 43619 - DNA, 843 bp, Heterodera glycines
acacggtctgatcaatttgaataggcaaaaaaccaccatattttgtggccatatgttacgaaataagacacagacagaaatgaaaagcatatttttccgatagagcttcaaaagaaaaaatgaattaaaaaacgttttaaatataagaccaaattgttggttttagtattttaggtatttctaagttacttggaagtcggtcaggttggtgttcagccagtacagttgcagaatggtcacaaattgggtgagggaatagccggccatgtacttgaacacgccaaacgaagtgaccaacgcggcacgaccctcgcgaatgatctgtaaaacggaggggggggggggaggggggttataggcaaataaaaaattttaataactttttttttgaaaaattgcagtttcctaatatatatatatatatatttttttttttgcggcggcgtcagtcagcaccgcttcaccgaattcattactaatagaatttgtcattttgtgccgaaaagttcgccaaaaatttgttgacttttttgtgcataatattaaatcatttccaaccgttggcacgcatcgaatgtccgcaactttggaagtgaacggtgccgcgatggacgcctccgcttcggacaacgaaatgccggcatgtgctgccttcagcgcggcacagtcgttggccccgtctccgcacatggccactgtgtagcccacgtcctgcagctggttgaccaactgaaaaaacgggagatgggggcgaggaacgaacaaaacacagggaattgcgtcgttcaaaaaattatatataatttaaaaatgtttagtttatgaaactggaaaaagaaaaca

SEQ ID NO: 43620 - DNA, 1318 bp, Heterodera glycines
tttatgaaatgacagaaagtactttctaacctgtatttcttgtcttttgttcttcttcctacacctttccatgcactaacatacctacctaccttacattcctctcggaggaaaacaatcgagtggaccagaatccgctaataaaaaaataaaatactcggccttaaaaacaacataatgtgaataaaccaaagccgaaactcaacgaagccaaattgtttttcgaagcacaaaattaaagtccaaaaagtctcaaaattttctaagcccgaaactctgctgccccatgttttaagcgtaggccgattcacccacacagccaaaagtgtatcatcatcgtcattttatacacgaacactcaaattaataacgtatctctccatctgtagaagactgagtaacgatacatttccggtgcatatgtttagggtcactgcacgctatttggtaagacttggattaatggggaaccgcaccacacacatttgcagtctctgctctgactgataattactaaatatcgacgatactgatagaaccatttactgttacagtaacaacacttaaccgtaatgctctaccggcgaagcgtcagctgaaagggggagcagcccggaaattagcaccagttcaccaccatattcatacaaattgtctaattaaagttaataatttataaggttttagttaaaaataaattttagatccaaaattttgatgaggacaattactgtttattttacgctatgcaagcaacactggttcgatcaattagttacttggatcgtcgtcgctttcatgattacgtcaatggaaacagtgaaatgagaggaaaacttaaacatgatgctttggaaatgatgaatgctgttaattcaccagctggccaaccaattacgatgcggaaatatatgtgccgagaattgtggactggtggaatgggaaaaaattcgttggtcaatggaatttcaaaacatttgtcttcggatcggcaggccattacaagcctttattcaaatatggaccagaggactatgttgtaccgatcatcctttacttcgaagaggggcattttaatggtgtgcagaaaagtgggaatttgttcggcaagccatattgtctaagttgtgaaaagacctacgatcggccaaaacgtcacattgttaattgcgaagcccgctgcgttaaatggtaataaacaattttaacgaagaattaattatttttaagctcccaaatgggtccaatatttccgtgcaaatcaaataatggattccgacgaaaatgcgaagaatgcgataaattattcttcaacaac

SEQ ID NO: 43621 - DNA, 970 bp, Heterodera glycines
ccgaaattttttttctggctattttatcaaggtttaattatctatatacataaatctaattataatgctcagactttcaaaatttttccaaaatggaccctaaaaattcaaaaaaatgaatttttcggacattctttggtaaattgaaatttaaaaaatgcatcccaaaaatctgttttttgatttttaataattcaattaaaaaattttttttcaaaaattctacaaaaattgatttttgaaaattacggatttcgaattacgggaaattacgggtttttggacccccgtaattgcggattgcggatttcagtaactgagaaaatcgccgtaattgcggattgcggatttccgtaattgaaaatccggttgcgcccagccctgctcgggactgaagtgtctatttccagcccgactcaatgtaactctttgtgattgcttgccgtcaaatttttctgattcttgctttggagaccgagaggagacgattgatattataatttttcagttttgagtctggggattataaaccatattttcctgtctctttttcttaatcttcaccgttggctctcttttgcccttttcctatttcactttcatcctccttggcactcctacacttttagcatttttttcacccttttcactattgtcaatttggacaaaatcctgttaataaatataaataattttcataactttttttcctcggatccctgttgaataaagtgcgccgcaaaaaaggttgttgtttcacccttttgttgcctttaataaatttgaatttatcactccaaatgccaatggcaaatttattgatccaataattccaattaaactacataattccattttattgtcccaattttcgaaatcattttttgggcaaaagaaattcacgcagcaaaatattaatgttcgttaaataaaaataatatattaaatgaatctcggagtctatttaata

SEQ ID NO: 43622 - DNA, 1577 bp, Heterodera glycines
tcgatcgtctgacttgggtataggggcgaaagaccattcgaaccatctagtagctggttccctccgaagtttccccctggatagctggagctcgttaagcagttatactcggtaaagcgaatgattagaggacttggggacgaaatgtccttaacctattctcaaactctaaatgggtatgaagccagggttgctttactctgaacccaggcgttgaatgtttgagctccaagtgggccatttttggtacttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattga

SEQ ID NO: 43623 - DNA, 842 bp, Heterodera glycines
atttatatatttttttaattgtaaatgaaaaaggaaaagataaaagcatcaccaataaacaaatgttcaatgaaatcgaaaaatcgttcgtacatttggcttaatcacagaaatgaactgcttctgttcccccgtccctctccaataaatccgccggtcgtttttgcttaatcatcgacatttacgtacaaaatgtaaatcatcgcattcgtttgctttcgctgttttttaattttaataaaaaacaaaaataattattcttattaacataatcataatttggtattatttcactatacattcctttgttagtcaacatcactgttatgacgtcactttttcgacttttacttaaatcacctcctttgattatctcaaatttcataaccaaatttactaaacaccgaaaaatgctctcccccgacctctgctgctgaaggttaaaacactaatgaggctgtgaaacggcaaaatgttgataatatgataatgaccagaaaattcgcgagctgagaattgcaaccgaaagtctttgaacagctcttcttcccatcggcgaatggatttgttggctttttcaatcggctgtcagcaaaatttcgttgtccatcggcgatcagcaaaaaaatgctttgcattcctttcttttttgtccatcctaaacaaaaacaataattttcaataaccggcgaattaattggttttagccaaaaagaagctggtacgaaatgacctataactaattgctgagaccaaatgaacgatacttgtgacttgaatactaaataacaccagcagtgcaagggcgtagccaacctttggcttcggggggggggggctga

SEQ ID NO: 43624 - DNA, 1255 bp, Heterodera glycines
tttctcggagaatgcaaccatttggacaatgcttggcccgcagttgcatttggcccatcaaaattatcaccaattggatcaggcaacaagtgaatggaataaattgcaatcaactgatcgagatcggtgagaattgttggcgaagtgcgacgacgcaaattgtccaaatgatcaccatcgataaagcgcaaacggcgaatgtttgacgcaaagattggccatatttcacgaacaaaaacatcccaaatcggctgccggtcatccgtggtctgtgagggaagaatccccagacgcaacttggtgcctcttttgtcgaaaatttgatgatttgaacgaagaaaagcgatgacggagtgatcgatgtaactgtgaaaatggaatgaatgcttttattgtgagtctctctgattttaaattactcaatcataaggcattttaaacggattttgctgggcaacggacggtcgggcaattgaaattccgcaaatttgtattcacccataagtacagacagtttcgcttctggtcctttgtccttgcgacgaatttcgattcgtctccaaattgtcaattcgcttttgccatcgaaatgtttgtccaccaacgcattgaaacgtggcgaaagaagtgccaatttgaggccgagttgagcatggtcaaaggatgggaaaatgtccatccaaacgtcattgcaaatccaactgaaataatgaaaataaattaggcaaacaagaatatgtgacttttaaaaaattcattaccgtcggttcattttgtggcaattagcacaatttgcctttttggaatgatgtcactcaaatagcaggataatcaattgcgttagaaatggttttttttttaataatgagaggcaaggcgaaaaacaaacatttttatagtcatgaaaatgggattgatgaatgaatgtttgtatgtatctttggaatcgtaaatctacaatttgattttaagtgttgaattgatttggtttttttctctatcatccaaatcaaacaatcttggtatcatccgaaagctcttaacatgctcatcgataaaaatttcaatggatgaattaaaaatatctgggcattaaataacaaatttaaaacagtttaggaaaaaattataaaaactggaattttttaaggaaaatcaaccgccacaaattaaatccgttttcaatatttttcacttgtggcataagctttagaatgccaaaaaaaaaactcgaaaatattagaattccaactaa

SEQ ID NO: 43625 - DNA, 962 bp, Heterodera glycines
ttatggggagcaaaaatccaacgcagaattaaagtacaggctatagggaagctactcccgaaggattcggtctccccataattctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttcagaaaaaatatttaagaattaattttgcaaaaaataaataaaaacgaaagaccgcagattttggaaaatttttttgag

SEQ ID NO: 43626 - DNA, 1132 bp, Heterodera glycines
aaaaaaattcttgccgaaaaaatggctatctctttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctgtctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaatggctgtctcttttttctcttgaggatttgaccgcaaacttggtaccaacatttgccttctctaatctggctctaccaaacactcacacgatatttgaaatgctaacgaaaaaaattcttgccgacaaaatggctgtctcttttatctcttgaggatttgaccgcaaacttggtaccaacatttgccttctctagtctggctctaccaaacactca

SEQ ID NO: 43627 - DNA, 1608 bp, Heterodera glycines
  misc_feature (40)..(40): n is a, c, g, or t
  misc_feature (91)..(91): n is a, c, g, or t
  misc_feature (1434)..(1435): n is a, c, g, or t
gattcaaacggtggtgcccttccataacgacgtgctgttnaataggcgaccaagaagcgcgtacaaagataatccaggaacaaatattgcnccacaaattcgaagtgcgtcccttctctcgtcgctttgtattgcaagttccttttctctcaaggctttggtcacttcatatgaaatggtgctgaaaacgacaagcgttttgaagaagttcatgtggcgatatttggtcatcgatgaagcgcatcggatcaaaaatgagaagagcaaattgtccgaaatggtccgtttactcaagtcgaaaaaccgtcttcttatcaccggcactccgctgcaaaacaatctgcatgaactttgggctttgcttaatttcttactgcccgaaaaattttccgacgctgaacattttgactcaatgtttacggaagaccacgttcttggccaacaaaatctcgacttggttgcgcgtttacatcaggtggaaagcatggagaatcgggggatgggatggaaatgggattgtcctttggtctaatctccatttcagatcctcaaaccgtttctgctccgccgtctgaagtcagacgttgagaaaagccttttgccgaaaaaagagttgaaagtttacgtcggaatgtccaaaatgcagcgcgaatggtacaccaaaattttgatgaaggacttggaaattctgaacgcctcggggaagctcgaaaaggcacgcctcatgaatattctgatgcatctcaggaaatggtagtccaatttatttttatttattgtttctggaaaacgaatttaatttagctctaatcatccatatttgtttgatggcgctgagccgggaccgccgtacacaacggacaaacatttggtggaaaactgtgggaaaatgattttgctggacaaactgttgtcacgattaaaagaacaaggtccccactcctataagaaatgaatattttcttgctttattggtggatcgcaagccaatttactatagctttttcatagcttatttgttaggtcttatcgactatttctgattactttcggggcggtgctaaaaacaacaatttgacttttaatagatgaggtaactcacaaatggacgaatgtccaattgagtcagtccactttaggctcgcgtgtgctgattttctcctccatggcccgtatgttggatgtactcgaggattactgttggtggtgcgccttttttacctttgcctttgcccgccgaatttcgcccttttcttccctttcccaggcgttctttccattattgccgactcgacgggaacactccgcacgaagagagacaaaagtccatcgacgaattcaatgcaccgaacagtgaaaaattcgtttttatgctcacgactcgggtacaaatttaattaggagagggaaaccattcattacaaatgggaggcnncaggcaggcggacttggcattaacctggcgactgctgacgttgtgataatttacgactccgattggaacccacaagtcgacctccaagccatggacagagcccaccgaattggacagaccaaacaagtgcgcatattccgattcatcaccgaaaagtaagccaaatgcacaat

SEQ ID NO: 43628 - DNA, 1275 bp, Heterodera glycines
gcggaggcggatgcaagtagtggaggcggagggagggatcaattgtgctcagcattagctgtggcggaggatcaagcgcagctcccagtggtggaggatgtggaggcggaggaggttctggcggaggttgcggcgggggatgtggcggtggaggaggcggttgcgggggcggatgcggtggaggatgtggcggcggctgcggaggcggtggaggatgcggtggtggcggaggcggttgcggtggtggaagtggaggcggaagcatcacgcttggtgtcagttgcggaggccccagcggtggtggcggcggcggtggttgtggcggtgggtgcggtggtggcggcggcggtggctgcggttgcggctgcggacgccgaaagcgcttggcccttcttcagcgttctgtggccaagcttgtctaatgcacaagccaataataatgcaaaacgtgtcatattcccttttctatcgatctttcttttagctatttcgctaacttagcttattgttagttttatagtacaaagcctagtcttttacgtagtttttgctggtaataatagtaatttttgtattcttagattttaattaataaaaataaaatttttaattgctattttcttttttggaaaacaatttaattctgaaaattcatttaaatttaaatataaatcgagtcaaataatgaactgaaattaccgggctcaatcaagtgccgaaactattaataaaaatatttaattttattgttaaaaatagattagaagaggaaataaatgaaaaaactggtgaagagaaaggaagcgaaccaataataattagagataattaggttgaatcaaactgcgacactcaccactgaaccaccagcagccaaaaaaaaaaagtttactttttatcgaaaaacctttctttgaatataaatttacccccgttttcccctacgtttttgagctgattttcaaattctttgtcagtgcgggcaaaagccgaaaaaataattttaagcaaaatttgaagcgtttacaatgtctttggacccattttaattttgttaaaattaaaatcaaacaataaaataatcatcaaatattgctacatacatatttgttgtgtttgagagttgatttatgtttttctgggcttgattttcccccccccccccccccccgtgccatccctcccctttcgaccgtcgctcagctgacatagagaaacaaccgctcgcctcgccttttctccataatctcccgagctaacccagggggaagagaa

SEQ ID NO: 43629 - DNA, 1484 bp, Heterodera glycines
attattgcgcaaattaaaactgtcaagcgttcgaaatgtaggaagtgaattaatttggaggagagagggctgattgtcaacaaaagtttcattaagaaaatctggcaaattgcgatcgattgcaatgttgtgcagcacagctgctgccgtgatcaatgttggcacattctgcaatttaattcgtacttcggaatgtaaaatatggaatcgccgcttccatctcccaaatgcattctcgacaataacccttgtttttgcatgtgcataattatattgttgttgagcagcagttgtggggtttgcaaaaggtgtcattagccagcgacgtgttggataagcactatcacccagaataattccttggatttggccaccttcaaatgcttcccatacgtttgactggcggagaacaaaggcatcgtggctgcaaccaggccattggcaagaaatgtttgaaaatcggccatttctttctcattcgaatgctttccacgaaaaaattcgcgaccctcagtaaaaaatgtcttagcatcgtcaagaacatcctcaaattttttaaaaatttcttgtttttttgtcatttctttcaattgcatctcgagaacactccgctgcagttccattacatcagcagctgtaacagttgaagcagttccggcacgagatcggaatggcacgcgagaggtgcttgattcaaattttggagttttcaccgcctctccgcgtggcacagtgccaagaacggcataggactttccttcttcaacaacaacttgctgtgaggaaaattcggcactttcctcttgttctttgccttcaaagaaaatggtgtcgccgatgttgagaccggtctgtacgccgccgggcactcctttaacaaacatctacttacacattagctcgaacacatatctaccctcaaatgccggtgaatcagcaaacaattgggaaacattgcgcgaaacttcagtcatttcgaatttctttccaccgcctgtggcacgctgatgcctaaagaaaatgctgaaacccagcacaggcgcacatatgattaacttttttcggtttgtcgttcgtccttggccctttgttttagatttttgaattttgtttggatttgtgcaatcgttaagccgccctggggcacttcctgaggaaactcacgattcatagaatcagtgacaaatttccacgcctctttttgcttttcgtttgcttttgcagttcgagttggagggttcaaatcatcttgacgcgattgaacaagttcgatcaagcgagccaccatggcttcattgaatcgcgccgccattaataattttaattttttggggaaaatgatttgggaaaaataagaaagaatgcaaaaagaaatttgtttgatgtaaattcacgccatcaaaaacatagtttggggaaacaatctttcagttattgatcatctaagttaatccctaaattatgcaacaacaaaaaatgcaaaa

SEQ ID NO: 43630 - DNA, 1224 bp, Heterodera glycines
tataccaaaaagaattaaaccgaggcgatacaacgaataaaggaatgtggaaccaaacatatcattcaaaaaaaaataattttttgtgagattttttggagctaattataaacaaacccccgcccccgttcccgggggcgagccatttgctcacccacgcccccgcgacgctgacccccgcaatcccccgcccccgcgaaaagccacccccgcccacggggctcgaaccctagaaaagagctttgctttaaaatagcaagagaatttctgagaaatcgcattgaaaatgataattaaaaaagaaaattttcccataatttagaaaaaaaaggtgccgctgaaacggaaggcccaaaaatgaataataatacattctgctcgagaccgaaaatttcccaaggcaagaaacgcaaaaccgacaaaaatttgtctttctcacgataatgccaataaaatgaatttaatttaatttaagagaatggcaaattgaataaccgtgaaaaagttatggactttttaatgcatagggcacaattaggagatgccattgacgccgtgaaattaaattcaaaatgcctaaaatcggaaatcgcttttctaaatgtatagctgatgagcatatttaacccattaaaatacttaaaacttaattttataaacctaaaaaatctaatctaatatatagagaatgttttttgaggcatatgcctttttttgcgaattagtttcgatatattaagcataaataacacattttctgcatgatttgaagcttctaggttgggttttattatgccttttttttacttttttgtgattaccgtgcctttattaatgccttttttggcattttttcccgaaaaattccataaaaatgcaataaaatcgggaaaatacacccctaagaatttaaaaatttatgaaaaatagatcgtcaaaatttattaaaaaattttaggtttaaaattttctttattcgaaaaaaaattataaaaattttaaaatatcttcgtagtatccgctactcaaatcttttttgcattaaactcattattttgagcatgagggagtccgagatagaattacacaaaatatgtgaatatgttcttgtgtttaattaaggcctttgtgcgcatcttttaaccctttaataatagaagcaagttgaaaaaagtctcactataaatatgtgcttatttaaaattatgaatacctctttgaaaa

SEQ ID NO: 43631 - DNA, 1183 bp, Heterodera glycines
tcagtacttgattgtcggtcattgtttaatttttgtttagaaatttttaaaaatacctttttaaaaattctatttttttgttggcattttcatccggaaatattggtccgcaagtgtcgacgaactaatgaaaaacaccttattcagcaagctatttgcttgatttcccaaaattttaaaccaaaaattcacttgctaatgatgatgagcttgaagttgaagaaaaggatgaattctttgatcttgatcgcctaagagaatcgtcaaaatatttgctcatcgatgattctcccttttccaaacgtcgggctgtgttaaataattagttaattaaaagtaatagataattggcaaattaaaaaataaaataattggttaattaacagtaataaagtaattgcttgcttaattaaattaataaaatcattggctaattaacaaaattaaaggattggttattaacagtaattaagaattactaattaataaaatcaaaaaatggttcttactgttcaaaattggacgagataaagaagacggcctctttacgacttcggcttcaacatccgctgatggattattcattaacagtttgaccggcttaattttacgatgacgaacactaccatcattatgcttgttttttgagcaacttttttctataatattaaaaaaattattttttaaaataattgaaaatatccagaattgtacgttgataactcgtttgcatatatggagattttcgcttagaatcgacaagatcagcaaagtttgtattaacggattgtgcaactgtaaaatgaattgaattttaaggaacaatttttataaatttttttaaaatttttttttaattgtctttttcaacaattattttccaatttatcactagttcactgtttgagagggacaaaccaataattaaaattaatttaaaaagcggcgataccgaaaaatttggacataaatgaaatttgttagtttttgcaaatttaaccaaaaaggcacaaaattttaatcgtaaaagatagcaaaatttaattatatatattatataatatatttttaaattattattttttgattttgtgtgcctgggaagcaggtgcgtaacatggaagtcattgaatttttatcaatatcattattattctctttctgctgcacggattgatcaaca

SEQ ID NO: 43632 - DNA, 908 bp, Heterodera glycines
  misc_feature (864)..(864): n is a, c, g, or t
ttcgacataggtcgaaattaatgtcagatccggattctccgacgcttaaaactccttaaatgatcaattctcgacaaaaaaaatttcaaaattttattttccgaaaaaggggacggactaccatcggtactattacccagctttattttaaaaaagcgctaattccttaaatcggccatttttccataacatttttgtaaaaaaatgttttcagaggcaagtcggcccgcattttcagcgattggctcaaggacgccaaattccatctcgaagtgcgactgctggttgagctgctcttggcacattcccaggcttcgggaattaggacgacatattgaaaataggcggaaacgaaacaagaccagtttaatttgtccaaaaaatattgattggaatgataaagtttagacgacccatttttcaaaatttggtaaatttcttaatgaaatgatgatcagaagagcaagaaagacaatgctcgatgttcgttcaacccatccatcccctgtccgtacaagcaaaattcaaagaaaatacgtgtcgtgttcgggatttccggagtcgaaggattctcgcccacccacctcgtctgatgacctaattgtaagcccaaggacatcctatgggatatttggtattatttgttcaggcaaagaaaatatgtaatttgaaaaagaattcaattttcttagctctctctcacttgcttttcaaggcagcctctttctctccgtttgtttgagaatccaccaactccgaccccgttggaggagaaggttcatcccccattccaattccatcacaatgtcgtgtgttagaaattcgttggtcgattgccggtactaatgcactttaccagacatnaaatttttttttttttgtcttaattcgtgtaaaaatggttttca

SEQ ID NO: 43633 - DNA, 1004 bp, Heterodera glycines
  misc_feature (914)..(914): n is a, c, g, or t
ttattttatgaattacaataaatataataatatttcaaagatttttttactttttgagtccggtattttttcctttatttcatgacattttatttctgcttgtgatgctccatttttattaatcaacagatcataattaatatcacgctgattattatgcagctttgggttagggcattttactgccatataaaatttattcttaaaattaacagtaaattatttgataatgtattaatattgaatttttaagcgatttagcagtgattaatggaccaattcccacgtggattctctcctgctgggtcagattcatctcgcccccaacactataagcgctcttggccaagttagttgcaattttgtagataatcacgattatattgctttttgttcaactcagtgaaaagcaagctaaatatagaatgtaatttggttaaatgtgccgcggcattctaatgcatatgcaaagttaccaaaattgttgggaatattcaatttcagctagagttgagcggggcagggaattttgggcaaaccgggacttttcgggttgaaaaaacgggaatttttggctgggaaaaccgggaaaaaaccgtgaatttcccggtcccggtcaaaactgatcaaaaccgggacttcagtactcagttgtccgtgttttggtcccggtcccgctcaactctaattgcagccaataaaattactgttcacactcaaagattcattgaacatcaaaaatggtaatattagaaatttaagaaatcctactttctgtatgaatttgactttcgttgggaaactgtttacggacacccaacaaaaatccgtagcattggcggcttcatcaacggccctgactttttgaccgtgttcgggaagtcatttcgaacgctaacccgcaaatttagttnaatctcatttggtccattaatcactgtttgatcacattatagaattattatattaatgccaattttgcaaaattaacatcttaccatatt

SEQ ID NO: 43634 - DNA, 1206 bp, Heterodera glycines
tgcgttcgtcgtctcatattgacgcggtcaaacgggagattatgcgaagtcagtgccacaggcaaaagcgatgccaatcagaggacggggacccctccctcaaaggtatgagcacaacgacacgaatcttcgggaacacaccgcgacggcaactgtccgtaaaagagcgaagcgtcgcggaagaggccgactcggagttgggcgactcgtccgcaacggaggaaggcggcaccgagtcgatcaggtggacagcggcgggggatgtgccattgttgcaaaatgagagactgtcccgccaggagttcgttgccgttcttcgattcgcttcgctccgccactctctcgccccatccgtttataacaatcgcagcgagcggagacaaacagttccaatacgcggaacgagacgcagtcgcggaacccttgcgctaccgcacgcggccgcctcagacggaactgccgaaagggcgcgcgacttccgtgcggtcggcggccgagtcggaagggacgaaccgaaagacgagcaaaggggcactgggcgagaaaaggtcggcacccgtggagatggaggaggacaaagacagacgaaggctaacggaagtgacggcgatgatgcgacgcctcagagacagcatcgaagcacaattggacagactaactgaacagatgggcaggacggaggacgacgacgcagcgggggacagaccgaacagccgacggggggaggagggcgaacagcggggggacagctgcgcatcactctcgccatctcgcgtttcatttgcatcgaccaaatagaaacaaattgagcccctccacctcattctcagattaatccacaaagaataaaatgttaagaatttatgtgaaacggtgtaacagttacagtacattttggtaatatattatagtgtatggtgtgcataaataccgtatggtcgggtgtttcatttacacggactttcccctcctcccaaaatcagtgcattatgaaaagaaaaataagcacaaggcaagtcgaaatcaccgcagcgagaatgagtgtgtccttgcgcttcttcatccgaattttgttcatcaaatggttgatggccgggtacttttctgaaggtttaaattagcgcaattttgaatttaaccgtttgttgagctaaccccccccccagccccgtagccaggggggggggaaggggggggggggggaat

SEQ ID NO: 43635 - DNA, 1366 bp, Heterodera glycines
aaaattgactagagcaatcgaccgctaacggacgacctaattgaaaaaaatcccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtattcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttgggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttaaagtgaaagcatagggaagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaa

SEQ ID NO: 43636 - DNA, 976 bp, Heterodera glycines
cggtgtcatctatgttactagatcggggatcgatccccgtttcggtcgctcgagcaggacctgcagcagctagcttgctggggatcagattgtcgtttcccgccttcagtttaaactatcaagagagggaggagagggttggagaaggaaaggaaaaaaaaaaatgaaggaggagaaagggtgggggcaatgaaggaagggaaaaaagttgaaagaggggatgcatataattaaaaaaatatataattattattttaaaattattagactgtgagtttcttacgggacaaaaaatgatttaagatcttaaagtgaaatttatgtttgagtaaaaaatttataagatcttgagactcacaaaaaggtgtttaagattttaatttgaaatctctccatgcttagttataagacattttttttaaaagttggttgtctctttttataagttgtttttttaatttttaaatacattaattatttttttcttatatatttttatttaattattttttcttcaaatattaatgaaaggtaattaaatggatataaagataagaaatggatttaaaataataatataagtaattaatatatttaatgtgattaattaaattaattatttttttaatatacatgaattaattgaaaaaatcttataattagagaccaagaaagacatacttgtctttcttttcttctcacctctccttatattgtaagaattgtgaaaaaaaaaatgaatctaaattatattactttaatgtaactctggtcccagacaaacaaaccggttcatctcgtaacttatcagcatgttagtgacaatggagttcaggatgtttatgactcatttcactacatccttaattttaactaaaactaaataacatttccttagacagatctttaacaaaaagaagtggattcatctcacattttaaagactaaaaatataattaaagtcctttttaatttt

SEQ ID NO: 43637 - DNA, 1009 bp, Heterodera glycines
tatcaaaaagggcgatgaatacaaattctaaaaatttttaattgctttttaaacgagcgaaaaactttagggcttacctttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaa

SEQ ID NO: 43638 - DNA, 1522 bp, Heterodera glycines
  misc_feature (1394)..(1394): n is a, c, g, or t
  misc_feature (1496)..(1496): n is a, c, g, or t
  misc_feature (1510)..(1510): n is a, c, g, or t
  misc_feature (1516)..(1516): n is a, c, g, or t
ccaacatcactgggaatttccgagtgatttacggccctttaaatcactgcaattttatgaaaatcatttggactgacttttttttttaatcttttttcccatatcttatgtgatggagaacatttaattaattttcttaaagtgctaaaattttaaagaatcatataatattagaaacagaaaaactgtaatgctttggaaaaaagtgtacaattgggaagtaaacataattaatcttagataaaattgtttttgcaattttccttatgtgtctgtagtcaaaaccggtaaaaaagctaaaaacatagccattcttttgtggcaataccccccccccccgtttatattcccaaaagagttttataataaaaccgtattcgtaaaacatacgaaaaatattattcatataattttttacatataataatataaaataattttaatgcgatcaaatcgatataatatttcctatacaaaaaaaaaatcgttaaatttggaaaaatcaaaattataatcaatccaatcatttacttactgtatggcaagggctctgaatgttggactacatttgagtccctaaagtggctgcgttttacagtaaagccgtaatcgcaaaaacacccgaaaagttaaataaaatataaaaataatttttatgcgattaaatcaattatttactaagcaaaaaaaaaaaaattattttaaaatatttttacaatagttattagtaatttattgattatattataaagaatcgataaattactaagcaaaattgtaaaatttttatttctttataaaatataaaaatcaaaattatttaatagataatgagtacaaataagaattattgatctaattgaaaattgataaaatgcaaacagaaaaaatgaaatgaattcaactacataatattaaaattaaaaaattcattaaaaaaatatttttgttgaaattttgccaattttagttttcttccaaaattttcaattttcttcccaatcaaaactccatccacagaatatgtgcaattatttatttatttatttgtgttgtgtgttgtttgtccccctcttcacatttattcgccaattttggggctgattttcaaggtgaaatttgggcggggaatggaaattgcaaattgcaaattgtgcgccaaccgacggacggacgaaattggcgcaaaagaaatttgtacaaaaatggacggatatgggatggggatgtattgttatggatgaattgttggaccatatttggggatggtgtcaattattcattcattcagtcagtcaatccatttccgtcgctctctctaattacattttcaaattttttaaatttggcattatgtctctatagaattggcacttacttttttttattcgtanaactagagttgagcgggaccgggaaatttgacaaaaaccgggaccgggacttgccgggacttttcccaagtgaaaattttttttgaaaaaaatttgaaattntaagtgcactttgntacganaattgc

SEQ ID NO: 43639 - DNA, 1358 bp, Heterodera glycines
  misc_feature (1339)..(1339): n is a, c, g, or t
gtgggaggtccggcggagccgctaaaacactgctgatattatgaatttagggtattttggaattttgaaaaataggcattttcaacttttaagcccaattatgaaaatgtaaaaagttccggaattttgtgctaaatggtcgaaatgcggaaccggaatatggaaccagcccttgtaagaagcaatcaatcaaaagtttttatggatttttgtttgctgtataacagagagaagaaccatatatatatgaagaaggtaaacaaaagataccaagaatgaaattttggtttgatttgataaaaacagaaataagtttggtgttgtgttgtgtacgaatcacggactaacaggcattgcagcgtattcatcggagaccatttcgacggcgatggcaccggcggtgtttgtgtcggccaggacaacggccggtgattgggtgttggaagaaaagtccaaaggacgagagacagacgacgaagaaactgttagggatgaagcgattttttttttctgaacatggcacgggtatgggataggccgatgtatccccggccgaaacgtcgccggatgttttcggaccattactttttttttgttgttaatcaaattacgctttgttgatgctttcgatagctatgcgttttgttggtgagttcgacttggacctggatttttgtcccggaaatccaggcccaacatgagattaagtccaggcttttttcaaaatgtcgaacttatttaatttggttgagaaaaaatgatggtccaaaaactcgtctggcgacaatttcgacaacaatgctttgtcctgctttggagattataaaagcattatttaaaattacatatatcccctgcacaaaattttttttcattaaacatcaaaaaatttcagtgccgactgtgatttgggcaaatttggagtctgatggtgcaaacatgcgcccccgaggaaaattagaattttgaaaggattttgttaagaaaagttgggtcaatttcagaaaatgctcctattaaaacaatcgcgcagatacattttttaaaaaataaaatgactcatcgcgtgtggcggacacgctccgccccttttggccatatggacatttttcaaaatgaaaggaccaacattgtgaaggcttctcctcctgtgcttcctcagagtcgtcgtcgtcctcaattttgagccgtttcgttggcgattcatttgacgaagaatcagcagctcgagacgcagttgttgctgttttttgatatgtatgtaaaatcatcgattgcttttgtgcttatttcggggtttccccccccccccgcccctcgtgtcgtttcatcccgaganattttgaaaaactttaccg

SEQ ID NO: 43640 - DNA, 1217 bp, Heterodera glycines
ttgctatttcccgggctagacatttcttttgtttaactgtcaattttggtactcttaaagcatgtaaatcctggtccaactatttgagctcggcttcttcttactcccctgtaatcggtcaaagctatatttttaataaaattgaccccctaattgccacttttaattcgcactctttcactaaccatcaatttctcactttcaggatgccaaaccgcgccgtgccaagtcaccctccctctttattttctattaatttcgcttccccaccacttaacccgtacccttcctcctcctcatcttctgcccctcgccccatcccttccctcttccaaaacattattcccactcctcccaaaaaattttcctctttttgctttacaaatgtccccaaccgttccccaacccccatttctagcccttcccaaattgttccccttgttcccctctctcaatctccccaaacagtacccctttcacgctcctcctccatttacctcaccgccgtctcttcacctctttcgaatcactccatttccaccccgcctccttccacacctcccccaaccattatgcctcccatttcccaatccccctccatccctcttctcccttccgacaacacccatcccccttcattccccgcggcccttcctccctactctgtggcccacaatttcccactccccaacaccatccctccccccttatatcgtcggccaaaccgccgccactcccgtagctccatctcccccattccccggtccatcactcccaccccctctaccaccccctccccctccccgtctccctccacaccccaagtacgcatggcaccgctgcctcctccatacgaagagcgctataaaattgccgaaacgcgccagtgagagtggacagcttacggctggagaccgatttaaaaccattgttgagcgcctcatcaccctagttaatgccgcttatgcaagaattagaccccacattccgcaaatattgttttttgcgtgtttctcgaaaacttcgggaagaaattgcttccatgttagacttgggagtagtgtctcccaacctttgaagagacccgaattaaggccttataagtagaaaaattactggccactcgcaaaccccgagatgaccccgattggctcaatgtcatggcctcctcttcctcggcccaatcccctccaagtttactccgaggaaatttcaca

SEQ ID NO: 43641 - DNA, 943 bp, Heterodera glycines
tgggtcggcgagagttttgggtttcgggggtcaatgttcggtttttatattcttgattaatgtgtgaacctccaaaatcaattaaaatattagtattatacaaaatgggtgttattgaagcaatatttttagggaaatggcgcatttcttcgctttcggtcccattgaggaattcggcttcaatttgcatgccgaaaggggcaaaagccacttcttcggtgccgttgacaaaggcggtatcgccgatgagtcagtccgattgaccgtttccattctttgcatttcattcggtttgtttagtgccggcctcgaaacatggcaaagtattgtcggcattaacggctatttgatctccgtacaaactgcgcaaaaggtgaactcagaaaagaatacaaaacatacatggaaaatgaggcgagggcagcgacggttccaggatttgggcttggaggggggggactgctgcgggcgacggctttttcttttctaatcgctttttcgcgccgcctttttcaaaagtttttgatcatcgagaggggtccgatggtgccggaaggctccgtcagaggaaattggaaatttttatacttacaaaaaaagttttttgaaaaaagcgcaccgcaaaaaaagtctgaaaagcaaaaaatcgtcgctaaacttggccccactccttttgtaaaactggtgcctcgatatttgtggtcaaacttttgctgcaatcagccataaatattagcggcccaattttttcgacaccaatcaaaatataacctcaaaatttttgtccaattcaatataagcgaattttatgtttttttgataagcggattcaaattacaatactttctcgaatccattttaattggatccaacaagtatcaaactgaaaaaaagaaagaataattgtggagaaatgtcagatcgatcagatcaaaaatctatt

SEQ ID NO: 43642 - DNA, 1421 bp, Heterodera glycines
  misc_feature (15)..(15): n is a, c, g, or t
  misc_feature (24)..(24): n is a, c, g, or t
  misc_feature (38)..(38): n is a, c, g, or t
gtctataatttttancatggcttntattttccttttgntgtaaaggaaggataatagaatgtttccagatttttggtaatttaccggtgttaaaagataattttaaaagatcagttataggcctagcaagaggaagaaaagagtttttaagtatttgattgttaatgagatcaggagacgtattgttttttccatccagaagattaagtttttgaatagtatccgaaacatcaaaaattatttcagagagataaacttgagcttgatcccctcctgggagaggataagaggagcttatatcgtttgaaaaagtttgagaaaaatatttcgcaaaatattgtgctttttcgaaatcatcaaaaataaaaccactttcggtttctatagatggaatagaagtactggaaaagttgtgttttctaataattttataaagattaatcggatttgcagaaagaaattttctttgtctgttttcgtaaaattttttaacttggattttaatatggagagctaaggaatcatagattggtttaaatttaacaggatcttttttcattttacgccaaatacaagctttttcttttattgatgatctaagtgataacggaaaatttggaggtctatttttgacaaatgtattttttggaataaaaagatcaagggcattttgaattgtattagcaaaaacattatatttactctccaaagtatatgtggtagttagagatgaagataaattggagagtaaataagaattgaatgctttaattttagactgggtgaaatttctgaccgtaatttttgggggtttttgtctttggaaaggaatatcaatattaaagtacaatgctgaatggtctgaaaaaacaatactatcctttagttcaattgaagagactaaatcagggtttgtaaaaagacaaagatcaagaattgaatttcctcttgttgggcctataatattagtgttaagtgaaaatttattaaaaaagtcaagaaaagttattcctagaccggtatgaggtacaggaatattgttaacccatgttatatctttgctgccaatgttaaagtctcctatgataatcgtattgtttgttatatatttttctagaagtaaaaaaagagattttgtaggtttcaatttggtgttagggggccggtatagacatataatagttatattttttgtattttttagtttaacgatagaaatttcgcacccaaattttgaaaaagtttgggtaaaatatggttcaattgctttattaattaaaagtgaggttccaccccctttacctttactgttatttcttatggccgaaaagattacataattttcatttaacgtttggtctgagaaaattattgtttcattattagtaagccaagtttcgcacagacctagcaccattatt

SEQ ID NO: 43643 - DNA, 958 bp, Heterodera glycines
agcagacacgaaggtttcagaactccgttcggagagatgaaatgttgcggtcggtccatatgattttcaactggcagtacctcttggcaattattgcgcttcattgctcaatcggaacggagagaaaacgtacgacggcaatgccttcgatagcgaaaatgacagtaccaaaacagaggggcaaatcggacaaattgccgacggcgggcaattcgtcgatgctgtacaaatgggatgatcatatattcgagaatgatgagcaccgctcccaaatagaccaagttggcaaccaacgcaagcggtgccaacactttcaattgtcgaatgctccaaagacttaaccggggaaggggggggggaattgacaatggcattttggaaaatcattttttaaatattcacaatgattactccatagctggaaagatcagcacaaaaatacagccagctcgtggtaccttagcgtacgttatgtccataactaggatcaaacatgaccaaatttattgaaatttagatgagcttgtagagaaatgttagggctatacaatgatacacaagcatctataattcagaagactcagacaaaagttccgatcacttaatcatagacaatttacatgtgctggttctttatataacgccctttttgatggtttttatataacgactcagcacccgtcaaatgaaaatgattcgatcattggcttaaacacttggacttatgaacacacgccgatcatgtccaagttgtggcggggagactaaaatcaaaccgccgattgctggacttcgatagggcaattagggcaattggcggtgcgggcaaaaaaaatatcacaaaaaaaggaaattttggaacattttttgaagatctcttttttcttgtttgttaggcacaaaatggtcaatcaagaaaaggttgaactgatttatttctgtacgcgcaaaataggaa

SEQ ID NO: 43644 - DNA, 947 bp, Heterodera glycines
atttttaaatttatactctatcccagaaaaatgtctatctttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatataccttttatttttgagggaatttttaaatttatactctatcccagaaaaatggctatctctttttttgataaattttata

SEQ ID NO: 43645 - DNA, 746 bp, Heterodera glycines
  misc_feature (58)..(58): n is a, c, g, or t
  misc_feature (92)..(92): n is a, c, g, or t
  misc_feature (94)..(94): n is a, c, g, or t
  misc_feature (110)..(110): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (126)..(126): n is a, c, g, or t
  misc_feature (135)..(135): n is a, c, g, or t
  misc_feature (139)..(139): n is a, c, g, or t
  misc_feature (145)..(145): n is a, c, g, or t
  misc_feature (166)..(166): n is a, c, g, or t
  misc_feature (168)..(168): n is a, c, g, or t
  misc_feature (191)..(191): n is a, c, g, or t
  misc_feature (218)..(218): n is a, c, g, or t
  misc_feature (236)..(236): n is a, c, g, or t
  misc_feature (294)..(294): n is a, c, g, or t
ccctctcacgctcgagcgcttttgtaacgtataaaacccaccctgagaagagatagtnatttttcttggatataagatacttttaaaaattntntgtgaaattaaatggngattgggnantgtntntgattttangttngagagnatttgtaatctataaaatttntnaaaataagagatagttatttttnttggatataagataaatttaaaaattntttgagaaattaaatggngattgtgtagagtaattaatataaagttagagtggttttgtaatgtataaaatttgtnaaaataagagatagtgatttttgttggatataagataaatttaaaaattatttgtgaaattaaatggagattggggagtgtttttttttttatgttcgagagattttgtaaagtataaaatttataaaaagaagagatagttatttttattggatataagataaatttaaaaattgtgtgtgaaattaaatggggattgtgaattgaagttattataatgtttgagagattttgtaatgtataaaatttttcaaaagaagagatagtgatttttgttggatataagataaatttaaaaattgtgatgagaaattaaatggggattgaggagggtggttattataatgatagagtgattttgtaaggtataaaatttattaaaagaagagatagtgatttttgttggatataagataaatttaaaaattgtgtgagaaattaaatggtgattg

SEQ ID NO: 43646 - DNA, 211 bp, Heterodera glycines
cggtcaacaagattgaacgcgcgtaagagaaaccggtgccgccggcgatcagcaccagcggacggctgccctcttcccgcagccaggcgtcgccgtgcggcacgtcgacggtgatcgcctgctctttcaggatgcgatccatcaccgccatggcatacagattcagctccgaagcgccgatgtgcagctcgatataatcttgctgcgtcgg

SEQ ID NO: 43647 - DNA, 287 bp, Heterodera glycines
cgcccatcctgaggccgcgaagcggccgaatgtcccccaaaaaattaaaagacgaccgaatccttccggaatagctgccctatatcctgtactttaagtctgcgatggatttttgctccccataattggttgagtaccccaaacggacacttgaaaaaatcgatttttttgttttcggggcagtccccccgaaccgatgcgcccagatttatggggagaccgaatccttcaggaacagcttccctatagcctgtacttaaattctgcgatggatctttgctccccat

SEQ ID NO: 43648 - DNA, 1007 bp, Heterodera glycines
ttgaaaagggcggcaagggtgtcagcagtggaccggttcggcagagagtcgcgttgcagagtcagatctgaaaagcaaggacaaaacggaaatccgccttttttctggcttaaaaattccatcagtgtcagcttcttgcgcacatttgcgatcagcaattggaaaattcatgcttttgccgattttcaacaatttttcaagattggcggctgcgacatccgccaattcctatccggccttcggcgaaaaaattgtccccaattttctgaatgctttccgtcctttcacttcgtcggtgcgactcattgagcctttacttttccaaatttgtccacactttgacttttccttagaaaatacgccggcgaacacaaccaacgcagcgaaaatagcattcaaaaaccattttggaatttctcgccgatttttcctccatttttgttgcttttacgctgcaccttgacgacgaattgcgctgtcggttggacgctttccgttttggtccagcttccacgttcgttggttgtgccggtggttggttcgacaaccgcaaatcaatcaattttttatcaacttctgaattttttcgaaaatcggcacttttcgtcgcaaaattttgttgtggcggttttcgtgcacagttggattgcttccgcgcaaagggcaacctacaatggcgagaaatgtgtcccgttttgttgcagttgtagcacgacaattcggtttgtctttggcgcgaaaattttttgtggttgaaatgtcggtttctgttgaaatttaggtcggtgcttgttggtgagtgtgcgaaattgggaggagcagtggctgtccagtacaggggggtgggttgatcattgatcagagtgttgatcagaatttggtgagtgcgtgtgttgaagggatggggggggcgtcaatggcgaatgatgctgccatgcatatattatgcaggcagagaacaaaatgaagaagagaataaatgagagagagagaaaaaacaaatgaga

SEQ ID NO: 43649 - DNA, 1195 bp, Heterodera glycines
  misc_feature (48)..(48): n is a, c, g, or t
  misc_feature (79)..(79): n is a, c, g, or t
ttatggatgaattaagtatagaaggcgtcgcagaaatccattcatatnttctaaattcgggtttcagaaaattaagatntaaaagaggctggattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctcccatgaaaataattgctttgcacaagcaatattttgtagagcccatcaaacacattgtgcttataggaaaggcagaattgaacaataggggcctttttattatgattacaacaaatcagcatggcgtctcgctgatatgatatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggagacaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaatagttgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgtatcaaattcctttggattccaaagtggaatgacagaattgcgacggcaaatcctaaatagacaacgacg

SEQ ID NO: 43650 - DNA, 828 bp, Heterodera glycines
cgctgttgtacctcttctaatcactgttgtaccacttctaatcactgttgtacctcttctaatcactcttctaatcgctgttgtacctcttctaatcgctgttgtacctcttctaatcgctgttgtacctcttctaatcgctgttgtactcttctaatcactgttgtacctcttctaatcactcttctaatcgctgttgtacctcttctaatcgctgttgtacctcttctaatcactgttgtacctcttctaatcactcttctaatcgctgttgtacctcaaaatttaaaaaacgggcgcgaagcgcccgtatgagttcaacgaatttaaaaaacgggcgcgaagcgcccgtccaaggccaacaaaaattgaaaaaccgggcgaagcgctcgactgaggccgtgaagcggcctaacaagctaaaaaacaggcgcgaagcgcccgtatgagttcaacggatttaaaaaacgggcgcgaagcgcccgttcaaggccaacaaaaattgaaaaaccggcgcgaagcgcccgactgaggccgcgaagcggccttaatagcccaacgaatttaaaaaacgggcgcgaagcgcccgtccaaggccaacaaaaattgaaaaaccggcgcgaagcgcccgactgaggccgcgaagcggcctaacaagctaaaaaacgggcgcgaagcgcccgtctgaggccgcgaagcggccttaatagcccaacaaaatttagaaacgggcgcgaagcgcccgtctgaggtctcgaagctgccttaatagccaaacaaatttcagaaacagggcgcgaagcttccgtataagcttcaacaaaattt

SEQ ID NO: 43651 - DNA, 990 bp, Heterodera glycines
aataaatttaaaaattccctgtagaatatattggacattgctctccgcgcccctctgcccatgctggaacatttgaatggtacgatatttctcgcaaaaaagagataaccatttttctggcatagagaataaatttaaaaattccctgtagaatagaatggccattgctctgcgcccctctgcccatgctgggaacatttgtatggtacaaaatttctcacaaaaaagagataaccatttttctggcatagagaataaatttaaaaattccctgtagaatagaatggccattgctctccgcgcccctctgcccatgctgggaacatttgtatggtacaaaatttctcgaaaaaaagagataaccatttttctggcatagagaataaatttaaaaattccctgtagaatagaatggccattgctctgcgcccctctgcccatgctgggaacatttgtatggtacaaaatttctcgcaaaaaagagataaccatttttctggcatagagaataaatttaaaaattccctgtagaatagaatggccattgctctgcgcccctctgcccatgctgggaacatttgtatggtacaaaatttctcacaaaaaagagataaccatttttctggcatagagaataaatttaaaaattccctgtagaatagaatgggcattgctctccgcgcccctctgcccatgctgggaacatttgtatggtacaaaatttctcgcaaaaaagagataaccatttttctggcatatagaataaatttaaaaattccctgtagaatataatgggcattgctctgcgcccctctgcccatgctgagaacatttgtatgggacaaaatctctcacaaaaaaaagatagccatttttctggcatagagaatatatttaaaattccctgtaaaaaaaagtggccattgctctgcgcccctctgtccatgctgggagcatatgtatgcgacaaaatatctcgcaaaaaagaga

SEQ ID NO: 43652 - DNA, 900 bp, Heterodera glycines
  misc_feature (872)..(873): n is a, c, g, or t
ttcattatattacaataaactattttaattgatttgttttttgaattaataaatttttattctgggcagcatcaattattgattattaattcatttaaagggaaaagtaatttttttttaaattgaaatttggattttactttttgttaaatttatttaaacttaagaattcgattctttaaaattattattttttattttgtgtttcaatttttaataatcgtttgatttcctctgcattttatggattcttattttttgtcttcatttatcaattattttgttattcctaaaatcttgtagaaaatgtttgttttttagaattaaagcaaatagaattttattttaaaattgaattaatttgagaaaggaaatttcatacaaaaattgagtacaattttttattaaatttaattttttaaattgactattaataaaattttcttatttttaactcttatttattgctattgaaattaaataaataagatttaaaaaaatattttcttgtcttctcccaggatcaaacttaaattttcatcgcggttgttttttattttaaatttaactgttaattttttctgcttcaaaaaaattaaaaaatatatatagcgaattctaaaatgactaagtaattataaaataataattcaattttatatgaattatgaattttactgtttgtacattgataaattgttttttatattaagttatattttatttggttcttttgcttggaggtaattttttaaatattgagcaattaaactagccttttaaactggattcatgacgttgacaatgtgtttttctttaaatagcgctattttcgtctctttttttaatgcatacaagcaaaaaaacatatnntaataaattaattcccatacctaatga

SEQ ID NO: 43653 - DNA, 1339 bp, Heterodera glycines
ctaagaggcagcaaaagaaggcacgcaaaaatctaacataaaggttaagaattaaataagttttaaaaagcatacattaaatttgcaattttactgtaaaaaatttattcagttaatggaaccacacacacacacacacacacatcatacacaggaccctacaacatgaacgaaaaaatgaaacgtaatatgttaaaaaagccgaattgtaaaaaaaaaaactcataagttctgtcataattgaaattattttcaaaaattacttaacaatggttaaaaaaacaaaaaaatataaaatttaataaaattaatggtttttgaaaattttatgcaaattataaaaatatatattttaaaaaccaaatatttttccaaataaaaatttatctattacgacagaacttaataaaatttgatattgggcactttttatttttaattttctttgaataaaaataatccctctgaaataattgtttccatttataagtttttttttttatatttaatttttaaaatatgttctaatttttttttgtcttgataatttaaaatgaatgaattattaagcatgtggctattttacctatttacataaattgaaaatttggaaaaatcatcctagaatttatttataagttaaaattttatttttagcacactaaattctggaagttatttagtctacaattaaaataaaaaaaaggtgcatttttttcacaaaaatctaaaaaattcatttattcacatttaatttcaattaattagagattttctggtttttagtgtttaaatatctacagggtgatcttgcacctttaaattgagcatatcttttgatcaacttctcttttattatgtttaaatactcatttgaaagcttattttatttgcaataatacccagtaacagtcaattaataatcgccctgcaccaaagcggaatgacgccttcaaaaattgcaccactttttgacaccactaaaagcactgttagctgaattataaaaaaagatttcctttaaaaaaaagcgatgaaaaaatttaaatcatacagggaacatggcacaacccatggaccttcaaaacagcatgagagccaggacaattaacactcataagacgcgcaaaatgatcaaaatgcgacttgaccggaataaacgaatttcaatgcgaaaagtggcactcgaaatcgggttgaaccgtgagacaatcagactcatagcaaaaatgaatttgaagtcaagccttataagctcaaaaaaatgcatttgctaattgagctaatgaaaaaagttagggcccaaagaacccgactactcatccagctgcacactact

SEQ ID NO: 43654 - DNA, 950 bp, Heterodera glycines
ggcacgaaaaacaaacaatgggaaaagcacttacagggaaagcaaagaaataattagggaaattggcagagcaaaagcgccggaggataatccaaagtaaattctgaacaggcggacagagagaagagagctgctttcattttcgcattttatcggtccacggcatttggccgaatgttcgcaatgcttttgccgtgccaataaaaaggaaaattgctcgagagtttggtctcttgattctagaaacttttttaaatctcgagcttattcaaagtacattaaataaggggcagaaacgggcaaaataatggccaatgaaatgcaaaaatttgatgcaaatacagaaaaatgaggagggcaaagggaccatagaaaaggcggagatttccaaaatacaatacggtaagagagtatggtatgtccaatgattcgtacggtgtccctttctgatcaatcagctgaacattcctttctcctcgttcactccttccatttgctcaggtccatttgcggtatctctatgcactggacaattggccccgtgcggaaggcttcgcgcggcactgtccgaaagtcgtcgccgttgtcgcaaatcactcgggcgagcgacgaacggcgaatttcggccaattgggcgcgggtgaaaatgcccggattttcaaaataaaacctgggaaaagtggggccaattttgccggagaggggggggggggaattcgtcccagtcttagtgaatgccttttttcttcacctgtccccgtcgcgagtccgtgcaaattgaggaccaataatgcaggcactgaataattaatgggagagtaatttgaaataataattaatgtttgatggcacttacactgtcggaccgaccaaaccgcgcaccaccgggtcttcgagcattccgccgacgaacagatcaattcggtctgaaaaggtcaaacaaatgtacg

SEQ ID NO: 43655 - DNA, 556 bp, Heterodera glycines
ctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcaccgaagtgaccccgacccgtcgcgaaggggaaaaagagggaaatttctgaaaaatttgtccattttctgaacaaaattcattaaaaattctgaaatttttcccccccggcggcgcctatcggcaccgccggcccccaaaaatcctattttttcttaaaaaaattagtctaaaatctcaaaattggtcattttttagacaaaacctgctaacaaatagcattaaaattacaaaaaaattttccggc

SEQ ID NO: 43656 - DNA, 1259 bp, Heterodera glycines
  misc_feature (979)..(979): n is a, c, g, or t
  misc_feature (1030)..(1030): n is a, c, g, or t
  misc_feature (1100)..(1100): n is a, c, g, or t
cgacatttgcggatttttaaaaccgacatttgcggatgttgattaaaaacgtcgtccgcaaatgtcggttatcagcaaatgtcggtccgcaaatgtcgggtaacctttagttcctagctcggttcgaacaaattttttttaaagtttttcattttttcctggaaattcagcaactttagtttttattaatactcaaaaaagctaaaatactttgaattttcttgaaattttgaaaaaattttcttttgtttgcggcgacgttttggggtgtacccgacgccccccccccgccccttcgcacggaaagggcctcaaaatgggggaccctttgcaccgaaggggaggggggtgtaaaagttctggggggatgagtcgccggcgaatttcttaaatgatcaaattttcttaacaaattcattaaaatcccaaaataatttattttctaggaattttttctttgataatttttgtttgagattttttttttcgggggcgaggggcgattgacgcacccattttttaaataaaaaattgaattataccgactctttcctacagcatcagttgaaaatggcacaccgccagcagttgcgggcaatgcgcaacaacaaaaacttcagcaattgtgcgtggcatgccgaagaatgtgtgcctacaattttccggtttgataatataatattttagaagttaatttaaaaacagttaatttgttaaaaacaatgcagttgcttaattaaagcttggtgtttcgtacaaattggcagattctaccgtacttagatttcctaggctaagcttttctttaattgtacgaactgcttttaattcttattcctgtcataaaaattattgtaagatttatactattataccgtaccacttttacagtgttttcgtcgcggtgtttggcgaggagggcggacgtgttcagcgggcgactgttgcccatttttggagcagttttgccgcgactcgnacgacgaagtgcgcagcataattgcctcaggctttcacgaaattgttgcancacgcaaaattgcgccaatgggaacaaaaaatgccaaaactcttcgtcatttccgctctggggccatttnttgtggggccatttgggggaccttttgtccagtggaaatgcggacattgtgcaacattgactgccattttgcatcgaatttttgcaatgttatacgccggaaatcagtggcagcggaaacccaaaagggggacgggaaaaatttaaaaattcattaaaa

SEQ ID NO: 43657 - DNA, 899 bp, Heterodera glycines
  misc_feature (849)..(849): n is a, c, g, or t
  misc_feature (861)..(861): n is a, c, g, or t
caatgagctcaatttttgacagacaaaattacacgttactgtcgcagatctgttcatatttctcttcagcgaaaattaatccgtaaaaaaaattgattggaactgaggaattttttataattttcccaacttttcaaatgttcccaaaaattttcaacttcaacaatcaaatttttcttaattatcaaatttttttttcagttttacactctatgagaatgcaccattgcatcagtcgattggccgtctcaaaatgcgtcgtcggccattttcgaatttgattaattgcgatttccaactctcatcccttcatgataatgcatcgtgtcctctaaaattccgaattcattttgatggtcaaatttttgttggcgatttgttggaccgtgaaagagacggggaatggctccatttggaggcctcaattggcaattgtcctccacgacgtgccgcactgatggcgacgacggcatttcgccaaaaagtcggtgttcaaattcgtctgttggacatcaatgacaatgtgccaaaatttaacgaagaaaacaatgcgaaagctttgttgatcagcgactcaatcaaaccaggaacattgctaacaaggtggggagataggaaggcgataatttgggtttttaaaggggcaatttactgctgggacgtcagtcccagcaggacgagaggggtaccgcccttttggtgtaattagttaaaaaaaaattcataattcaaaaaattcaatttcggcacaggagttattggcaggaatgccatcgcgcaaaaacccaaaattttcggcaaaaaatatagaaagttttatgcattttaacgtgaaaaatttacttttanattgaaatttanaattagactgaagacataaatttcgcaatattttgtta

SEQ ID NO: 43658 - DNA, 935 bp, Heterodera glycines
  misc_feature (50)..(50): n is a, c, g, or t
gtttttggctgcgctgaacccgaatttgatgccgtctcctcggtaggagnccaaataattttttaggaattttattgcttctgtttcgaggtagactttaaaatcaggcttttgccaaattagctctcgagactgtagccagacggaatcagagcccttagctctcgagactgtagccagacggaagcagggcccagccgttcgtccagttgactttttacagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgttttgaggtaggctttaacatgaggcttttgccaaattagctcttgagactgtagccagacggaagcagggcccagccgttcgtccaattgactttttacagaagtttggggtggtatttttaccaatcagttttttatcctgtttcaaggtaggctttaaaatgaggctttttccaaattagctctcgagactgtagccagacggaagcagggcccagccgttcgtccagttgactttttacagaagtttggggtggtatttttaccaatcagttttttatactgttattgatcgaatccaactgagaatctactgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaagcagggcccagccgttcgtccaattgactttttacagaagtttggggtggtatttttaccaatcagttttttatcctgtt

SEQ ID NO: 43659 - DNA, 853 bp, Heterodera glycines
agaaagagggccctatttcaaggacttccttgccatccctggacggatacgagccctgttcaagggttatcgaggtctccagcaagaatatgcatcagatttttcatttgacgacataaaatctatgatttttcatcaagtacttttttccggcgacgggtttcgttcaattatttatctcaaaaatgagctggacttctttattgcgcgaaaatcataaatgtatttgtatgaaaaatgataatttttattaaatcattaattaatatgtgtttttaaagcctccgatgtcggcgcaagatatggttgtgccaaaaaataactaatttaaaatcccaatattatttgtttttatttttttatattcttattttcctttataaattttaatgtttttccattccattttttgcatattcattataatgattcattctttcggccgttctcatctcttaacagcttctaaatgtaaatcagctgattattacaaataactaataatattttacttgcaaaaataaataaattattacaatcaaatacttaaaaatatttaatcaaaagaaaaaaatttgtaaaattcgtacaaaatgcactttttatttgccaattttgtcctaattaccgtgctaataaacatcgccaaaggccaatccatctcaaccgaaccgtaattttacaaaaaaaaaataaaataaaataaaggaaactcaattaacgaataaacgaaatcatagaaaagaggcaaaaaatgattggactgcgatgtgcaaagcaaatataactgatgaagaatttgagaggtaaaaataaaaatttttttaaaaatgtttaaaaaattaatttaaat

SEQ ID NO: 43660 - DNA, 1129 bp, Heterodera glycines
  misc_feature (67)..(67): n is a, c, g, or t
aaaagccaatggggccgcgcctcggacaaaatgttgggcatcagagagaggagaagcagcgggaganggaggaggagaagcattggcgaaagcattggaaagaaaaaatggaattggagatttttgaaaatgcaatttaattgctccaaattcggcccctttaaatatttttgtacgtcggccttttaaatcatttttgattatcaaagatcactttttggaccacaatttgagtgatggatgacttcaaaacgcgcagaaccaaagcaatttgcagtaataattttgaaaatttaatctgaagtaattaaaactaatccaaatttggaaatatgttaacgaaaataaagtaagaaaagaaaacctttctacttaatattattttggtttaaagaacagttacacgaaatcttttaattgacagctaattaacgatcgcaagaataagagtgatttataccgtcgtaatattgtaaaattaattaatgccacgcaaatagtctgacatggacagttccggtgctcatttgtcagactgttttttacacgtcactcacaaacatcgcatcatttctggttgtttaaaaagaatgaaagaagataacaaaattgcatttgtaagaatattaccctatttagcagaatgagattggtgttataaatattttttttattctctcaactctttttcctccattaaattcgacttttggcaaattaaaaaagggatttttgacggcagaaaaaataaaacaaaaaaatgttgaaaagaaccaaagcttgccaaataaaaacgtacaaaattttggcgaagtctcaaaaaatgctgaagaaactccaactgctcaaattgaaagaaatgctaaagaaaagggcaaaaataagcaagattttgacaaaaatttaaaaaaagacgaccaaattttccaaaaccaaccacatttaagtgcggaaaacattggcgaaagctccaaaaatgaagtaaaaactcaaaattcattggctaaaaatgccaaaaaaaacgaagacattgtcgaagattttggtgaaattttagcagaaaacaatggaaattctttgaaagaaatcaaaattcgtgttctcaatcgaattgacaatctcccaaggc

SEQ ID NO: 43661 - DNA, 952 bp, Heterodera glycines
agtatagtagtccaagcctattattattttttttgactagtctttgaatggggttatccgagtttttagtatcctttttgaaaaacaaaaattttaataactgatacggtagcccaacatccattgccccaatgtagccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcacgacatccattgccccaatgtacccttcggtttgtcaatataagactaacaattgatgagtttgtttggtttcttttttaag

SEQ ID NO: 43662 - DNA, 1070 bp, Heterodera glycines
  misc_feature (1019)..(1019): n is a, c, g, or t
atttgcacccacagtgccaaaatgacgtcagaaactcggagtgcttatccatttcattaatttttgtgactttgggggtttcaaaaagtcggcaattaattcctgagatctttccctgggttacacgaacatttgcaaccatagttccaaaatgacgtcagaaactcggagtgcttatccatttcattaatttttgtgactttggtggtttcaaaaagtcggcaattaattcctgagatctttccctgggttacacgaacatttgcaaccacagtgccaaaatgacgtcagaaactcggagtgcttatccatttcattaatttttgtgactttggtggtttcaaaaagtcggcaattaattccctgggttacacgaacatttgcaaccactgtgccaaaatgacgtcagaaactcggagtgcttatccatttcattaatttttgtgactttggtggtttcaaaaagtcggcaattaattcctgagatttttccctgggttacacgaacatttgcaaccacagtgccaaaatgacgtcagaaactcggagtgcttatccatttcagtaatttttgtgactttttggtggtttcaaaaagtcggcaattaattcctgagatctttccctgggttacacgaacatttgcaaccacagtgccaaaatgacgtcagaaactcggagtgcttatccatttcagtaatttttgtgactttggtggtttcaaaaagtcggcaattaattcctgagatctttccctgggttacacgaacatttgcaaccacagtgccaaaatgacgtcagaaactcggagtgcttatccatttcattaatttttgtgactttggtggtttcaaaaagtcggcaattaattcctgcgatctttccctgggttacacgaacatttgcaaccacagttccaaaatgacgtcagaaactcggagtgcttatccatttcattaatttttgtgactttggtggtttcaaaaagtacgcaattaattcctgagatctttccctgngttacacgaacatttgcaaccacagtgccaaaatgacgtcagaaactcgga

SEQ ID NO: 43663 - DNA, 138 bp, Heterodera glycines
aaaaaatatttataaaaaattaatcggaatttgaaaaaaagtcagaaaaaaatgatttttctaccaagttgagacgccaaaaaaatagtagagccattaaaacattgttctgtcagacctaatctcaaggtcgagact

SEQ ID NO: 43664 - DNA, 1340 bp, Heterodera glycines
  misc_feature (30)..(30): n is a, c, g, or t
cattgaattgggcggatgccaacaaatccngataattgcattcgaaatttgcgtcaattttccccaattcgacgtgttctctttttgtcccacacggggcgacacatttaaaagattttttgacatcaataaaaaggcaatttttattagctttaggtaaaacgttcttttcgtattagcaatgcccaagtcataattcgaaattgaatatttcttttttggtttggtgctttgatttttgaattttcagctcaatttgtttgaaaattatctattttttagcaactcgcattaacaactttaaatggaaatcctcttaattttcaatccaaaatcccaaaaaatgatgttatctgagtttcatgaccgtttgtactaaatccataaaaaggattgtcattttaaaaaacactgttccggttttaaatgcctttttgcataattggataacaacaatctttcagcatttaacaattttcccctctctgtagttttattttttaaagttttctccatttggacaacttttttttttttttttgcttttaacggtttgcgtttagacaattttatcgtggccttatgtttgaattttcaatgccatttttaaatattttttggtcaaactaattcccccccccccccaatttttcctcgctgtttgacactctttccccccccccccgcccaccggcggcccataaatcggtgccattgccctcaatatattatgtgccattttattgtgtcgcgccttcgtcgtccttcggcacacccatttggcccctcagggcacaccaaattgggtcgttgttcgtgaacaaattccacatgaaaagcccggtatgcacaaatttacgaaaattttttggcattttccgctaaaaagtaagtgaacataacccaaaaattaaatattattttaaaaatacgtttaggaatctctgattttaaattggaaacaaaaaattgcatttttaaaactgttttataattttagccacattaaagccatccatattttattaattccttttaaaacatggaaataattttgaaaattaaaatttatcaaaataattcaataaaagtataaaaaaatatttattttttattttgttttttaaaatatttaaagtaaaatatgaatattcagtcattctcaaaaataatttcataaattatttaaaagttcgaagagtgcacaaaatttgaatttaattttcaacattttttaatttattcaactatattaaacgtcaatgattgggaaaaaaggggggggggggtggggacagctgagagcggatgtttgcgcaagagaattattataagaaaga

SEQ ID NO: 43665 - DNA, 799 bp, Heterodera glycines
  misc_feature (790)..(790): n is a, c, g, or t
tgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcggctcggctgtggggttttggtgtgcaggcgcgaacttgtggttctaattcgcgttttacggaccgtaactcgggcgcaccaatgcttcgcatgctgtggcggagtgcctggattactggcattcctgctttgatttttcgacctgaactcagacgtgaacacccgctgaacttaagcatatcagtaagcggaggaaaagaaactaacgaggattcccgtactaacggcgagtgaactgggaagagtccagcgctgaatcgcagctcctctagggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccaagagtccgatagcgaacaagtaccgtgaggtaaagttgcaaagcactttgaagagagagttaaagaggacgtgaaaccgatgaggtggaaacggacagagctggcgtatctggtctgcattcacccgtttgttgctgtacgttgngctgctagc

SEQ ID NO: 43666 - DNA, 1203 bp, Heterodera glycines
aaaaaatcgattttttttttttcggggcagtccccccgaaccgatgcgcccaaattttgggggagccgaatcctttcggaaaaattttccttaacctttacttaattttggttgggattttctccccaatattgttgagtccccaaacggaccctgaaaaaattgatttttttgtttcgggggcagtcccccgaaccgatgcgcccagatttatggggagccggaatcttcgggaatagttccctatagcctgtactttatttttgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattttgcgttggatttttgctccccataaatgtttgagtaccccaaacggacacttgaaaaaatcgatttttttgttttcggggcagtccccccgaaccgatgcgcccagatttatggggaggccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggattttagcactctgatgctttagtatcccaaacggacacttaaaaaatcgattttttgttttcggggcattccccccgaaccgatgcgcccagatttatgggggagaccgaa

SEQ ID NO: 43667 - DNA, 690 bp, Heterodera glycines
gggggggggaaggcacaccacgaggccgcgaagcggccgagtgaataccttcggtgcaggaaaattattaaggaagagagttcattatttatttgttttttgcataattaatttataaatatttttttcagaaagggttctgaaacgcaccaaattttatttacatgttagttttaggcactcttatgctttttctatcaaaaagggagaggaataaaatttttaaaaattttttaattcctttttaaacaggccaaaaagtttaggcttaactttttagtgaaaattcaatcactcatttttcgagtagtgatcagaagcgaaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttaggggtgcataattaattcataaatatttttttcagaaaataaagggaaacgcaccaaattttatttacatgctagtttaggca

SEQ ID NO: 43668 - DNA, 1220 bp, Heterodera glycines
  misc_feature (9)..(9): n is a, c, g, or t
  misc_feature (1206)..(1206): n is a, c, g, or t
tcaaaaaanagtcttgacatcaaaaattaaaatggaaatacattggcaatttcttaattttattttgaaaaatataaaaattaagacattctttttcttccaccaaaattcatgtccttgaaaacaatgatttccacatgtccttgaaagtcccaaattaacaataatccctttagcaattagaacaaattaattttttcttttttttccaaaaaataatgattaagctatgccctgtcggaatgcagccggagccttcagcgattggctacgtgccgtgcgatttacttgcgcccggccaatgcagcgaagggtaagcacggggaatgattccagattttccggaagtccaaaaaattagaatttttcacaaattcccacaacttttgactcaaatttgccaaaaaaaatagtctctgatcactttttaaacatttccgatcactgtaaaatgccaaccgccacaggtatcagtgcgtgcattcgcgtgacgatccggagatgaacatttgttgcagtcggttgcgcaaccaaccgccatctgctgcggcagcgcccatctgccccaatcaggcaaaattttcagtccctttctccatcgcgttcagttggcccatttctgacgggacagatttttttttttttttcaataaaccgaagttggcaattttttcagcaaattttattgcgagacgggtcaagcccgcgctactgctccccacggcagggcatcagcgcgtgtccaaatgggtaccaatgcgatgagtcaattggccaaccgaatgtgtaaattcaaaaaaacaaaattggcattttaatacagtatgtgccaaatttgaaaaataaaacgtctccaggttcgtatgctgttccatcccttcgttggccatgtgcccgcaaggcttcgtctcctcgttggacctgcgcacacaaagcccggtcagctgataagaccagtgtagttatcgctactatatcaggaaaataccgtataaagcagaagtgtatgatattgcctaaaaactgattttgtatcatcatactgtattgatggtgatcgatagcttaatggaatgccctattgtattacttactacatccagtgattcccagggtgtgtattttgaaatttttggtaaaaattttcaaaaaaattttaagtttaggtatttttgagaattccaatcttatggggctcaaaaggtntcgccttaatatat

SEQ ID NO: 43669 - DNA, 895 bp, Heterodera glycines
  misc_feature (15)..(16): n is a, c, g, or t
aggtcctggaacatnnttgggcaaatgggtgaataaaaaaaggacgagagaaaaagagacagagatagagagggggattagagagagagagagagagaaagaggggggagagagagagagaaagaggggtgagagagagagaggatgagaatgcattaaatgcattcattagggccgggattttcgaaaaagtcagggtgggattcgggcttggcattaggtcgggataggtttaccgggatttacatcccagttttgccgggaattaaattccgaccccgggaatcaaatcccaattttgttgggatcccgatcctaccgggaccgggatctcgggaaaatgccggcgggatcccgaccccgtcagggccctagtttttatctcctatcacttcagttgcttctcctttcgttggaacttcgcccggcgttccgccgccccacccgcccccatacaatcagtcggtcacgccaccgatgctgcaaaagccgtcgacagacaaatgcggagtgacagtgccaatggcaaacaacgcaaataacagcccaaacgtagccaatgccaatcagcagaacatcttgcgtagttgtgcactaccaacaatgacgacaacaccactcggcaacaatatcacaggacagaacactgttagtggattggatatggccggattggacactcaaagcaaaaaaaagggcattttggatgggatatggcacggattggacacccaaagcaaaaaaaagggcattttggatgggatatggccggattggacactcaaagcaaaaaaaagggcattttggatgggatatggcacggattggacacccaaagcaaaaaaaagggcattttggatgggatatggccggattggacacccaaagcaaaaaa

SEQ ID NO: 43670 - DNA, 166 bp, Heterodera glycines
ggcgaatcaagtacttagcaatccgaattattaaacttgagaaagagataacgggttatatggtggtttatccccgctggcgcggggaactcgacagaacggcctcagtagtctcgtcaggctccggtttatccccgctggcgcggggaacacctgttttcgcaaa

SEQ ID NO: 43671 - DNA, 962 bp, Heterodera glycines
aaaaaaaattttcgatgataggtatcccaaaatttcacatctgttcaatcttttgcacaatatcatgtcagattttattacatctttgttggttggaaaatgaattttcgaattttgtttgaatttgtagccagacaaatgagggcagaacactgacaatgagtcacagtgaaaatagacacttaagtaccgaagaaaaaatggaagaaaataataatttaaagcaaaaaattacgcaaaaaggagcattgaagatggagaaaattggggcgagaagcagggtaaaaataagcgcctgaaaatcgaaaaaaatttgattgtaacagaaaagcacatatgtatggaaatttaaaaacagcaccgttccgatttttcaaagaatgaaatcgaatacacactatcctttctgttgtacttggataagaatgcatctgatctcgaattttgctgttcttcctcacaaccattctttgtttcacttctttttacgcttctgacgcgatgcaatgtccttaaatgtacgtgaaattactgttgaattgtaaattcctaattctctcatttttagccgctttccattgagctcgaagtatccgaagacaaactcacaacaaacaatgaacagttgcattcgttctctcaaggcgaaattgtcattttccatgcccaattttcggatggaaatttctccctttttcttctgctcacttcgaatgcgaatttacttgtccagtacaaattctgcgcttcttctcaattcgcttcggtttcgcttaaaaagtttttccctgaaaaggttttaatgtgatttttttccttagtttcccacgttttttaggatttttcgcatttggcaaccgtagcaatcactgcagacagttctctgattgtttgcttatcaaacgatggaccgacaatatttatggttccagtaagcatttaaaacataaatttttcaacaa

SEQ ID NO: 43672 - DNA, 750 bp, Heterodera glycines
gaaacttaatgaaattttctgaaatttaaggtaaatagagaattcttagggctatcgaatctataaattaatttagagcaattgcattttaaacacctaaaattttaaatgtttataattttatatgcattaccattacaaaaacatagcatattcaatgctttataactttttttatatttaaggaaaaaattatagaaaattatactctgaaagagaacaattaaagctattaaatgatacacgaaatatttatttggtttaaattgagtgtatttataaatattacccattttttgtattcaaacccattggcggattaggaagcgcgcatgggtggcgctttttaggaaatgcccagcaccgaatccaaggacggatggcagccctgccttaataaaatgcatttattccagggcgcgtatcgaaaatttttcaaaatcagaacatcaagcccaaaaaatcagattctggggtcgaaaatcaggacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaatcaaaaaatcagatttttatgaattttttgcggcgcatttttccaaaaaacttttaggaaatgggcgaggggggagggtccggcggtgccgataggcgccgccggaaaattttttg

SEQ ID NO: 43673 - DNA, 1001 bp, Heterodera glycines
caattggatgtgcaaaccggtgatgacacaaatatccacatgggtccatacacccaccattgggtagttacaattcgatgtgcaaaccgggggaggcgcataaatatccaatatatccagagcccccaaaatgtatcattgtcgtcagggctcgtccgttgtgagaagcacacgtctacaggttgtagatgaccggcagattcttgcggcgcaccattccatcctcgccgaaccactccagcttgaacacggtgtcagacgggccgggcgtgttgcaccattccacgatcacgcggtcgttcttgatgtcctcgttattcgggtcgaaggttgccacggtgatgatcacgttcacggtgtcgccgacgcccacggtgccgcacggcgggttcaggaagatgcgcttcggcttcgtcgtcttgaaggcgaacccaatgcgctttgagcccgtgttgatcagctgaaattgcacaatgattgatcaattagcagagaaagcctcccaaaccgacaaacgtacgcggaagttgtagatggtccggatgttgaatggcgcgttgaggtgcagctcacgtgctggaattgttgcgatgtcttctggatgttgccccattgttgtcgctgttgttgcggttgttgggcacgtcgatgtgttgctgatgaaagaagaaaggaataggcagaagtgtgtgaaaacgcctccttatatacatcatttgagttccgtttgttagtgctaaaaatgttttttgtgcataataataaatacagaacgccaaaagaacaaatacaaacataaaaaattgacatttttttttaccattttttatgaatttttttagcttttaactttgtcaataatagaacaaacaaaaccatttatgctcattttgaatggaaaatttcaggtattttcatgtctgaccatttttgggacgaaaatgtcttcgatctgatcgttgaactagagaaggaaggccgccatgtacggcttgattggc

SEQ ID NO: 43674 - DNA, 1187 bp, Heterodera glycines
ttcgttttttttcggttttttaaccgaaaccgaccaaccgaccctcttgtccggtctctaatttctacgatgcttttgcttttttagtctaatttttcaaaaattttaattgaaaaactaataaatagaggttctccggtggtaccaaatatgagcagacgttgaaatttttaaaaatatttattaataaattttgattaaatgatggcaatatttgaagatttttttttaaattgcaaaaaaaatatacaaaaagcctcaaatatattttgaatagagtccggtaaaaaaatttccgggagcgggagcgggatcgggagttcaaaattttccgggacgggagtcccgaacgggattcccgtaaaaatcccgctcccgttaaaatgccgtccatttttaacgggagtcccgggcgggagcgggagtaattcgaaaatttaattaaaaactcacaaaaatatttttaatgcacaaatttaaaggacaatcaatttattaaattaaaaatatatagaaaaatttataaaggagaaatttgaaattaaaaaatcttatttttgagtcaaaaatcagaaaattttttcaaattgcttaaataaattattttttataattaattcgaacaaaacatttattaactttatatttttgactccctttattaattttacaaaattttttgcggtgtatttcttgaaaaaactttttggtgaccaaggaggaggagggaggccggcggtgccggtaggcgccgccgtgaaaaaattgcaaattttaatacaatacattgttagattctgttcaaaaatgaccaatttttgcaaattgagcaagttttttaagaaaattaaggattttaaggatccggcggtgccgataggcgccgccgggaaatttttttgaaattttggctatatatttaacagattttcaatgaaaaatcattatttttaccaaaaaaaatcaattcttaccagtgcatttttactcccgtttttgggtaaaaatttccgggagcgggagcgggatcgggagttcaaaattttccgggacgggagtcccgaacgggaatcccgtaaaaatcccgctcccgttaaaaatcccgttcaccgaaaaaagcgggagccgggagcgggactcccgtaaaatcccgcgggagtcccgatcccgccggactctagtaatta

SEQ ID NO: 43675 - DNA, 968 bp, Heterodera glycines
ccccccccccccccccgccttcagattttgaaaaaaaaataaaaataaataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcgaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaaatctgacttccttaataattttcctgcaccgaaggggctcactcggccgcttcgcgggatacgtatcggaacactacaaaccttcccccc

SEQ ID NO: 43676 - DNA, 1234 bp, Heterodera glycines
ctgaagagtcgccttcttacagaagcgcaaaaactcaattgtgtactgtttcccgctcagacagcaggtgaaagtccaaatacttgtaggacggatgggttttccacgaatctccgccataatgttactctcaccacccaaatattcgtaacacaaactcaggaagctgtagataacgaaagctataaaagcacagtttattcattaaatccaataaacaaatcaccctcatagcaatctctgatggagttgaagtaaatgtacacatcattgctgaagaacaacaaactcagccacgagtcgaaagcgtaaattggaacgatgaaaaggattctgcacatgggatagaaaaaatgataatttacaattaaagtatttaaaacctaattatccatcgctgttcactcgggcaagaataccatcgtaaatgctggtatatttgatggctcgtaatgaataatgcagcccaagtacaaaagcctataaataggatggtaccttttttgcatcttcaaacgaaacctgcaatgctgtgagccaatgggttggtaaagaaaacattattctgtgcaatagagaaagaattattcgtcatctgagttgttgtgcctttatgtttgtgattaaactcattagaaatttagtccaaaaaattcctgaaatttggtaaaattattattaccagtagcataacactgattgtgagacagaaagtttaaccctttagggaggaaggaaataaatctaaaataacagaagctcaatgtaagaagcataatgagtgggaatgagaagaaacgtgcaaattggaaaaattaatgaaagtatagaaaaggcgaagcgctgcgtgctggtgtttgtaaaaggatatgcatgtgtatgtgtatagacatatagcagcagcagcttccttttttgtcttcctttatatgtataatggtgtggcgcccgctttctatttggacggcaaaaatgccgtagttggataggttaatacaaactcattaaagggatggaagtgatgaatggaaagtgaaaattgattatttaatgatttgatcatatgtattacagtaccaaaagaaatgtaaaattggtagattggatcgaaatcataaactctaccataacttggttatacggacaaagaagctttaaaattggccgtttaatacaaaaaataggtttgaaaatagtattaaacaacagcagcagaatgaagaaccggaatgaa

SEQ ID NO: 43677 - DNA, 504 bp, Heterodera glycines
cgcgaagcggccgaatgttatcaacaaaattaaaaaacgggcgcgaagcgcccgtcctgaggccgcgaagcggccgaatgtcccccaaaaaattaaaaaacgggcgcgaagcgcccgtcctgaggccgcgaagcggccgaatgtctcccaaaaaaattaaaaaagggcgcgaagcgcccgtcatgaggccgcgaagcggccgaatgttctcaacaaaattaaaagacgggcgcgaagcgcccgtcctgaggccgcgaagcggccaaatgttcccaaaaaattaaaaaacgggcgcgaagcgcccgtcctgaggccgcgaagcggccgaatatcccccaaaaaattaaaaaagggcgcgaagcgcccgtcctgaggccgcgaagcgtccgaatatcccacaaaaaattataaaagggcgcgaagcgcccgacctgaagccgcgaagcggtcgaatatcccccaaaaaattaaaaaatgagcgcgaatgagcccgtcctgacgccg

SEQ ID NO: 43678 - DNA, 882 bp, Heterodera glycines
  misc_feature (811)..(811): n is a, c, g, or t
  misc_feature (823)..(823): n is a, c, g, or t
  misc_feature (828)..(828): n is a, c, g, or t
  misc_feature (837)..(837): n is a, c, g, or t
  misc_feature (844)..(844): n is a, c, g, or t
gaattatatggaaatccatatttttttcctggactctgggaggcgcctgaaacgcacgaaaaacatgtttttagcttggtttgaagcttctaggatgtatttctatatccatatttccatatttatccatatttgggcgtttttccaaaaacctctaatagaacggcccccaacagataattggcctttttgacctcaaaaacggaatttttcaaaaaaatcaatttttcacaaaatttttccagagaatattgaataaatttaaattttcttaaaaattgttaaatttgtgtcaaaaataagcaaaaaaaaatttcgctttttggtttgatttttcgctaaaaatgagtaaattttaactttctcatgttttttttcttttaaaatgatttataataccatatttaaccatttttgaaagctttactttgcgtttagccaatttgaagaaattgtacctcaaattggaaaaatttatgtccatatttttgccatttatgtccatatttcgcgatttttggtccatattttgcgattttatatcaatatttttccgagccctactgatcagtgatcacgaatagagtatccatttaatgcaatctcgaacccctaatccgaactcgaacaaaaagtcaaaaactcaaaattttcgagcttttggacctaaccagattaaaaaacatgaaaatgagcagaaaacccgcctaaaacatatttttatgatttaaattaaaaaatatttttttcaaaaaaatggtgggaggggagacaaagtgaactattaccaaaaattgtgataacttttgtncaaatcgaccanattanacattctanaccctanagtttctatatcacccatgaaaatttgttcatgtttga

SEQ ID NO: 43679 - DNA, 1090 bp, Heterodera glycines
agtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccataacctcagatttactattttcgcaaccccactttttgaattctgacattttcagctcattacgctctaaatataaacagcatcagtgttccggaaggatcggtttgaaatcggcaataacccccaaattacaatttcctactgtaaacttatacagattacatttggatataagaaattgaaatattgagaatatcacaaaagtgatcatgaaaattgtaaatttgagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaatttgagattattgggacttatcagctcggtcctccgcaaacactgattcagtttatattt

SEQ ID NO: 43680 - DNA, 1441 bp, Heterodera glycines
  misc_feature (970)..(971): n is a, c, g, or t
  misc_feature (1014)..(1014): n is a, c, g, or t
  misc_feature (1045)..(1045): n is a, c, g, or t
  misc_feature (1053)..(1053): n is a, c, g, or t
  misc_feature (1056)..(1056): n is a, c, g, or t
  misc_feature (1071)..(1071): n is a, c, g, or t
  misc_feature (1079)..(1079): n is a, c, g, or t
  misc_feature (1081)..(1081): n is a, c, g, or t
  misc_feature (1236)..(1236): n is a, c, g, or t
  misc_feature (1276)..(1276): n is a, c, g, or t
  misc_feature (1313)..(1313): n is a, c, g, or t
  misc_feature (1324)..(1324): n is a, c, g, or t
  misc_feature (1326)..(1326): n is a, c, g, or t
  misc_feature (1336)..(1336): n is a, c, g, or t
  misc_feature (1338)..(1338): n is a, c, g, or t
  misc_feature (1347)..(1347): n is a, c, g, or t
aactttcctctgtatgattactatgttcaaatcgaccttaaaattttcataaaataaacgcctaagaaatgaaaaatttcatatttttaactttaatcaatattttgtgagctaaaagttctatctaattttatatcaaccatatttatgaaacgccttggcggttataaattttttgggtccaagattcgaatcatttacattgtaatgcattttacaactttcatttttgcttttttttattaaaatcttttttataagtaagctttatttttatttttaattcaaaaaataaaaattcttagataaagatgcaataatttcaatcaatttgatggcttcaagatttgaaattaaaatttcgttcagatgttttttttggtcggaagtgggaatgtttttattttaatttatttctttaaatccgatggcgctaatcgatccataatgttctacaccaaatcttctccagttccatcacatcacatctataatttcaaaattaactaaaatattccttgtaacaattaaacaaataattttattgcaatttatgatttatataagttttttttttatattgtgatagtcataatattgttttgcttaaaacgataaattattcataaatttcaaatataaattctcctattaacaatatttttaaaaaattcataaaaataataattaatgttttttataaaatcaaatccaattatttcagcttggcaagtaaaaaaacattaaaaatttaagttattaaacttaataatatagagaatgaccgtggaaagaaaaatatatagtctaaacttaaaaaaatgaaaaattcatcgcaaaatttgagaatagcttttacgaacctgagcacaagaaatttgcgtaaatcgacaaaatattcataaatttagaagtaatgtactaactcgatatttttattagtctgtgttgttggccttcggtttccttnnggtttcgctctttgtgtttgtgttttttttgtgggcttgggtngggttgtttccgcttttgttttttggcctcncccttttngcncttctgtctgctgtnggcgcccngntttgtgctttgcgtttttggtgtggctttgtttgtgtgtgtttttcggttttgtggttttctttcttctcctctttgttgttgtgcgggttcttgtttgctctgttctttcttctttctttgcttgctctcctgcgctttgttgtgctgcccctncgttgtcctttgttttttcctttcgtccgggtgtcggttnttccgtcccggtgtttctcccgtgttgttgtttgccncttgcttggtncncctttcgctngngcttcgttngctttccggttaaactctccgcggtgcttttctgttttctgttggtgccaatgaagaattgcttttttggaaaaaaattaacaaattcttaaaa

SEQ ID NO: 43681 - DNA, 810 bp, Heterodera glycines
gcaacgcggcggcagaagcgacgcgcactgtacgcgcgtgggcattaaatgatgcatgtttaatatttctatttgtatttaagccgtttcccgattggacttcgcccatcacttttgcccatcacaaagcgaatgcttccatagcttctcatccgtcgtcgtcgccaatggccactataatcctattcagctgcgttcgttgctccacattccgttccgtcaatgtgatggtgcggtttcggagatcgggcgttatttttaacgggtgtcacttcgtccccccccccccgagaaattaattttgattaaactacaaaatctaaacttttaaagaaatttcgtaggaagggggggggtgtaaaactgtcaaaatccccattgcgaaactaaaaaaaatttcgcaaatctttcaattcccaaaaaaaacttggtttcatcatcgaacggcacattttatatgtacattttacaccattaattatttttccattgtggcacctttttatgcattgtttgacctcattaggattttcttcttattgacagactaatacaaaaacgaaaagaatcccttcccataggcactggctgaacacattgccaaagtgcacttgcagcaaaagccattccctggcggcgttcgcgtgcgtctgttgccgaacagcaaaaacaatggacgaccactgattcagtcggccaacatcagcagcaccaatggagaacaacagaagaatctgatcgccgtcgtcgagcagcacttggagcagtacaccaaggacctcgttaaggaagtaagtgactggggcatgg

SEQ ID NO: 43682 - DNA, 1709 bp, Heterodera glycines
  misc_feature (46)..(46): n is a, c, g, or t
  misc_feature (1525)..(1525): n is a, c, g, or t
  misc_feature (1634)..(1634): n is a, c, g, or t
tttcgcaattaggggcccaaaaattaatgcaatggagagagatttnatgcacaagaagcaaataaaattcattgaaaaaggaaaaacaatgaattgacagagtgaaaaatgacagtaaaagcgaaccattggaagaaaaggtgctgacaatgagtcgtcgtcactcaaaaacttttcaaatagaaatttttgactaaaaattattttaaattttgcttaagcataacgaaattttaattcttcatattttccgttagctctaaatgtattctattatcctccaaaattaaaaaaattcattgattttcaaatatgctccgttccaaaattataaagtcaagaattttcttgccacttcatctatttcccgtggacgaattgagctgaaattttttaccattaagagccacacaaaaaaaatctgaaagcataaaagaaaaattgttgatacgatttttttccgaaaatgtccccaaattaggcgttccaatattataaactcaaaactttgaagacatatatataactttttctatagggtaagaaaaaatctgaaaaaattcatgtacgcataacttttcatgctgatcaaaaaagtcaacagcaccaaagtgatcagagcactccttcagggtgatctgaaaaccgcaaaatggcttgaaaccgcgaaattttcagaaaaaaattcctagggtgctggaaaaaaatttacatcaaatacgaatatggcggacagaaagagaacataattggctacaaaatgcaaaaaactgcatgtcgctacgacttctgtacgctgagattccggaggattaatttcgaagtgatcaaaatcactgtaaaatgcactgttttcttaagaattacggtactacatattttcaaagttttgagtttataatcttggaacgcctaatttggggacattttcggaaaaaaatcgtatcaacaatttttcttttgcactttcagattttttttatgtggctcttaatggtaaaaaatttcagctcaattcgtctacgggaaatagatgaagtggcaaaaaattcttgagtttataattttggaacggtgcataagttatggccagaaaaacgcaaaaaaaagaagagattttcgaatattattagtccaaacttttttgaaacttgacaaaattttttaattttgcacggtaatagaaaacacctagagttattgaaaataggttaaaaattaaaatttgattgtttttgagaaaaagtcataggtaaagtagataaaatttgttttttgttttttttctggtttttgagtaacccctaagaaaagacagaagatagccaaaaacgggggacacctgttaaacagttggaggtgttttatctaaagcactagaatgatcatttagcaacagattgtgccatcatcatttttaggttgctttgtttccggttttttccaatttcgggcggctgctgctggcggatttgggttcctcagaaatttttttccatccaaaaatgtttctaccataaatganatctgcctttgcaatgccacattcgtccattgtttggtcatctttgaaaatgtatcctctgatttgtacaattccatttttgttccttcttctttctacgtaacatccncgttctccttcgatcattgccgtgatctttcctttcacaatttcaacgtgtctttgcccttcaccctcactttgc

SEQ ID NO: 43683 - DNA, 2465 bp, Heterodera glycines
tcctatgtatgaagggcaccaaattttttggttaactgctgacaatgtacgaatgtagcttaaaattcttagaaatttttgcctcaaggaaacatattctgaatttctactttctgcatttattatcattttttagagaacgggattttgaaagtaccaggtccggaaaactgcgtagtcttcttaaaaaaagacagaaaatttcttatcctttttatacgatttacaagcaaaatatattaatttaatgcgattctcccttttacactttaattaatgaccatttatcatggctcggaacccgcttgacagatgagaactattttgatttttcttcaaagtattattctatctagcacaaaaaaccgaaatttacaatagcaaatcgactatgaaaatcatttattgatgcatgctatcatctacatacttaatcaattactaggctaattattcaaaaaataacaatagaactacacataaataatatatgggggataaataaaaaaaagtgatgctaaattaactacatataaattatacaatacaaaaaataactaactgatgtatgagaaacataattatgtggtgctaaaatgaataaaagttttaatgactaaagtaactgcatctacgggggtatctgtatgtgtcaacaatgaatgatcattggcacacttttaaatcaatgaattgtgccctcctcctctgctcaattgtgtgggaagcgtggacggcatttgttgttggccacttgtggcagcagctaccgtagttggctgacagcttcttgcacaacgtgagtcggctacgatagtcccgttgccggcaactgtactgggcgcagctgttgtggccaatggtgccgagattggtggcgacaacatgccactgagcgctgccgcactgagcgccgctttcgcccaccgcacctaaaaaggatgtataaaatgataggataaatgaaaagctttgagatatcatcaaaaaattggatttttgaaagtacgcagccacagcacaacacaccgctgggcagctaaatggggcaataattttattatgggttttataggtattttttttggggggacccccactcatgataaggttatttttgtttattttttttttttttttccccccccccccccccccccccccccccgcggggggggagaaagaaaaatttctttttttttttttttttttttttttaaaaaaaaaaaacacagcaaggaaatatgaagagggggggggggggggggggagggggggggggggggggggggggggggggggttgttgttttataaataaaaaaaaaaaaaaaaaaaaaaaaaaaaaaaaaaaaaaaaaaaaaaaaattttttttttttttttttttttttttttttttttttttttgcgctcccctctccttctaaaaaaaaaaaaaaaaaaaaaaaaaaagaaggtgtgtgtgttttttttttaaaaaaaaaaaaatatattttttttttttttataaaaaaaaaaaataaaaataatttttattttttttttttttaaagaaaaaaaaaaaaaaaaatattttttttggggggggggggggggggatttatttttttttttggggacaaaaaaaaaaattttttttttcttcccccccccggggggggggggggttttttttttttttccccccccccctttttttttttcccaaaaattttttttttaaaaaaaaaaaaaaaaaaaaaaaagccccccctcccccccccccccacaaaaaaaaaaaatttttttttcccaattttttggaaaaaaaaagggggggtttttcccccattttggggggtttttttcattttttttccccctttttgggccctttttttcccatatttttgaaaaaaatttggggggttttttcccccaaaaaaagcggggccccctaaaaagccccccccccaaaaaattcccctttccgggaaaaaatttcagggaaaaactttttcggataatttcaaagattttttgattttgcatttaaccgttaggaaaaattttataaacttcccagctttagttcgtggatatccaggatgtggggtaatatgtagttctgcagtttgtagattttcatagtcatgaaaacatttctggggcgttttcagggtcgatgagtatgaatatgacattacattttcgacccatttcaaaacccctgatcaccatggcctaagaaacagggtatggtcattgagtggatgcctaaagtgcaatagagccatttcttgtgaatcgactttgggtttaaatgctttttaaagagaattcgaatgttcgactttcctgcgtttcgctttccattttcacccgctccattctttgtgtgtttccgttactttccttctgtccatttgcattgtattattttctaatgtcctctgaccttttatttttcattcgtttttgcttta

SEQ ID NO: 43684 - DNA, 853 bp, Heterodera glycines
  misc_feature (564)..(566): n is a, c, g, or t
agttttaggatcggatcatgcattttgtcagggatcacagtatgccttaggggtttgatctggaatgagtgtaacgtctaagtacaattggtttcgtattctgtaaatcgattttaggtttggtctccgggctctgaccaattgtcttttattttcaaatcaatttgtgacaaaattggatcctcaattgtctctttctcaattgagtcccgacttatttccttttggttttcttctgaaacagagcatatagggtatttcttcttttattaccgattctatttgttcgcactttattggcgcacgcgaccgagcgtctttcactcggttgacctttccctccaagtaaatctccttggcttctagctcttgtaaatccattacccggcggtttaatttggggttgggagtcgacactgaatgcaaaaaattcagagggagatggtcagttacaatgattatgtgggagccatatattattgtctgaaaatttttcagcacatacacaattacggccaattagccgagggttgccgggagaattgcgtctgttgcggttagtgnnnccccaatcccgccccctggatacgtgcctggtgccaggcaaagtgggacatcgttggaatggggaaaagttatgactgattaaattaaagtgttttggatgacattattgcgcggactcaattgcaccgatgcgcccgttttttgaggcccacaaaggcaaaaaacccatattttgttcatttgaaataaattccaatttccaaataaaaccctggggttttttaaagtgtcgtaaaaatgccattaaaaatgtaaaagtaaaaatggatgccgtaccttcgtcatc

SEQ ID NO: 43685 - DNA, 430 bp, Heterodera glycines
  misc_feature (25)..(25): n is a, c, g, or t
aatggggggtcaagtgcgatgaacncaaccggcgatcattttgcaacaacagcaaatgacagcccaaattcaacagcagcagtggcaccagcaaatgcaacggcagcagcaacagggacagcagccgatgatggggtaagggggaggggggacaatgaaaaaacattgttggaaattggggttcctataggtaggcgacaggcacgaaaaatggcaattctcaaaaaaatttaaccatttttttataaaatattaaaatttcagaaaattttcccagtggcgtctatcggcaccgccgtgcccccatttcaccttatttttttaaattttgaccccaatcctttttggcggaaaatggctacaattcctgttttttactctcctgcgctgaaatactcaaatcatacatttttagggggggggggggggg

SEQ ID NO: 43686 - DNA, 1031 bp, Heterodera glycines
  misc_feature (58)..(58): n is a, c, g, or t
  misc_feature (1000)..(1000): n is a, c, g, or t
ttttactacaccattttttctagcttagatcacatgcgatttcggcactctgatattntagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgttcataatgggatgtataaaggcgattgtagaaggaattggatgcgctaaaattgtttgagaagctttttgagcgtaattacgatttttacttacaccatttttttctaggcgtagatcacatgcgattttcggcactctgataattttagcgttcataatgggatgtatanaggcgactgtagaaggaattgaagcgctaaa

SEQ ID NO: 43687 - DNA, 1315 bp, Heterodera glycines
  misc_feature (1231)..(1231): n is a, c, g, or t
  misc_feature (1253)..(1253): n is a, c, g, or t
  misc_feature (1302)..(1302): n is a, c, g, or t
ctgaaaacagtttaacgttaacatttaccctaattaatgcccatgtttattttttgccttgtaatcacataaatcaatgtccgccagcaagtggtcatgctcgttgttgctaatgaggccaattaaatgcctttcagttgaaacattttcaaactgttgagcattcatttcataaataccaatatatataagctaaaaatattaattagtgaaataattggccctaggcaataaataaaggcacattaaaattttataaattaaaaataattaacataaattggaaagtgcttaaatgcttataagtggccaagaataagaaaatgaaaaaacagtgaccgtaatccttggtctcaaaaaattgtttcgcctacagtaactatgacaaaaaaatctcatcactttcggttaataatttgataaaaatcaaattttaaaacaaaatttgtacctcacgctactaaaaataatattttaaatattttcatattttcaatttatgtatttttataaaatttatatcgaaactaagtgaatcggccggacaaattgaatttgtgtcggcattgttctgtgccaatgttggatgggtctaaaaatgtgccgagaactgaatgaatgggaatggcccggagccgccaaatccgcccaaaataaaaatgaatggtgggataaaacaaatgaaaattggattaaacccatccgtttgtttgaatcacttcttgtcgaggagaaatggagccaaatttggattgcttactactgtttgctgatgaatgaatatgaaaagcaatagaaaacttttttttttaatttttgaggatttttaaataacaaattttaattttcgatacaaacggaaattttttggaggcgctaaaataaaacaaatattacaaataagggcaatgaaaaaaatttaagaattttcgaatatttttaaaataataaatcttaaactttgggtaaactaaattttttggattcctaaaataagtacaaatcatacaaataaggacaacgtagcaacaacaaagaaacccaaattccttgcttaaaattgcttcgtgttaagtgccatatttggcgcaacaattgccaatggcattttcaatgcatgtgccattgtcataaatccaaataagatcaatggactttgttgctgaaaatgcaaataaggaagtgcatagcactcggaagcctttaattgaactgcatgcatgcataatanaaagaatgggaggttatatcanaaaaaaaaaaacccgagtgtatgacgcattttctaattattataattgnggcatctaattat

SEQ ID NO: 43688 - DNA, 877 bp, Heterodera glycines
aaagcgcttgcgtatgagacggagggctgtgcacacctcaattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggatatctctttttttgagaattttatac

SEQ ID NO: 43689 - DNA, 1152 bp, Heterodera glycines
ctgaaagcggagagcgagcggggcagacgaataacagagatgtacataaatataagcattaaaacgcttagttaacccccccccccccatctataaatctattctctggtcagtagagttgaaccatggtgaaattattaagcttgattggagattaagttgccgtattccctcgattaaaagacccatatcgattattaggtccctcttcttttgagggggttgaacattaagtactataattgagaaaatactgtagtctaactttgtcaattaatcaacaggtttattttttgaattagcgcacaagaaatacttttggcataatgttttaattgtatacctaattttatttcctgttgctattccaacgcagaaatgtcaaaaatcatgtccaaatggcatattggaatgaacatcatcgctgctttggatgccaattgcggcattggccgttccaatgcattgccctggcatttgccggaagaatacgcacattttgtacgcgttaccacacacacgactgacccacgaaagcgcaacgctgttttgatgggacggaagtgttgggaaagtatcccaaaaaagttcaaaccgttgaaggggcgcctcaacattgtggtgagttttgattcaaattagagttatttcaaaaaacaattatattttttaaatttagctcagccaaacaatggcacctcaggtgaatttgtgcagcaattaaaacactaagcttttgatgcacttattgttagataaatgaccaactgatagtggcaaaacagctcgacgaagtgttcgccattctaaacgacgaaccgttcaaagacacagtggagaccatttggtcagcttcacaatgtaaaaaaggcgtttaaactagcagaggattattattatttttttgccatttcatcaaaaaaagcatttccaggaatgtgggtggtcacgatatctatgcgctcggtttgcagcatccgtcgctgcacaaagtggtgctgacccgtcttgacaaggcctttgactgcgatgttcatttcccaaccgttgactgggcacaattcgaacgcaaagacgactttaatggaccggaggaaatgcatgaagagcgaaaagtgacttggcacgtgacgtcgtacacgcggaagaaag

SEQ ID NO: 43690 - DNA, 839 bp, Heterodera glycines
gtaaaacaccgactgaaaatgagtgtaatagtaaaaaaatacaatgtaaaacaccgaatgaaaatgcgtgtttaatagtaataaaaatacaattgtaaataccttaccagaaaatgtagaaattccggttattaaatataattgtaaaacacaaccggtaaattcgggctttacgtaaaaaaatttcaattataaaacacaactggacatgcacaaaacaatttctgaatttaaattttacttttccggaaaacactttctgtttttgtttttacttttccggaaaacaagaataaaagaaccgaaaaaatgtattttatttcatataaccaaaaactattcattttaaaataaaaaaaaatcggaaataatgtcttttctgagaataaccggaaagcataatggtgttgaagagttttgaataatttagccttaaatttggaattttattggttcttatttggtggaatagttctggattttatctccatgttttttccgaccccctactgatcaacataaaaaataagttagcaaatttaacaatttactattttgtaaagaattaaaatcgccattttctaatatcttggaaaattaatgagaaaatatattcaatttcctaaaggattgcatttaaactttttttactattcaattaattaaatccgtttttataaaaaaggatcattaaacttttcaaaaattttctccctgacaccgcggcaccacaaaattttcgtaattatttttaacaaattctgataagttttctctgattacaaatatggttaaaccaatagagtagccatttcgattaatctgtaattttttttttt

SEQ ID NO: 43691 - DNA, 1021 bp, Heterodera glycines
tgtttaccatcatcgaagcgttaattcttagttcattcaataataattacttttcatgcgtcataaaatttggcgctgttaactgtcatttctctgtcctatggtttctgtttctctattccggtgtaccaaaaggcaattgaggacggtgatcagatgaccaccggatcatattttgattttataaaggtttgattttgttttttatattttaaaaattatatatttttagagtgtttcacttataatcaattttgccaataaattttggggtcgctgatcacgaacccggcatcaattttgggtcaattccgaaccccggacccgaattcgaacaaaaagtcgaaaatacaaattttcgatttttggttcaaaatcggttttcgcaaagacgaaggccgtttttgttaaggcacctcaacgttcgaacatttaccacgaatgtttccggatttggcactaactccaaggctgttttaacgagatgggggacttggcttcaagccgtatcgttttattggcaaaatttcgaggcagtgaaagaagtatgtgaaaccttaggcttttttagcattatgcgtttaggtggtcaactcgttcgacccatgtgatgcattatgcgttagtgaaagtcagtcgtgcttcactctttcaagatggcaagaactctcgtacattcacacgaacaagcagccggcgataaagcagaaataatccgccaaaaaatctcttacattgtctcaaaaaacccctcatttgatcaaattgcaaaattttgccaaattctttccggaaaaaatgttgattgtgatgttcccccaccttaattccattttacaaatttgcccctctcacttcttgcgatgttgaacggactttcactatttaaaaaataattttatccgataaccgattttgccttaaaatttggaaatgtacctcatttgcaactgcaatcagtgaataaaattatattggcttaatttttggaagaaaattatgtcactatttgtcaatattt

SEQ ID NO: 43692 - DNA, 1021 bp, Heterodera glycines
tgaacgggcgggggaaggtggccaccggaaaattttctgtatttcgttctgatttgttaacagattttctcccaaaaaattttaagaaacaggtgggggtaaggcgtgccggaaaaaaactttgtgcttttaatgcgattcggttacagattttgtccaaaaaattgtttaaattttgccaaaaatcttatttcttgataaaatagtgatattatgccataaatttcataaattttgagtttatttaagaaatcagaacaaattttggtcgccccccaaaaatcagaacatttctgacaaatcacagatgagaaccctgatttaaacacaatacagctatttaatattaaataataattttttccaattaatttttttcgttttatttgaaattcaaaaatgcaaatccaagctgatcgcgctcattggatgtgcttctattttgcattaattgcttatttcgaattattttaaatagttctgctctaattgatgtaaccgccaaatgaggaatgaattaataggctataaaattattttttacgaatccttgctaattaatgtcattacgtgccaccattatttacctatcttttggcactttgctccattttgaattgcttcacaaagctgccatttctgtttgtttacactgcatttttgacagaattacatttcgtttagcagtgaaaagcgcttttattccacggtttgcaattggtaacaacacaaaataatgttttagattatcaaatttcgcggcaatttctccgacgtgattttcaacggctttgatcggctgattagaataatttctgagaaatattagaaaattaaaatctgattttattttgggtttttctatagtaaaagcaatatccgattttctttaactacacaacattaattttcatagaattggtttaggattttgtattacattttatcatattataaatttgtatgatggctagataatcactggctgtataatcgatattcaaattcagggcccttctca

SEQ ID NO: 43693 - DNA, 460 bp, Heterodera glycines
aggcttttgatgctacgaattgcttctctttttctgcataacattcactgaaatgggcgatcatttgtcttcatttgcctaaaccctttcaaattttcttctttattaattttttttattttcagccatttttaatttttgcactaacaaataagttctttcttcgtcatctaaattaacactaaataaggcttagttttgaataatttgctctttttcttctctcattttttctttttcttgtcgcgcggcagcaaaatctgacaaaaggcggcacttttgtggcaggggacggacggacgagagaaaattggcggacgacggacatggcgatttgtgctgtttttgttgctgttgctgcgtgaagtgccgattcgctctcatccatttaaagctttgtcaattgatcgatcgctttctctgtttgtgttgtcgccgccgccgaatccgccgaatattc

SEQ ID NO: 43694 - DNA, 858 bp, Heterodera glycines
ctgcgtggatttttgctccccatatttgtttgagtaccccacacgcacacttgaaaaaatcgatatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcaatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtagtttaattctgcgttggatttttgctcccccataaatgtttgagtac

SEQ ID NO: 43695 - DNA, 986 bp, Heterodera glycines
tttagaggctttttctaggctattgcttagcgaccccccaattaccaaaaaagttataacatgaaattgcaaaaaagtcaaatttttgaagttcgttttttggcaaggctaatagagcatgttaagagcttacgaatgataccaagattgttggatttggatgacaaagaaaaaagctcaagtggaaaaacgagcctgcgcccaaacggccgcgcccaaacgcgtgggtccctaaaatgatattaatttccaaaaaaaaatcagtcaaaatttgtaaattaaaaaaaaaaatcccacaaaataagaaattttcaaaggctcaacagaccttactgatgctaatttgtaaggtcagtgccaaccatttggacattattggccaaccttatgcaatttttagaacggtagtgatttgaatgaattttttgtttgaaatacaaaaatatgggtacagtaatccgtcaactgttttggtgctttagggatggcctacagttgggggcaaggtcggcatgaacttgtataaatttctggatttttaaacgaaattttgtacaaatcaccattaattctcaaaaacatttttgacaaattatttgatgttaaattaaaaatttaaaaatacgagctactaaaattcccatccctactgataacaatgggaatccggcgggtggcgataggtgccgcctctggaaattttttttggacatttttgcgaaatatgatatgtaagaaaactgtgccaaatttacaaaaaatttgcccattttttcctgattttttatatttttcatttcgggggggggggggggaaaggaaaaatgagaaaaaaaataaaaattattttttaccatataaaccaaaaaattaacgggggtggatttttagggccaacgactaagaagggccatccgtccgtgagcctttttccttcccttttttagcctaaaggggcatttgtcccctaatcccctcccccatcc

SEQ ID NO: 43696 - DNA, 889 bp, Heterodera glycines
tgtccccctttttaatttggccacaattcgccatttttggcattttttctaaactttgcttaaagcagtcaaatttttcatttgatgaaattcaataacctaaatgttctctatttgcctaattatttccttcttgcttaaatctttttgtaactgaagaatgttcaaaatgttgcagcatatgcttcacctgactcttaaactgctgattgccctcattgctttttccctttcccacttccactgatcccacggcacattctccgctctctccgtccgccccttttgccgtgccgtcgtccctctcaaaagttccaatcgccgttttgtgcgcatcgctttcgcgccaatcgccgtttgggctgtacacattggggacgacattgttccgctgcctttgctgatcattcgtcgtccgatgatggtccctctccaattgaatcgctcctccgatcatttcgcactgatcagtcggtttggcgatttgttggtgtgtgtggtagcgaagcaatcgcattctgtggacatttaaatttaaaatgaaattttcaatggcattacctccacaaagcgattcctaaggggggggggggaaggaaattagtgaaatgaaacgaaggaaaagcgaagaacgaaccgcagccaattgttgcgatgatatactgaaaaggaacaggtttaattcagttttactatgtaaagtagagctcggcctgtacctggatccaggtctggatttttcctggattctggtccaggacatccaggtccaaatggaatccaggcaggctttttcaaaataccgagctctaatgtaaagcacttccccctacatggatgatgtcggtcgagccgaacaccatcatcgcctgtctgttctgtcccatga

SEQ ID NO: 43697 - DNA, 1376 bp, Heterodera glycines
tcaaaaaatggttgctaaatttgaaaattatttcaattttgttgaggacatggcactgtgtgtgttcatccattttggtggcgagccacagctgtactacgggacgcatgaccaccagcagcagctgcaccaccacccatccgtgatcatgccggacggggttgccggtccggcacgcatgtcgttgggtgtcagtggtggtggggacgggtacatgaacggcacactgtccaacgccagcatgttcatgccaagaagtgagtgatgtgcgagccatttttggggagtacaaaatttgatccggtcatttgatggcgcaaagtgttaggggaaaatgaccgacaacacatttcgaatcttttcctcttttaaaattagtcaacatttttgaatttgtgcgattctttcgaggaaaaccatatatcaatctaaatatgcgttatttaaataaatttttggttttacgacaaattgttcacgaatggactggaattcaatttgtacactaaatgcatgttgtgaatgccaattctaatccggtaactgtttcaacagcacctcttcgaacatccaccccacaacaaaacggtggtggtgccgcggcattgagcagcggaggaggtggagcagtgcacatgaacggacacacgccgctgcatcaccagcagcaatatttgacaccgggcggcgcgtttgacggggaccagtccatcgtggccggagcacaggtaaaattgggttttagaaaacagtcagtggcttttaaatgatcgaaatcgaaaacatttttacggcgcttgactcgactctttctaaactcgagagttaccataaaatgtgcgtaactgtttagtttttgtgaaaaaaaatcggggcttttgagtcgatcaatgtccaaattacaataaaatacaaaaaaatgttcccatgttttccctatacaaaaacagttgatgccatcgccacggcacgagtcattgcacacactgttcgcgcggattgtgaaggatgtgtggcgacgcaatctgtgtacggcacagtcgagcaataatgtgagcaaaaaagggggccaatgtttcattttaaatggatttgagggaaaatgccaaaagattttcgtcacaaaatgcctgggatttaacccaatgcattagttagcagatggaaatagccattttgtttcacccttgcagtttgtcaccccgtgattcatttttatatggttgatggaattctttttttctcgaaaaatgctgttcctagggccctttaaaaggtggactctgtgttgttaggtgattcggcacttggccagcagagtgagcctgccggcatcagttggcgcactgcgccgtgcatggacgacatcagctgac

SEQ ID NO: 43698 - DNA, 994 bp, Heterodera glycines
  misc_feature (47)..(47): n is a, c, g, or t
  misc_feature (109)..(109): n is a, c, g, or t
  misc_feature (172)..(172): n is a, c, g, or t
  misc_feature (978)..(978): n is a, c, g, or t
cgtacattcgtggggtcacaatatgcaacaaagaaaagtgcaaatanaataataattagaagcaatgccaaattaaatcctatagcaacgacactcatatccgaaggcnccgcgcgctttcgccggcgccgatttgcgccttaaattttgataattatttcgtaacccgatntaaaaaatagagtaaatgaatcagcccaggtattgtacggtatcaatgattagcctaccgtttgaaaattttggcttaatcttttaaaatctttggtcagagtgccgaatctcataaatgagtgaaattcctattttaaaatttaagtctgagataccatttcttaaaataagtgaaattcttttagtttacgttttcttctctttgccatgccgccgtcaccaatttcaattgttttcgccaaaaaattcaaaaattttgccatcctcccttttttacccttaaattcattgcaattttcatgttcattttcataagtcgtatcattcattgacaaatattcatttgaatcattggaattctgtttatataaaaataaggatccaataaaaattattcatttaaaatttaaataaggttggaactttgataaaattaacctttgcttttgttccaaaaattctctcaaaaatggtaagaaatttgtgaattttgcaggcaatatttaccaaagattttgcggtattgttttggtgatcttaattaatgtacataacattatttaaccataaatccaaaattaccgttttctaattgtgttagtccatcattaaacaagtttataaatgccattttgtcaatttcatttgactcatcagattttgcatattttattaaagaaaagaaaaataaaggaaatattaaagtaaatgggtgcattaattaaattactaatttaatggaatatttttaatattaaaaaaaattacgattcaatataatgttgttttttgtttatttccgcngatgcattataaaaaa

SEQ ID NO: 43699 - DNA, 1348 bp, Heterodera glycines
  misc_feature (9)..(9): n is a, c, g, or t
  misc_feature (75)..(75): n is a, c, g, or t
gggagaatnttatggactttatttggaatttctatcttaaaaagaaaacaagttattccagaatttctgaaaatnttcgatttttcagataaaaattcataacccccttctgaaaagaaatttttgaaaattaaaatactacaaaaatccgcaatttttttctttataatataaattttattttacatttttatcacatttttaaaaaaagatacaaaaataaaagtgattttgggattcgggaccaaaggggggtgaccaggatttttgagtggaaaaatttttccacccaaaatcttcaaaaaatatgtctttaggggttatttgggccgctgatcacgaatacgtgatcagattttacttttgacatagtcaacacctcagaatccctgtgtgattggggattctgagtcatcttctgggggggggcggcaggttcgaatccggacggtgaacattatttttctatgcatttttgggttatttttcagtgcgtttaatttatatttaaagatttgttatttttcaaaatatgctcctatgaaatgaaaaaaattttctcaaaaatttactttcttggcaaaaatttttaattttaaaaatttttttaggtaactattttgggttttttggtcttaaaaatcccagtcctactcatttgcaactgcaaatagtgaataaaaattatttttgctcaatttttggctgaaaattatgtcactattcgtcactattttggacttttttcactattttgtcactattttggcactttttcgtcactattttagttaactatttcgggatttttcgtcactaaaagtcccggccctaaaaattaatttcatattaatttaaatatccaattcttgtacatttcaaaattctctttgtaattaataaaaggaataattaattttattttttaaagtttataataaattgcattcaatttttgtacctcttctaatcagttttgtacctcttttatcactgttgcacctcttctatcactgttgtacctcttctaatcacagttgtacctcttctgatccctgttgtacctcttctaatcactgttgtaccttttctaatcacagttgtacctcttctgatccctgttgtacctcttctaatcacagttgtacctcttctcaccactgttgtacctcttctaatcactgttgtaccttttctaatcactgttgtacctcttctaatcactgttgtaccttttctaatcacagttgtacctcttctgatccctgttgtacctcttctaatcacagttgtacctcttctcaccactatgtacctcttctaatcactgttgtacctcttctaatca

SEQ ID NO: 43700 - DNA, 1220 bp, Heterodera glycines
  misc_feature (59)..(60): n is a, c, g, or t
  misc_feature (67)..(67): n is a, c, g, or t
  misc_feature (85)..(85): n is a, c, g, or t
  misc_feature (118)..(118): n is a, c, g, or t
  misc_feature (209)..(209): n is a, c, g, or t
  misc_feature (1162)..(1162): n is a, c, g, or t
  misc_feature (1206)..(1207): n is a, c, g, or t
atttatgaattattatgcaaaataataaaaaatttctaaaaattgatcgtccataatannttgtaantgatcagggggctcaccnaatttgcaggggatacgtatcggaacactacanatgcttactaattttcctagattttttaaacccggtgaaaattttttgcagacaccaccacttttgcacttaaaaaaatttcaaaaaactntaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttanacccggtgaaaattttttgcagacaccaccacttttgcacttannaaaatttcagaaa

SEQ ID NO: 43701 - DNA, 1085 bp, Heterodera glycines
aaaaaaaaaaattttttatttttttttgtatttttcaaaaagtttcctttccttaaattttcttaataaattgaaaaaaaaatggttgagccttgtttaacaaattagttttttaattttaattcaatttagtgtacatttattattttttttcaatcccaaaatccacaaaacaaaaaaagttgtaagcctttttcgttcataaattatatttttccctttcgcattggtgagccgggggatgggagggacatatcaacgttgttgattccggtaaaacgggctttttttgaacgggcggcccgccccggtcaattttcgaagcccggtcccgggcccggtcaattttaccaggctaaaacgggcttaaattccgccagcgaaactgcccaaaatttgaaaatttaaataattattttggcgaaatgtctttaattcaaaaatttcaagatagaactttggatttttgaaatttttgagcaatttcaactgttaaaaagaccccaaaatccatacgaaattgaacaacattttcataactttctttttacaaaaaaaaaatttcaaatttcatgaaaaaccaaaaattttcttaataaatttcattaaaagtcaaagtttttcttcagcgtcgcctagtacaaaaagctaaatttttttctaaaatgtagctcaaaatagcaacgttttgtcattttttcgtgtgaatctgttaacaaatcaaactcaaattttcaaaaatttacccggcggccctgtcggcactgccggaccccccccccccccaatgtcgtcaaaatctttttgaaaaaatacaccttaaaattcttttgaagagtaaaaaagctcgatttacaatggcttgacatttctaagctaaaataaagaactataaaattttttcgaatttttaatcaaaattacaaaaatttcgaaaaaagcccggtcccatacgggcgcccggtcaaaattttggaccgggacgcccggtaaaacgggctttttttgaacgggcggcccgccccggtcaattttcgaagcccggtcccggtactttcaaaattccgggctctactaaaaacatt

SEQ ID NO: 43702 - DNA, 972 bp, Heterodera glycines
cgcatctgggaaaactatagaaaaaaattcagcgcggacgactgagtcccagggacggatttctcattttttcgtgcgtttgacggcccataactttttttctgaaactcggatcaaaaaattcccgctgtgagggcactccgcagaagtgtcctctataatccagtattttttattttttgatcagaccaaatccctgacctgtacagacacggagactcagttaatttttttttcccacttcagtaccaggcgaataactcattagggtttgatctgggcggggagttaccagcagacttattgtagagttttgaaagcccgatttttccaaatttaaaaaattcgaaaattttcaaaatttttcgagttaggcctaaaaaacggttttcgggttttttaattttatgattttttaacgaattttcccagaaaaacgaagaccacttccaaaacatagtttttcgagctctatcgattggtaatttttttggaaaattttcgatttttttccagaaatagaaaaaatttttggcctgagcgggacatttgagtcccgggcccataactcgtcaggggttggttttagccaaaaatggccttagagcaaaattgtagagctttttaagctctatcgaacggtgtacttcattttcgaaaattttcaaaaattttcgagctaggccccctagaaattttcaaaaattttttttgggttgaaaaagagggtgaaaaaaatttttctggggtaaattagggtcctgagcacaaatatgatgtttattttaagtttcagattttttagaattttttaaaaattcgaaaatatttttaatttttttggtccttggaaatttgggttaaaatttgaaaattcataactcaatggaggactggtcaatttaagtgaattaaagctttaaaaatagcaaaaaatcgagagaattttatgagatttatttggttttataa

SEQ ID NO: 43703 - DNA, 995 bp, Heterodera glycines
tcatttctaactcacttctcaaattgttgataaattgcattatatttttccaaaagtctgttgacactttctgaaaataaattctatactcatgtattttccacttattagattttgcaggcttattgctgcatgttctttgccacttcttcaaaataacctatgccctttattcgttcaaaacaccatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagattatcatttctaactcacttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtagcgttcataccaataattgagggtttatttttaaaagaaattttatgataaaccttattatctcagaagctatttaattgattcggatgtttttatcgcggttaattagagcaacgaaaattggtttgaatcgtgaagattatcatttctaactcacttctcaaaattgttgataaattgcaaatatatttttccaaaagtctgttgacactttctgaaaataaattctatactcatgtattttccacttatttagattatgcaggcttatttgctgcatgtctttgacacatcttcaaaataacctatgccctttatt

SEQ ID NO: 43704 - DNA, 938 bp, Heterodera glycines
ccatttactcggtggtggacgacgacggcgtttcaatgcgtcgagacgaagaggtgcggatttggggattctccaaatagcagcacattctcattttttacggcatactttttccgttgcacatgcaaaattaactttaattctgagcggcataatttaatttttatcgtcattttttgtggcattaattgattttttctttaattgcctaatattttacaattactcaggggaaaattctcgaccacgaggggaaaccgttgccgaccgacgcttacggccaaccgatggggcccgacagttcgccattgccgaccaatttctatggccaatttgtgcttggccaacggctggaggaggaggacaaagtgttgcccaccgacacaatgggcttcccaatttacccaatcgtttatccggacggacaattgctgcccactgccagttccgggcttttcctggactcggaacgaggggacgaagtgcaacgggacgagcagggcattccggtggacaccgatgtaaagcattggcaaaaaaggacaaaatgaatggcacgggggggaaggcaaccaacatattgtgaaggaggtcaagccaagtaaatcaacgaactcttttttttcttgttttttacaacatttaaagaggggaggggacggcagtgccgataaacgccgtctgggaacaaattggaattttttaattaaaatttgtttagcttagaccaaaggatttgtaaaattcagggtaaaacgctgccaaagaatgcggagggaatgttcgtattcccccggccaccgtcggaatttgtgccggagggcggagggtgccgcggccgcccaaacgactgctccgcccattttgacgacctcttccgaagcgcctcccacccccacgtccagtggccgaaggcgacgacaacgtcgacagcgcgt

SEQ ID NO: 43705 - DNA, 683 bp, Heterodera glycines
ggattttcctggatttttgtccaggaaatccagtccaggcaaaacacgaaaaaacctgttttcctagacaaaattttagaatttattatttcaagtgaccgatgtttttttcatttttcaaaaatgataatgattagggatgccaaaaatatgcacataaaatcgtaaaatatgcgcataaaatatgcaccaaaaatcgtgaaatatgcacataaaaagtgaaaaatatgcacataaaattttccaattgagggtgtaatttctcaaaatttcttcaaatttgttaaacataaagtaaaatcttcaaaatggctaaatgtggtattaaaaatcattttaggagaaaaaaacacgatacagcttaaaatctactcattttagcgaaaaatcaacctgaaaagcaaaattttgcttatttttgacataaattaaccattttttgagaaaatttatttattcaatattttttcgtgaaaaattttttgctaaaaattattttttttaaattttcccggtttttgaggtaaaaaaggccaatttgtctgggtggggccgatctattagaggttttttgggaaaacgccaaaatatgcacgaaatgccaaaatatgcacataaatcgcgaaatatgcacaaatatgcaaaaatatgcacatggaaagtcatcccagaagcttcaaatc

SEQ ID NO: 43706 - DNA, 960 bp, Heterodera glycines
  misc_feature (879)..(881): n is a, c, g, or t
aatccgaatcatccaatcacttagaatttatgggcacctatatcatcacttgactattttttgacaaaaaaacaaacaatttttgaggcacatttgggcataaggaaaatgtcacaatgaaaaattaaattgaaataaacaaaaacagagagaattttttgttaaatacgatgaatgtaatttaaggcaatgaattgcaaatgatttaagacgatgatcaatcaattggatgtgcaaaattaactcatgaatgacaaaatgacagcttttgttgcggtttgaattttaatttctgagcctggcaaattttgactgaccaaaaatagaatttctgaaaaataccttctgtcattcaaatgttaatgaaaagaataggtacgtgtaaaataaagaaataaatacttaaaagtggaaaaaagcaacaacagcgcgctttttgagtcctcagcggcaaatgaacgggaaatacacacagaaaacggtggtacccatgaaaaagaggatgatgatggcgaccacaatgcagatagccaacattattttcagctaaaaaattggttgctcttttactgaaattaaaatgttttcaaaattttgccaaacatagcggtttattcatatttttctctgtcctatattaccatcgtcgtcaaaaaaaagaagcgaacttagaaaacccaaaatagtaaagctgatcggaaaataggaatcgatgacatacaattttaaaaggggaaaaattgaaagaaaatgttctagagcccagtaaaatgtttgacgattggcagttgtgccaccatcaccttcatgttgcgcttctttgccacctccgcagctttcaccgtttttgagggcgccgtccgcgcgttcctgcccggnnnacactttccgctcgaggagaccgaccatttccccctggttacgaacaaccaattaatggagttaatgcaaaaatcccct

SEQ ID NO: 43707 - DNA, 848 bp, Heterodera glycines
ccttccatggaagggtgtgtttcgagtaattaagaccctttatgtgatggtaacaattgtcagttgtaatgccccgcaggctaaccctaaagttgtgcatattaatcagcttaaaaggtgcgtagaaatcctaggacccgcttgcaccgcaccaaatgtctccgatgaggaaaaactttcattggaaaaagcagatgctgttgaagtatttgacatgcccgattttaatcatctgaactcagacaatccaaataaatccgaaacagaccctaacactgagtccacataaaccttttgcagtattttgttattttcccacgtaccacaacactcatcaaattcagttccctcatttgatttcagattcaaaactcataatcctccaaattcccaatttccttcctcgttttctgatcaattccattccccaacaaagtccgacatccgatctttcatggactccgacaaccgttcaatgtccagcgacacgtctacgattcgccgagtaatcgacgaagctgttgacaacgttgtttgctctgaattgttggagggtcaagatcccattgacatcgacctgtcgtatgcgctggaggtcgaattgctcgggccgcaagagcccactaatccgcgcataacacctcaaccggacaacaactccgaagtttggcaaagttgtgacgatgacaacatggacacgtccagctccaagttggatgtgagtattgtgccgagtagtgatggtcgggcgacagcctgttctaatgagtcagttgtggaggatagcattttgattgatgaggaaggggcgacagcccagtctaatgactcgcttgaaacgaatgaaa

SEQ ID NO: 43708 - DNA, 963 bp, Heterodera glycines
aataaatctggcacatttagtggagtttgtccaagtctgatcagcaattcaatccttttgtataataaatctgatcagaattgatcataaagtttgtccccattaagcgctgaccgacccgagcattcactacggatttcatcggatgcagaaatcgttgccaaaatatccaaatgatccggaacgattgcccaaggaagtgattttgagaagagcggccgaactggcagaagcattgtacaaccggtgtgtggttatagtacagcttaatttattgtgatcaattggccattataccgtatttattgaaataaagcccccgggggctctatttttcaattccctcaaaagtggggctttatctcaggggggctttaattcaggggggagcgctctgtttttcaacccccctcaaaagggggtctttatttcaggggggctctaatttaggggggggggggttataattcagtaaatacgatatatcagtgccaatgccggaaatatcaatttttaaccattggcattttgactgcacaacaatttgtttgccctgaattaaggtacagcagcccggcggagcagttgagccactatgcatacagcttcgactcgggtctgtttaagtagatatggcccccgaatcttcggggtgagaaaaagtcggggttggggtgtactcccgaaaaatgtgcctaagtttgttttcgggattgggatatcctatcccagttttaactggcattccattctcggcaattatttgttccttttgggtgcgtttccttcatgccgtaccccctaaaatgcgatttcccggcaaaacctttctaattaagccgatatgcttcctcgttacatattacagatttttgatcatcattagcgatttgtcccgaggcaattatcggattagggtcgaaaattgctttggcattaaatattcgagctttatctataccg

SEQ ID NO: 43709 - DNA, 772 bp, Heterodera glycines
atccgattcagtcgaccgcgaatgccatatacagcaataacgaacagattctttgctccagtgttatcggcacaattaattaccttatgacttttaataaaaaatccaataagtaaaatcttactgcgccaacaggaagagcaagagaaacccggaatttcgccccagaagcgcctccacgacctcgcttagacattttaaatcaattattactttaaaaattgtctaaactccaattttatgtttaaactaacgaatttcaattctagaatcaatagttaagttaattgataaaagggcattaacacgcaacgctcacgttttctctctttgcttcaaattgagtaaatcgaaaatctcatttttggcataaatttccaattttagaggttattttattaaattctctaaggaatttcctaaaagctgattttttcaatccttagaggtcaaaaggtcacccttaattatgaatcaagggacgcgttggtttttcgaggcatggacggtaaaaaaggaaaaaatccaaaaaatttggctagtaaacaaaatgccaatgcattcaaaaagaaaacaaagtatttatgttatatgttgagaccgactaaaaaggcaccaaaaatagcgaaaaaggcactataaaaggcacgaaaaaattgaaaaaaggcatgaaaaggcacggaaatcccgaaaaaggcatgaaaaaaggcatttaaaatttttttattaagaatttttagggagcaaaacacgtaaaacttaaccaaataac

SEQ ID NO: 43710 - DNA, 1243 bp, Heterodera glycines
ttttaaaaagtgtttcactgaaaattgacaatttattaacatattttgaaattttagggaaattttgggggcctgtcgtgctgataggcaaaatggccatttttgagaattttttccaaattaccataaatcagcatctcataaaaaaatcagctttgaccttttgaaatcagcaaaatgctgataaaaaaaaaaagttctgatttgaagggctgagccaaacatttaaaataattggagttaaaattttttaaaaatactttcttttatttagcatatgtatcataaaaaatgtatcacggactggtaaaattgcataaatacataatgaattttgtttggttttttgtgcaggatgaagcaaaataacatctgtccgatgtgtcgtgcagatttatttaaaattacattttttaaaggttttatttaattaaaataaatttgcattaatcattttttgttaaagcaaagccaatcgtacagaaaaaaacaaaaaatcaaccgaaaattacaaatgaaattcactcagatgtgtgaagagacaccggatcgaaaagaaaaagagagtaacaaatttttcaaatttctgaattatttattttctttatgatatgtagcatttctaaaaggggggtggggatgacacaaagatttggcaagtattttacagtcattaaaccactaacgatgtttgaattctttttttatttcttttaacttattctttactcgataaattttgttagaagaataaaatttaaaggatttattataatgaaaaaaggacggattatatttaaaggttaacaaacccaatccgcaaaagtttgctttatttgaagatgaaaataaaaaatcataaaaaagtgcggacaaagtcacgcaacttttatatttggctttttatgatcaattttcaatatttccgtgttttttctttggttttgtattcagcacaatttttgaccaataattggctgaaaattttatttattttttattttcaaaaatcacttttgagcaacctttcaaacgattgaaaaagtgactccaatgttcgcaccgctttttaataactgttttttgttgagtcatttctcgatgtgaaatgatttttgtgctttttatttaataaactaattggatagtatcttaaaccagacggtgctatgacgttagtcaaaaaccatcaatgaaaatattttttgaaataactttgctcaaatgcaaccaaatttttaat

SEQ ID NO: 43711 - DNA, 1093 bp, Heterodera glycines
  misc_feature (25)..(25): n is a, c, g, or t
  misc_feature (953)..(953): n is a, c, g, or t
ttaatgctatttgttagcagatttntgtctaaaaataccataatttagattttgtctaattttttaagaaaagatagctttttggggggtcggcggtgccgataggcgccgccggaggaaaattttaagaatttttaatgaattttgttaaaaaaatggccaactgatttttcataaaagtcggtcgattgtttcgcaattacctaaagaaaaataaatcgaaaattttcgtgataaattatttagatttgttattttcttggttcattcgatagctctaggtgtttctactagcctgtcaattttgaaaaatttggctaagtttcaaaaaagttatgagcaaaaatgtatgaaaacctggctcgttgattacattggccataactcgatggttttttatataacgcccttattgatggtttttatctaatgactcagcaccttttatccgaccaaatatctcacgacagcctgcccagtttggcatcgactaatccgcccctcaacaccaacatggcggtcaacgaggagcaaaagagataactcaaagttggcgcagtattcagtgagttcatttcaaaggcgacagtgcagagaggcatagacattttacaagtttttacttttttttattttttattattattctttcagctatttagaaaaatgcattgatttttttaggtttcttagatcataatagcccatcgatcttttcccacattaaaaattttttctttaattaaaaattgtccttttaggaaagaaaatgctaattcttttttttgctaatttgtataataaaatgccttaaattatcaacccatttttaacctgaaaatcgaatgaaacaattctttaaatgtgaacaataaaaagtcagaccgcaaaaattgcatgtgtaaaaaattggcaaattctttcatagtgctaatcaatttatgccactttanagcttttaggtaagttgctaaaatttattattaattcccaactagcattttttcatttttctaataatttacatcagccgattaatacaattaattgtacatttaacttgcccatagaaatgcctttacaacttttattt

SEQ ID NO: 43712 - DNA, 889 bp, Heterodera glycines
ctctctctcccctcgtgccgaatcatttctgggattgcaataaattgtttcctatcagcgagagttgcgtcgcaatatgtaccaatttgaggactctctggcaaagatgttcagcaatggggctgaagtgtcgcccctccccgtggcgcccccggccgactcagtccccagtccggctcaattagtccacgcacttgccattgccggaaaaattggccccgtttcttctgtatgactccaatcggccgatgcttttcattttcggcattttttgccattttttgtcaatttttgtcatttaattcgttagtgttcttttttttcgttattacagtattgcctccctttgagctttaaaaggaattaatcttttcctattttccatttttatttcttccgccgaattcgcctttcttttttcgtttttaaatttgctaattctctcaattaataattaataaatgccggtcgtccaattaaacatttgcacatttattttattttatttttctcatattttgtcctcttcagctgcatattttattttgatattctcattctcatttttggctttcctctcattttgcattgctttaactttcgttttttcgtcttattgttaattattgctcattttttgcgataaatttttaccttttttcgaactttcgccccgggcattttcgtccttttttccctcgtcaatttttgcgcaaacattcggtcggagaattggcaccgatttgagtttaataatggcacttttttttgtctattttgcctcagttcgatgaatttccttatcaaattgtccttttccttttcatcggatcgaataaaaagaaaagaaaaagaaggaaaggtgcatcagtgcaaaaaatgaggtgta

SEQ ID NO: 43713 - DNA, 620 bp, Heterodera glycines
caataaaagcattctttccattttcaggtacatcgatcattccgtcatcgcttttcttcgttcaaatcacaaaattttcgacaaaagaggcaccaatttagatttgtggattccttattcaaacaccacggatggccagcggatttgggacatttttgttcatgaaatttggcccattttttcgacaaacattcgccatttgcgcttttacgatggtgatgatttggacaatttgcttcgtcgcacttcgccgacaattctcatcgatctcaaccaattgaattcaatccattcatttggtcggttgcccgctgcgtttggtgatggttttgatgtgccaaattcaacattttcttctggccaagcattgtccaaatggttgcactctccgagaaaagatggccaacccaagctattgcgttgcgtagattacaacgaacaaacggacttcgattgggtcaacaatttcaaggaggtgtggcataatttcggcaaatcactgatttttgttttcaaattgtttagcaatttattcgtgccaatgccatttcttccgtcagttacgaaattcatttttatgttcacgtgccgtcaatacaaatggagccattcgagttggt

SEQ ID NO: 43714 - DNA, 1043 bp, Heterodera glycines
tttgtatggtacaaaatctctcgcaaaaaagagatagcctttttctggcatagaaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagatgccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagatagcctttttctggcatagagaataaatttaaaaattccctgtagaatagaatggccattgctctccgcgcccctctgcccatgctgggaacatttgtatggtacaaaatttctcgcaaaaaagagatagcctttttctggcatagagaataaatttaaaaattccctgtagaatagaatggccattgctctccgcgcccctctgcccatgctgggaacatttgtatggtacaaaatttctcgcaaaaaagagatagcctttttctggcatagagaatatatttaaaaatccctgtagaatatatggccattgctctccgccgccctctgcccatgctgggaaatttgtatgggacaaaattctcgcaaaaa

SEQ ID NO: 43715 - DNA, 843 bp, Heterodera glycines
ccctcggacaaaacaattcacgggtagaatcatggggatggggtgggggttatcgaggccaaattttgacaggtggcgacatatacaaaatcctcgaccaagaaaacttcgcttcattcacggcaccaattccacccggaccattgaaattcttgctgatggatgcaatgaatgatctgcggaacatttaccgtctttccagggccaaaatccttcatcccgaggacctcaattagcttgaacactggaccaaaatgttctactgccactggcagcaactccgaacaattgacgccgctcgttacccagtccggccaaagcttcatcttctcgctgctcacgtcgttccatttgcacgcactcatctctggtggggactgatcagtgaacagggaatggagcatatgcacagaatgcaactatttggtttaatgaataatttttcccattaaaattataaatccaggtcggtcgttatgctcatctcggtactccagagaaggttgttgagaagttggtgaaacacgtgacactgctgaatgcccttcacgatcgaggtgtcgaaaacaatcaagaaaatggaaacaaatacccaaacttttgatcaaatttcatttttccaaacattttcaccatttcacatttccactatctgaatattatgttgaacacatcttttccgctttctatagtactattaaataaagagtttagtcaattgaataaagtttattaatgttaattggtcttcaaaaaaggcagtgatcagtatatcttttgaattaacgcgcaaaaatttacgccaaatgcgctatttggcgttatgagcaattttgtctgaca

SEQ ID NO: 43716 - DNA, 170 bp, Heterodera glycines
cggccgagccagtcgattttatcattcataatcctataatacaatcgtactacctagcgggggatgcgccgaaggcgctgaccccgctagttgtataaattttttgccttttatccatgaatatgtcattcttaggggtgtattttcacccccgtgcccccgcgggggcg

SEQ ID NO: 43717 - DNA, 823 bp, Heterodera glycines
tcgtccaatcgcggacaaagtgagtggttttgtgcctccccatggttcatttggttgtctaatgtgaaaaattaaggctgagggttagcaaaaaaaatcaaaaaatgatgcattttgctggatttttgaaccataaaatttgaatgttttgtaagctagtcgtgccaggccgttaaaaaaaataaaattttgtcggttggttaaaagttttgaattttggcggtgaattgggagtagtccggcggtaccaacaaacgggagcagctcgtttccccccccccccccccccccgccggtaaatcttaccaattctccatataaatttctcaaaaaattttttcttagaatattcctatgatgatactttgctagatgtttatgctgagaaaagaccaatgtaggtaaattttgttaacacaatttatctaggatggttgtgatcccgtctttcgagcctggttaccgatgtatttgattccccaactaagaaaggtttagaatatctactttagcatggccacttatacattcatcagaaatgttcagtgcgtgtacataaatatgaccaagagaggatacgtcgcgctatcttgtaattagcgggagtgcttaagcgaaccaatttctaatttagtaaatgtttcgaatcactgacccgaattcaaacaaaaatttgaaaatttcaaaatacatttatatgttcgtatctataaaaaagaaattttttccaaaagaaggtccaccatctaaagtgataccaatgtacatcgtttgattccattttttgcgaccaattaccaaacccgatgtcctacaaaaagaa

SEQ ID NO: 43718 - DNA, 911 bp, Heterodera glycines
  misc_feature (293)..(294): n is a, c, g, or t
ccatacattaaaaaggggggtgggttggtaaaattttttgcgaaggggggggtcggccgccgatgaccttttttttttgcttttcaaaaaccgttttttcggcgcgtttttcccaaaaaaattttcgggaacagggggggccggcggtgccgataggcgccgccgggaaaatttttgatctttgggtgtgatttgttaacagatttttcaccaaaaatggccaatttttgcgattttgagccaatttttgaagaaaaaataggaattttggtgttcggcggtgccaccagcgnncgccggaaggaaatatcaattgccacctttgctgtgttgtttcgacaagtgcggtccaccatcatttcgttgttattcgacgtcacgggaggcaacggaacattgcgaagcaccggcggcggttgtggcggaggagtggcgaatcgaatgtttgaaacttctaaaacaaatacaaataagcaaatgtttggtacagcatccgtatgtaaagcttttgccttgtgatccgttgatttgttgctggtaatccgacagttcgccaatcggtttaaacttcggcggcgagactccctgagaaagttttgaaaaagtgggaatacaaaattgtataaatggtcggacaaatggaatcagacaaataaaaagactagcgttttgaaaccgaatgaaaccaaacatgtgtaaagggtgcagaaagggctgaacgtaactgcgtttcaataatagaaatccgtaagggaggtccaaaaatgcttcaatttgtaatccgtaacccattatatgcattgagtctgccacacatccccgcccccctcctccgttaaaatgcgtatccattttaatggaggatagcgagtggatattgcgtgtccgaaaagcaaaaaagtagacattca

SEQ ID NO: 43719 - DNA, 227 bp, Heterodera glycines
aatttttcatttatttttcaatcattaatttataattttcacttttgttatttttgtaaaataaattttaaaaattgcacgctcagccacaaccgagcacgccaagagctccgatcgatccccccccccataggagagcccaagcaccactctctcggagcccagagcgtacccgcccttttggctagggctagcacagctcggtccccaaaagactctcggagccc

SEQ ID NO: 43720 - DNA, 896 bp, Heterodera glycines
  misc_feature (7)..(7): n is a, c, g, or t
  misc_feature (88)..(88): n is a, c, g, or t
  misc_feature (101)..(101): n is a, c, g, or t
  misc_feature (757)..(757): n is a, c, g, or t
cgcacgntgaatgttatttttattgaattctgagccgttttgagtagattagactagaaaaaattgaaaattttgaaatcatgtttcncactcccttctcncaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaaatctttttttccccaataaacttgtcaaaccccatttttcgcaccgtgaatgttatttttattgaattctgaaccgttttgagtagattagactaaaaaaattgaaaattttgaaatcatgtttcccactcccttctcccaggggtattattttgtanagtcttttttttcccaataaacttttcataccccatttttcgcaccgtgaatgttatttttattgaattctgaaccgttttgagtagattagactagaaaaaaatgaaaacttttgaaatcatgtttcccactcccttc

SEQ ID NO: 43721 - DNA, 1010 bp, Heterodera glycines
aaaaaatgagaaaaaagagatagctattttttgtcaaagaattttttttgttgcgtttcaaatatcgtaagattgttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagagatagccattttttggtcaagaattttttttgtttgcgtttcaaatatcgtaagattgtttgatagagccagacaagagaaggcaactgttggtaccaagtttgcg

SEQ ID NO: 43722 - DNA, 1289 bp, Heterodera glycines
cagacttttggaaaaatatatttgcaatttatcaacaattatgagaagtgagttagaaatgataatcttcacgattcaaaccaattttcgttgctctaattaaccgcgataaaaacatccgaatcaattaaatagcttctgagataataaggtttatcataaaatttcttttaaaaataaaccctcaattattggtatgaacgctactatccaaacatgcacgcgttttgcgctcgagctatttatcatcgggcttgtcaatccaaagcgaaacaacaaagatgctgttttgaacgaataaagggcataggttattctgaagaagtgtcaaagaacatgcagcaataaacctgcatgcccctacgagggtccgagcgaggagcggagcgaagcgaagcgacgagcgatgtgtaccgagtcaatacgaacctgatcaattcttttgcatgccgcgtagggtggggtgggggtgaacggctaggctaggctgtaaccggtagctgctactgcacgaacatccagacacgcatctgcgcctgagctgctactgcactaacaaccgcgacggtgcacaccttacgcatctacccctcgtgtggcctaccagccgaccccatcaattgcccagccatctaccgggacgcctagttatctttattataaaattatgtggggggctaaccataaaacgatttggccgcaaagaactacgcaacggatcgccacgagaccggtaccattcgaaagagctcggttttttctatcgttctatccttgtggaaaaattagtcacaggcagaaaatttcgagaaaatcgcgttcgaacgaaaaaaacccggctttttacaactggccaaaaatgggttgtaaaatgtgtgttttcaccttatttctcgagaaccgtcagagctacgcttttgcggtaagcgaacaatttgtagagctcgtcgagaggaagggtgagaaaaaaaattcgtagctctacgacaaattcgaacaaagttataccccggcaaaggtcgaaaaaagccgattttttttgtattttcgccttccggtttacaatccgtttacaattgcaaattcgtccggaatgtccggaatttcgaccgaccggatggattttgtgtttttgcatgtgttttcaaccggtttacatgtgttttcggcatgcgttctttaaaccggttccggtttttcacgtgttttgttcacatttacgtgtattttcgacacgtttgcatgcgggaagaacatttcacgtgtgttttcgttacattaacgtgtgt

SEQ ID NO: 43723 - DNA, 996 bp, Heterodera glycines
  misc_feature (126)..(126): n is a, c, g, or t
aaaacgacagctgttcatcaatttgtaaggcttcacatatgtaattggcatttctcttttataatttttaaaaatttaattttttttgtccataattttcgacatctccctatttttgtcatttanagggcgatcttctgtccatcaattgccatgagcgcacggattcgtcggatttgcttggaagcattcgtcccataagtgcggaagaagggggcggcggctttcgttggcgggatggcattgtgctgcaggcaatgcgccgtgggcaacggttgttggtcgatgaaatttcgttggcacccgactcggtgttggaacggttgaactctttgctggagccacagcgtgccattctgttgaccgatgcgggcgccgcgcatcaaagcgacggcactgacagcggcagcagtagtgccattggcggtggtgagacagtgacagcggctggcggtttccaactggtggcaacaatgaacccgggaaatgatcatggcaaaaaggaggtgagtgagaaggaaggaattaattttttaccactttttcttatttgttgacaaaaataattgatattgactaattgtgcgaaaaaaagttgttgtattttcaagttgccgactacactcaaccaatccccgtttcttttttcatcacaatgaattaaatatgaaattttgaaggaaactgctttttcgttccaaattttcgggtgtgaaaaattctaatgtaaatgaaaatgggtataaatcagggatgggccaaattgaaaaataaaaagcgaaatgcgaaaagctaaaatatgcgaaatgcgaaagcgaaattttttctacaactttttaatagtttaaagcataaagcaaaaatcatttttttaaattttattccaaatttaaaaatcaatagaacgcttttttgaggctcgctttttccaaaaaaactttttgggaagagggggcaggcgccgccggaaaatttttgaaaatttgattaaaattt

SEQ ID NO: 43724 - DNA, 858 bp, Heterodera glycines
ctccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgcccccgaaaacaaaaaatcgattttttcagtgtccgttttgggtactcaaacattatggggagcaaaaatcaacgcagaataaagtacagctataggaagctactcccgaggatcggtctcccataatctgggccatcggtccgggggactgccccgaaacaaaa

SEQ ID NO: 43725 - DNA, 475 bp, Heterodera glycines
tttttattaatttgctttttttttgtttagacatttttaaggtgaattattgctgagtaagcacagtttttcccattttcgttcataaattgcatgttttgtgctgctaacattgtcctggagaggtcaaagtgaccataattattaatttggacatcacataatgggatttgtgagggttgcggaaaaagtgggggggggggggtgggcatgtgctaacaaataaaagtaagaaatgtcgagagagagacattggcacaaaaagaattaacagtaacagagcccagtcgagacgagaccaaagaatgaatgaatggcccaaaaatccgagaagagccccccatcggtaagaactgtcgaaaaaggggacgaagtgttttgacttggaccctcccatgaagaacaatggcaagtggaagtgcgcggcgcgtgacctttcccccttcgctctccccttccccctgccccccccccc

SEQ ID NO: 43726 - DNA, 961 bp, Heterodera glycines
atcaaaaaaagaagataagccatttttctagggataacctctaaatataaaaatcctcttgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataaactctaaatataaaaatcccctcaaaaataaaatgtctattgcgcaccgccctccctatcatacgcgagagcatttgtgaggtataaaatttatcaaaaaaagagatagccatttttctgggataaactctaaatataaaaatcccctcaaaaataaaaggtctattgcgcaccgccctccctatcatacgcaagagcatttgtatgtgtataaaatttatcaaaaaaagagatagacatttttctgggataacgtataaatttaaaaatcccctctaaaataaaaaggtctattgcgcaccgccctccctatcatgctcgagagcatttgtatgtgtataaaatttatcaaaaaaagagataaacatttttctggggataaagtataaatttaaaaattccctcaaaattaaaagg

SEQ ID NO: 43727 - DNA, 1155 bp, Heterodera glycines
tttttgagtatgaccattatcaaaaaaaaagttaaaatcaagtttccatagaccataagctttagttaatcccaagaacataggtattatagaccaagtaagaaaaaagttatggcctaagaaacgggatgatcattcacgggacacataatctgccacgggacgcataaaaccgactagaaccaaaaatttaggtttaaaaattttccttatccgaaaaaaattatttaataatcatttaaatgaccaagattaagttctttgaatacctttaacgtgtttgctccctaaaaagccttaataaaaatttttaaatgctttttacatgcctttttcgtgacttttttcaaatttttggtgcctttttagtcggtctctacaaataaatttaaatttaatcatatgttttttggcaaatttgttgttttttacagaatttgtaagaaaagtttttgtcgcatcaatgtgttggccaaggagaataaatacagttcggtagcaattggcaaaattttcgatcagtaccggtaaaatcgattttatcccaagaaaatattattttttaatttataaaattaagtgccataatttttaaaagaaaaaaagtaaagaattttttttttaaatctaagttggaaaaccttcgagctaatcacaaaatttgataatccaatttttttaccaaaaagtattcaattacatatgtatgtaatcacataattttaataaaatgtcacattaacacatcatctcgttgaccactccctggcagttgaccacgggttgaacttcgccagttacagctgtgtccatccgaccgggtctttgttctgtcagtgagatgaccagtgtcgtggccgcgccctatttgggaaagaaaaccttattttgaaaaacactcatttttcaaaagataacataaatcaataatttaaattacttaaatcgattgctttagcttcattttactgggaagcagtgtattttttttagaaattttggcaatttatagtttttcactattttttcctgagctccccgtggcctgaaatgcacgaaaaacatgtttttttcgactgttattaagctacttttcgagttattagcaactattttatagttctttatttttagcaactaaaaaatataaaattt

SEQ ID NO: 43728 - DNA, 1241 bp, Heterodera glycines
  misc_feature (54)..(54): n is a, c, g, or t
  misc_feature (138)..(138): n is a, c, g, or t
  misc_feature (175)..(175): n is a, c, g, or t
  misc_feature (213)..(213): n is a, c, g, or t
ttgacgtttgccaatggaattgggtcggtgtacatcttttccacccgcctcgancctggtccattccaaggtctaagaaaatttgaaattttattattagaaaaccaaaggggtgggtaataggattcaaaaaaaggngtcacggaattttctcagtttagtggacccaatcggngtgtgtgtagttaagttggggtaaaaaaacaagagggngatgaagcagaatttgtggacagcaaccctgtgaaatttcacaaaccaaaaaggtcacaacttatggccaggggtccataaaactggaaaagtgctaagggcacgaataccttgaaacatcgtgttgagtgtggtggagagacggatcacattgcggtcaacctcaaacacctcatcgtcgttcgacttcagaaaaaattttgacgctgacatttgcaatttagggaaatatttagcttaccttaaattgtaacaatttatttgttttttgtgaacataatttagtgttgtctggttatgacttatgatgtattttataactctacttttcttcgactatatttgtaaataattttttgtttactgtttcgagcacaaattagttatacaaaaacttctgtatactttaagctttcaattgataccaagaatgtggcctatatagtcattgctgggacacttaatctgtgatttgacgcgtaaagttttgattggacgcacaaaatggattcgatgcgaaaattgctaaaacctattttatttgtgccttacaattagactgaaatacatatttttgcggttatttcggtaaaatgcgaaaagcacttaaaacaaatgaatttttaattgaagggaatgggaactcacttcagtattttctttttgctggtgagaatgtgaatgagaaaaagtaaatgaatgaaaacgtgagaatttttgatgaaaattttatttggatggagacacaatgccaataaaataaaattcaaatttgactgaatataagagcacggcgggacggtggggtcaagttgttgactcggtcaattgcgcatgaacaaagtttcaatgtgcttcttctttcaataaatttatggcaaaaaaccaaattttcacgagcattttggccacaaatttaatttgttgttttttgttgcagatccgacaatttattacaatgtttcccggattattcactttccaaaagagtaagaggcctttgtcccttcttctggacttttattatt

SEQ ID NO: 43729 - DNA, 1131 bp, Heterodera glycines
ttaaaattttgcctattaaaatatttattaaattttaatatattttatattttttcaaaaatttccggtttccgacgtttttggggtcgaaattccattccgacttccgaaaaattcttggacctcgaaattccgattttcgaaaaattttttacccccgtaattccggtttccgtaaatttttggggcctaggaatgccatccctggtttaggccctatatcgcccagttggcatcacccatttggctacgcccgccgctggcatcgcccggttgatttgatcccatcggaaataaaagagtggaaagacgatcatggttcccacaaataattaatgttggcttttacaatgttttgaagacgtggaattcgcctgaaaaaagcgagtgaaagtcatgttattggagtaattaatgtgcaataatgcttgaaacacaaaataatatcgaattattccataaattataatgtttttcaaaacccattaattagaatatacaaattttaaatgatcgcctctcatttagaaatttaattaattaattttcgaataaaaaagaaaaataattcagattttctgctttgtaaatgcattttttggcatttttattttcgtttttctgttttgacttcgttttggcagatgaaacggacaaaaggctgaaactgcgcgtaattttccaccagaatttgccaatgcgcaaagtcaacattagattaaatgcaattttcaatgatggcaacgaaatcgtacagaaatatttgaatggcaaagacattgaaatcgaagtgccatcacagggagaaaagaaagagaaaattgttttgagattttcaattgttataatggcaaacgaagacgaaattaggcaaaatgagggggaggagaacgatgggacggcgacgaacacggcacaaaaccaaagccaaaatgccatccccagcccaagaaaaaaggccatggcccaacggcggagtgtcgaagtggcactgtacaagccgaacttttcaaaaaggtgccctccctaccaaacacacaaatttaaatttaaaattgacatagttatttatcccataataaatctttcaattggtctgacctattaattggtctggcccaaatcgaaact

SEQ ID NO: 43730 - DNA, 214 bp, Heterodera glycines
taacgaagacggcggtgtcatccatgctcaccataacggcggcggtggcctgacgagccatcataccggtttcgatggtgacggtatgctggccatactggaatttgcgaatgatcggtgtcagcaaaattatatccttgattagcggcgcgcaatcgcattgacgactcgacacgcctgtgactcgatttgccttctcactacatcctcgcga

SEQ ID NO: 43731 - DNA, 1381 bp, Heterodera glycines
  misc_feature (152)..(152): n is a, c, g, or t
caaacggtgtaacagagcgcgttaatcagaccatactaggaatgctacgaaggtcgacttattcagctgggaatgggacgaaagactgccttttgtagtgtttgcctataattcgacaccatcagaagtcaccggcatttccccccaccatntaatgtttggcaaaccaataaacttcccattggaacatgaattgaaattcagcgtaaatccgctttacacaatagaccaaaattcgtatattcaactttttcgtgagtcactaatgcaattagtggacgaagcgcggaaaaattcccaaataagtcgtgcaaaaatgaaagaacactacgacgcacaagcaaaagtcacggagaacaaattccaaatcggagacagggttatggtcatttttcccgggtcccacattcgatcaccacataaaaagattttgtggaaccattttggcccatttcgtattacggaattgaataaatcgacggcgaccgtaatcccgtccgataatccatacggtaatccaatgacagtccctcttgaacgattagtgcgcgtaccaaaggaattgccaaacatttgtacaatgccgaaagggaaaaacccctataagaatgttttaaatggactgataagtgtggccggattaatttgtcaagaaaacataaaattgtatggggaagaaaaattgaactctaaaccggacggaataattgggcaattgaggtcaattgcatttttaggcggtgaggaggagcacatggaaacggaacagacggacgacaaagaggcggagaccaacgaaagcgaaaacgaagaaaatgtagaggaaaagatggacggcaaagaggtggacgcgaatgggagcgaaaaagaagcgaatctggaagaagaagaccaaatttcggtcgttcaggaagaagaggagccgaaaacgctttcttggacattggcatgtgtcggagacgggcacaaatgctgctccgatgtggtcgtggccgacttggatgctgtccttgaccgatcaggcattgggctcacgaagatcgagaatccgctcaaagcgctgttggcaatgtttctgctgaagtctgaagcggtcgcatcggcatctgctgccaaaaagctcatttcgcaaattctggacacggatgccgattgggaactcgcaacatattgcagtgcccgagaagacgacgtcaaaaacggcacatttccatccgaatcggacgtggaaagcgttttgcgaatttggatcggccactgccaaattgcccgaaaagaagtcgaaaaatcggcatttgggccaattgcaattgagctgccccaaggcctatcacttctgcccgaaagagaaagagaaggcatgaggaaatcgctcgaaagt

SEQ ID NO: 43732 - DNA, 1037 bp, Heterodera glycines
ttttttttttccccgttgtccagtggggttttccccaaaaacgcctttctatttgcggttgagccctacaaaaggtcggtttgaaaattctgttttcagaagaatagataatctcagaaaaatgggctatctctttttttctacaccgttgtacatgggggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctcttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcgggttgaaaattgctttctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattct

SEQ ID NO: 43733 - DNA, 955 bp, Heterodera glycines
attaaatcccgtcccgggaattggacaccaacttttgtcttttgttgtagcgctgaataaagcactaatagtgtgtttgaaaacgcacgaaaaatagttattgacaaaaaatggctatctctgaaagtcacgattaaatccctaccgtgaattggtcaccaacttttgtcttttgttgtagcgtgaataaagcactaatagtgtgtttgaaaccgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttttgttgtagcgctgaataaagcactaatagtgtttttgaaaccgcacgaaaaatagttattgacaaaaaatggctatctctgaaagtcacgattaaatccctaccgtgaattggacatcaacttttgtcttttgttgtagcgctgaataaagcactaatagtgtgtttgaaaacgcacgaaaaatagttattgacaaaaaatggctatctctgaaagtcacgattaaatccctaccgtgaattggacaccaacttttgtcttttgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaataaatggctatctctgagagtcacgattatatcgctaccgtgaatcgatcaccaacttttgtc

SEQ ID NO: 43734 - DNA, 983 bp, Heterodera glycines
  misc_feature (411)..(411): n is a, c, g, or t
gggggggagatttcaaccgccttcaaggtgtgggggctttatttcagggggctataatataggaaatacggtaattgaattttttttttataaattctgccagggctacctcgatgcacgctttggcacattctctgaccaaatatgacgcccgaggggggctgttcaacttgagaaccttaaaaaccaaaaaaaaaaaaattaaaaaaaaaattaaccaactttcattcgaaaaaatgtgatggaggtgagcaaatcgacggtggacttcaaatcgcgcaactttgccgagttggaatacggaaaatttttctaaaaaattaaattaaatgtttgtaatttaaatttgtttttttttagctaattgatttatttaacaattttctccaatgctttaaactaaaaaatttntaaatgaaatttcaatatattttcaatttcaattttttatgaaatttatttttaaaatttatatttttctactgatagtttaaaaatttttcaaatttaatttttttctccattcagtataaaaatgttcccaaatttttataaaagtatttcttcattttctatattttaattttcaaatttaaaaattgttacaaaaattcatataattcctgattcaaccttctgatttaaatttcaaaattttaactccatttgaacaatttgtaaacaaattttccgttttacattaatagatttttcaaatttttctccattttaaacaatgcgtaagcaattctgcattttcccccagtgttttatgtttttcctccaaaatgcttcatctccccacggcatggcatggcatgccattttgtgccagagcacacctcctccctcctctgcatgaacatgttcgtcaacacttcggacacgcgttccagtgccgggccgacgccgtccggcgccgccggactcgagtggcgccggcccctgtcgtccgcgccgtccagcgccagtgccgactttgg

SEQ ID NO: 43735 - DNA, 1403 bp, Heterodera glycines
  misc_feature (43)..(43): n is a, c, g, or t
  misc_feature (241)..(241): n is a, c, g, or t
  misc_feature (251)..(251): n is a, c, g, or t
  misc_feature (271)..(271): n is a, c, g, or t
  misc_feature (1369)..(1369): n is a, c, g, or t
cgacggttcacgcacccgctagtatatatgttatataggtttngagtttcgttgctaaaaacattttctcccgggccgaaggccggggagcgcccctgaaagtagtggaagggtcttacaactttttgaggagcatccgggaaaactatagagaaaaattcagcgcggacgactgagtcccggggaccgatttctcactttttcttgcagtttagggcctgtaactttttttctaaaaccncgaatcaaanaagtgcccggctgtgagggncactcccccccccacccgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcatgagcgggacatttgagtcccgggtccataactcgttaggggttggttttatcgaaaaaactccttcgggcaaaattgtagacttttttaagctctatcgaatggtgtgccatatggccggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgaggtttatttggttttataatgttcaaaagaaaaaaagttattccagaatttctggaaattttcgatttttcagaaaaaaattcataactcggttctgaaaggtcatactgtaaaagtaaaatactacaaaaatccgcaattttttcctctataatataaattttattttacatttttatatcttttttgcgaattgttataaaaataaaagtgatttttggtttcgggaccataggggggtgaccaggatttttgggtggaaaaattttttcaccgnaaaatattccaaaaacatgtctttaggggtattt

SEQ ID NO: 43736 - DNA, 1593 bp, Heterodera glycines
  misc_feature (48)..(48): n is a, c, g, or t
  misc_feature (139)..(139): n is a, c, g, or t
actcgccctcagatttgtcaaactctaaattgaattgcaaataattgnatatagtgaaaaattgccattttacttttacttgggaatgctttctttgatttggtcgccttttttgttcctttcacgcttcccaaagctntggcttctggcaatccaattgcttcaatttcgctttggtccatttccatggcgaattcaggattctaaatgagtattgtcgaggattcgatttaaatggccatgattaaatcaaaaacatacctttttcaatgcctcatttggatcatagaccagtccccattgcacttaaattttgccgcgatgatagttgggtttgccatgcttttttgatcaaagagctaaaagtattaaaaaaacgacatgaattaattgtatctatttgctgagcttgttgatctatgtatttgaaatgaaaataaaattctaaatcgaattccaaatttctgaaagaggaatttcaaaaaaaaattaaaataatgtgagaccatcagcaaatcgaatacaacaacaggaaattagcaatttaaaacttcaatatttttaccatccagctatgttcctttgctttttcttctgttttttgttttgcctcttaactgctgacaatttgtatctgaatcgcattcctttttttcctccatgttttactgaacgcattgttcttaataaattgatctgaaaattagttaaataatttgaatacctatttatctagtaattttacaggtaactaattggggtattcatgcatagagtaaattctgtttttctattaaaagaagagataatacgccaaactgagagaaattattatgaaaaaaagaaaaagcagagaaagaattagatttcttaaaaatccctgttttgagtttgagtgtcaattttttgagattatgattttttcccctaaaataatgtttttcaaccgcaaattctaactctatcattttagtagttttattttcccggtcaattttagagtaaattccctataatgcttttctaaagttgaaacagtcgaatctattgaactttgttaatttatatttttttcccatataattttagttaatctttcaattttagttaaatttttctcatacaaacgaaatgcctttggctgaagatttgttgtatcctgatccgcaaaaggaacgtcaaaagcacaagctcaaaagactcgtgcaacatccaaattctttcgtatgcattattataaataaattaaatactgtcatcccttttttaagtttatggacgtcaaatgccctggttgctataagattactacagtgttcagccatgctcaaactgttgtggtatcgatttattcttgccaaataatttagtgatttaatgagctaagcaaatgaatagtgcacactaagaccggtcataaatgagctgtgttttgtagaaatttgcatacatttctaatttaggtctgtgttggttgcagtacagttttgtgtcagccgaccggcgggaaggcgcgacttgtcgaagggtgttcgttccgaacggaagggcactaagacaatgagacaataataacgggaaggcgatgctatc

SEQ ID NO: 43737 - DNA, 975 bp, Heterodera glycines
atttttatatatttttaacaatgaataaatgaatcctttaaatagagtttttataaaataatggtttagccttgccaaatgaaaatattgttatcctcaaaatgctaggtttattcttcttttataaatttaaaatcgagctatattaattattttaatttgttttttatcaaagatgtttctagttaggcatcgtccattaatttatttttccagttgaaaattgtctttctttgaaaaatctttccttttaccaaagttccttaagaatggtttaccaccaattaatattcaataatttctttactaaatttttaattaatttttttctatttctaacttttttaaaaattttaatgctttcctttttactcattaaattatcattaacttgctagcaatcaattcattaaaatttgtggcaaagatgaggggaaagtttattaaattaaattttaaaaattattcagtggaaaaatatctatggccatatgcttttaacattaaaaaaataaataaaatttatattgaaataattttatataatctatttgagaaataaatagaaaaatggatttttgcgaatgcgaaaaatgcaaaagattgtgaaactggcataggaggataggacggaatgacctaattggttgaaggagtgctcaagtgaagcgatgtgaccgcgtcgtttcccattaattttcagagaaaagtgagaaagagagaaaaggggcaaagaaaaagagaaatttgaaaaaattaataaaaaacaaaaaacaaatgcgatatcctaaacttgtaagatttgtcctgttttcgagagttatcaatcgacccaaattgtatttatttattcacgagttttttaggtaactgatagaaattaccccaaaaaaaactcaccgaaattcgcgaaaaatatgaaaaaaaacatattaaaattatctcgaaaatgtgcgcaaatattttttatgaaaa

SEQ ID NO: 43738 - DNA, 585 bp, Heterodera glycines
cgtatatgctctaattatagcccatgggggattattcctttacctcctcagaaaaggggggataattagagactgggggattatgatagagggattatttttcaaaacacctcgtagactggggataattggagactgcgggattaatagagactgggctataattagagcatatacggtaattgacaatttttgtcaatggttaaattgttgaatgtgaatttttcatgctaatgaattgttttgttatttgacgtgttctataaaataaatcccccgtttccttcaaaagggcgctttagggctttatttggggggggtggctctattttagtaaataatatgagttttttcgtgttaattccgagtgatcaacaatttcaaattatgcatttgtgcttactttatcaaatacttttcacactttttttcgcttttattttgcttttttatcatttaatgagagtcggtcgctgttttgaatattttacctttttttggtcggcttttccctttttgcttttttgatgctttgtaatgcgatacccccctaagtatcttctctcctctgttggatcctatcga

SEQ ID NO: 43739 - DNA, 1448 bp, Heterodera glycines
tgtggagatgggcttagcccctaaagggggaaatgtccttctgagaagaattgggcctaccgaaaggatttccttgcaaacgtaagcgatccattcctccttcaaataaccgccttcgaacgatttgatcagatcggtcaccgatccgccgccgcaaaattccatcacttaacggaaagactcgaaatcgccggagggggcgagaaaaccgagccaaagttggtcatcgtttgccagttgaggagggcaacttcttgatgaaggcaccgtagtaagtggcgatgtttgggtgatgtgaatactaaaaagttgcacgttcatccgtcccattagcccacttaatgtgcgattattggcccccttttctctgccatttaatccccttttatttagccatttctttcccctttttggcaatttttcctcctttctgatcattcctcccttactttttgacaattttctcttttttggccattttcctcctttttagccatttcccctcttttttgggcccttctttttgactccctcccaacctttttgagcatgtttatttccgctttgatctcctcctcctcgtcttcgtttatgttcattatttttattgctgctaatgcctgcgttttcaaatgccgtcccttaattggtcaaaattagtgtcagattcattataagcgactccgaatttttaaagctttttaaatttgggtattaaaaaccttcaaacgagtatccatttcattgccaagacgtaacgattcgcgtaagtagtaatgattaaacactgcatctatccggatttttgtcatttttcctaaaacgaaagaattaaattcacgtttattgcccaaaatcacttttaggggttttcagggtttaaaaatccaattctgacacccattttaagcaattcgaattccgaacgaagattaagaacacaaaatagtttaacggtggtgattttgattttgcattatctgtttttggtttgttttttaaacatattgttttgtatttctcactttggcgtactcactatgggtacgtcccagtgttagacagggttgcgatctgtcctgatttatcagatttgtcctgatttggacgtggtgcgacattttgaggacttgacatttgaggacccgacatttgaggacccgacttttgaggacccgacatttgaggatttgacatttgaggacccgacatttgcggatattcccgacatttgaggacccgacttttgaggacccgacatttgaggatatacacaattactataaaaatgaaatgaaaattttatttatatcattataaaaaaagagaaaaacctatttccccgagggcccggggaaacaaaaaataaaattgtaccaaaatgcttggtaaaccccttatcaatcttttgatatttttggaaagtttcatatttaaaaaaaatttaa

SEQ ID NO: 43740 - DNA, 1008 bp, Heterodera glycines
  misc_feature (967)..(967): n is a, c, g, or t
  misc_feature (970)..(970): n is a, c, g, or t
gtcgatttacccagtttaattaaatttggaatttccctagattacttttaaaacattatgttacttggtggtcttggaaaataccttttttggtgaccactttcagactcggcactccaataattccatgctgagacgttccttaaaactgccatcatgtgcaataattaaactacaaattaaaacaactatatagaaatacttgttgatataacaaacatttgtaaattaatatacattaatctccagtattctttttttttattattccttaaagtgttccccaaaaacacaagttactaaaaaaataaactatttaaaatactaattgtcatgtatcatgtatgaggacttatttgatgggactcaaatgaaatatttcaaatttgtctcttaatccccgactcgttgctgcctatttaaatgctgcctttccctcctttccccgcagtcttcattcattcatttattgttctcaatcatctccacttttgacccttctgtcgcgaaagcgacgagagtgcgatcggaagcccaatgttatttcccttttttatgtcctttcatcgatcctcattctttcaccaattttcactattctctcgtcctcccattttgcccctttttttcttcgtttttacaattggactttgagcccttctccccccgggttggccaacactttgtttttgtcacccgcctattaggtttttgaattgcgctctctcctcaatttttgatcatgaatttcccattcatttgcatttttcacacttttgctccttcccttcacccgcctttgttcgtgcctctcttttctcacttttctgctcagaattcccttttcccaatttgtgctccttttttcttttgtctcgtttggattttgtttctcctttcgctcgcatctcccgtcccttcctactataccccattactttaccctaccctctcccttatataattnccntttgcttctcttcttcaaacttcactcttcaccttttt

SEQ ID NO: 43741 - DNA, 945 bp, Heterodera glycines
ccgtgtcccggctgagcttgctctggctgatattctttctaagctcatccatcattcgggtctgcccgatacgctgggtcgggtcaatgtagttttccggataataaaccagccgcgacaccccaccccaggtgctgtaacggatattcatcgcccagtcggtaaagaactgacgggttgacacatcggcacgggcattcgattctatccggttcagcgcccggttgatgtagagctgaataccggcaatcgcttccgccagtcgggtagtttttatggcagaagagacctgattatcaatcaggaagtagctgtacaggtcatcccggctttgcaggaatatcccttcaggctggatattggccagaaaccaatggcacagcacactactcaggcgctctgcggtatgatctgccagtgcctgagcctgttgtgtactgagcccggcttccatattttctgccagggtctgccattcatcccaggaaggcagatccgactcggctttgttcggcacagtcacgtagcggatattgaccagcctacggataaccgatggcatggtgtgcaattctgaggccacatccatccattgcagcacggcgttgatattctgccagctttgaagactgctcacgtcagcacaggctatggcctgtgtcaccatactgatgtccagacccatcaccgaggccagtctgtctgccgtcagcgtttgctggcgcagcatatccagcgtgtcagagctgaggttacccagtgcgttaatccactggtggaatcggtagagtgagaacagggtatcgatattgtgctgtccggcgggttgacttctcacacccagtaccgtgaaaccggaaatgaccagtacggacagctcggcttcactgagacgcaacgtctgcacggaaagcgacaactgagccatcacatggcagaactgca

SEQ ID NO: 43742 - DNA, 1502 bp, Heterodera glycines
  misc_feature (1495)..(1495): n is a, c, g, or t
ttttgaaactgaccgacgggtcgcataaaaaacgatcggtcgccgccacttttgcgttggtgatgaaagcgtcctccgcagtcatttcgatgcatttttccactaataaaaaagcaagagaaattacgaagacacaaaatcacaaataaaatatttcctttaaatcagtattttagacattttggtaagtattaaatttgatgtggacacttttaacattatacgtacaaactaatagaaagtactttataaattaaaatatatgtctttatctgagaacttaaggaaaataattgcaaatacaacacaaaaataaagtgaaaatgtgtgaaaaaaatgtcattctactcgcgacggaaaacagaaaacttcttgctcttcttagtctgcacaagaatctcgtccatttttttgcacacttcggcaaattggtgcttcatgtcggtaaactcgtgctcaaaccggcgattgacctgagcagaaaataatgcgaaatccgttttcgattcaccgagctaagcacgaacttggccaatttgggttgtcaaatccaactttgtatcggcaaactgcagagccaactccgactttgtttgcgaaaactccgtacgaagttgggcaatttgagttgtcaaaaaatggtaaatggtgagtagaatgataagtccactaagcaaggggacgatgaatggcagtagaatcgtcaaaaatgtccgcgcgttttgcagttcaattgccagtgctttggaattcaaacgttcatcagcatatttcgatgcatttcttaactgataaaaaagaaagaaaaaaagttctttgacgcgcgaaaactttttctggtccctccgaatcactgaatttagggaaaatgaaatggtcacagccaaagagataaagcaaatgcaatataaacagactaatttgacatgtacagcaacgaaaaacgaatccttcaaacatacggactattatttttcgatttttttgtaaatataatctctttgatatgctgggtaaaaatcagctattttatcatattccgtgacaccaccacccaccccctttttctttttaaggttagaacagtctttccgtttgccatgccaacaccgcccccgtctcacagtaatgaatgtcctccaagttcactcggttcggcttgccaacctccaacgctttgcggcacacctccttcacatattcgaccacaatttgctcaagtgcctccaaagtgtcgtcgtttgggttcttaataactaggggaataaaatgtgaaaaatccctaaatttttttcgcactctttcgtccccaaaaccgaatagcatcgaccgcagctcctttctgaacaaatatttgcgctcctccggcgtctttttcttcgcttcttcatcctcctcctcttccgagtcgaaaagacacgattcgtcgatcatttagaaaaaccaaaaaggaaaaacacggaaaaaacaaatgaaaataaaaataataaatgancaaggca

SEQ ID NO: 43743 - DNA, 1358 bp, Heterodera glycines
ccctttgtttttccattctttactgatcggtgatcgcagttcagtctttttcctcctctccttctgctcatttctcctaattcttctcaaacgtcaaaatgctttctgaaattgtatgtgtcaaataactattaaatttaaatttaatttaatatttggcattgcctcctaaccaatgcttttttttctttacgatggttttttttttcagccgcttccccaccaaaaaggcatcgtcgaccctcgtcttccctgcaaaattcaaattgtcggccgtgccaatgacgtcgcgaaacgtttcgaagtgaatcttttgtcacaaacaggcgaacaccttctccatttcaacccgcgcttcgatgttcgtaaaatccaaagatcgaccgaagaagtcccttcaggaacattgcgtggtgcgaagcagcacaaaagacggccaatggcaagcggaagaaaggggagggaccaatcccttcgtggccgggcgagcctttctcgctcgatctgctggttgagcaaggcctaattgaggtgggtgccggccgtttcggcccccaaattcgcccgtggcttcagtgttctgtgaatggcttccaattctgtgaatttgccgcgcgggatgacttctcccaattgggcgctgtttccgttggcggtgacattcagctgaactctttggaagtgtccaccgccgagggtcccgcgattgcccatgaaggcggcgataaggggccgcgcgaagctgacgaggaaaatgcgcaagaacagccgcccattgtgatgccggcccatcccgaaccgcaaccggtgccagccgaaccgactccccagcagccgcagcctccaccggcccaggggccgctggtcagtcacacaattaatccatttaggtatgctgtggacgagggtatattcgaatcattcgcagtcggtgccttaccaagctccgctccatgcgttgcttcagactaaccgaatgcgcgtcgtcggtgtcccccgcccgggggcacagcgcttcacagtgaatttcaaaacgcacgacggagagacacttttccatttcaatgctcgctttgatgttagagacaatactcttaagaaacggtatggtcaatttagcaaaactgtgtggtgcgcaacgccagcgtgaacagacaatacgcgccggagggggaggagcgcgaggggacgggctgcccattcaaagtgggcacacatcaaacgacgcccactcattcatccctttctttcaattagcctggggttacttttgcattggattttctcatccacggcaacgtcattcgagttaacgaaatgcataatgcatttgccttcgttttttgcttttcagacct

SEQ ID NO: 43744 - DNA, 901 bp, Heterodera glycines
tttggaaattggctatctctttttctgctcaacagtactatgaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaatcaaccgcattctatctcattttctgctcaacagcaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaatagaatccaaccgcattctcagaataattacgccgatactaattgttctgcgatttgattctctgcgcgt

SEQ ID NO: 43745 - DNA, 1018 bp, Heterodera glycines
tggttcaagaaaggggcattattcataagattttccaaaattgcgcgaaataaattttttagtcatgaacagaaaagtaccgaaataacttaaaaggagagataacccatctatttctataaaaaatgaacaaaaacccagccgaattaaaagtaataaatattgaaatatgatagactaacttgtaagagattgtgccgtgcagtcgtgtcttatggtggttttgtcaaatgatctatttttatgttctatagaagcctatgaaaaaataatttaaaaatatatcttggccattttgcactttttaccggatgtacgtgcagtacagtagcaattggtgggtcttcccgtgccgcagtctgtccggttctgttggatacgtgtgtggtgatctcgaatggatcgaaatggacaccatattcgtgatcatcgaaactcccaaaaacccaaaaaacttgtttctatagcaaaaaattttttgaaaatttttttttcaaaaaggggggtaccatcgacacagtattacccgagtgagaattgtaaggttaaaaatattaaatgttaattaggttatatatagtgattatcgaatgctgaggtgaaactttctatgcaaatgttaagctaagcctactttcgagttttataacctattttctaggctgaaaacaagtacccggagttttcgagatcgctgatcacgaatatgataattattttagcatattcagaaccatgaaccaaaattcgaacaaaaagtaataattttgtttttttgtttgaatctgaataaaataaatattttttgatgtttcaattagagcccggaaatttcaaatatgcggatcctgttgcaggattggaattcaaaattttttgcaggaccggatccggctggactaatcaagcaaggctggaaatccggcaaatccaacatttaaaatttttcggctcctctaaatttaaaaaatttccaaagtctataaataagtgtaaacagatatattattagtctaaa

SEQ ID NO: 43746 - DNA, 1047 bp, Heterodera glycines
  misc_feature (88)..(88): n is a, c, g, or t
  misc_feature (90)..(90): n is a, c, g, or t
  misc_feature (92)..(92): n is a, c, g, or t
  misc_feature (127)..(127): n is a, c, g, or t
atcagatgacttttataatgcctaactttgcctattttgaagttttgtgcctaaggtgcctatcttaggatttttgaaaaaatccttnancnaaaatgcaataaaacgaaaacacacccctaaaganagaccaaaaaaaaatttcagaaaatacatgggactaacccaaaaatggtttttttggtaagaaataaaattttaatccaatattttttggaacttcagcgtttttagaaatatagtaagattaaatttttattcgttataattataatagcttcctcaatggcttatttcggggtgcgctacaaaacgtaagagaaaatccatgcccgatcgagacccgattttgtactcaaaattgatgagttgcttctgttgatttttaagaaatccttcatagcctaatcgcaaattcaacaaggcataagcaatgtaaaaaattcaatgtttttaaaaattgtctcaccacatactgtatatgattattataaagttttaatataattttttttattaaattgaaaaatgaaaatattatttttcgtaatcaaatgttcatttgccgttcactgtgccaaaatgaaaaaattgcaagaatatcttgacttatacgatgtttttttctcgtggaccaatctcgacgaatatggtaccaatcgatagctctcgatgagatagatcgatctagggatggtggaagttgatccgacaagtataaaccgggttttgaaccggttcaaaactcgaaaaattgagagattgggcactataactttttttaacgatcgaatcatgacaaatttggtatcattcgaaagctcttgacgggctaggtctaaaaatcagggaatgaagttgaacggatgccatctgacaatgatagatttttgaacaggttcaaaatcaatgaaatttggcgcaactacaaattaaaaaatttttttttgcttattgcgctaaaaaaccgccgcacactcgactacggtggccagtagttggggcgagactacgggcttcggaagaagtccgcgcgagatccgcagg

SEQ ID NO: 43747 - DNA, 1159 bp, Heterodera glycines
aaaaaaaaataaaagcattataatagaaaaaattgaacgttttttttccgtttcattgcttggctttttattggcttctttatttaatataatcgccagcttttatttccttatctttaaaatttatttttatttatcatggcttttcgtttcttagctttttcgattctttttcattttcgcctgctttttttttcttagctttaaaaatgtttttcatggttttttcattttcgtttgcttttccttttaatacgctcaagcttttctttacttagctataaaatttttttaaatttttcatggcttttcgttggcttttctttttcgcaggcttttattttcttagctattaaaatgtttttctttttcatgctttttgttggcttttctttttcgcaggcttttattttcttagctactaaaatgttttctttttcatgctttttgttggcttttctttttcgcaggcttttcttttcttagctattaaaattgtttttatttttcatggctttttgttggcttttacttttcgcaggattttcttttcttagctttaaaatttattttttttttcatgctttttgttggcttttctttttcgcaggcttttattttcttagctattaaaatgtttttctttttcatgctttttgttggcttttctttttcgcaggcttttcttttcttagctattaaaattgtttttatttttcatggctttttgttggcttttatttttcgcaggattttcttttcttagctttaaaatttattttttttttttcatggcttttcgttggcttttctttttgcaggcttttcttttcttagctattaaaatttactttttcatggctttttcgtttaagggcctggcttttggtttacttttctttcttttttttttttgcctgcttttcttttcttagcttaaagttttttcatggctttttcgtttcattaattgtctttacgattcgtttgcttttctttgcttttctttgttagattaattaattaattattaatttgttagttagtaagttaaaataagcataataaaagcacaaatataaaaatattgaacagaacaaataaataaaacggacaagaaatcaatataaaggggagaaatggaatgaaaatgatgggt

SEQ ID NO: 43748 - DNA, 1027 bp, Heterodera glycines
  misc_feature (1000)..(1000): n is a, c, g, or t
aaaaatggtgtaagtaaaaatcgtaattacgctcaaaaagcttctcaaacaattttagcgcatccaattccttctacaatcgcctttatacatcccattatgaacgctaaaattatcagagtgccgaaaatcctgtaatctacgcctagaaaaaaatggtgtaagtaaaaattgtaattacgctcaaaaagctcctcaaacaattttagcgcttccaattccttctacaatcgcctttatacatcccattatgaacgctaaaattatcagagtgccgaaaatcgcatgtgatctaagcctagaaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtaatctaagcctagaaaaaaatggtgtaagtaaaaatcgtaattacgctcaaaaagcttctcaaacaattttagcgcatccaattcctttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacatcgcncttatacatcccattatgagcgctaaa

SEQ ID NO: 43749 - DNA, 1048 bp, Heterodera glycines
cgtagaaaacgtgttctagtttctgtttggacttaggcctgaataccggcttagttggcccgaaataacaagagacccgtctaattcaatttaaactcataaaattaagtcttgaacagaccgaaccttgtaatcttataaattgtaaataatacatcgtgtatggcattgatataaaattaatggtaatgagtttagcaaacaagcacgcttaatcgagtgaatattcgttaagaaaactttctattcctaactttattaaatttactattgttttaaattagatagttgcaatttatagacaattaaaataatttttattttttaaatccttaatttggtgcccaaacttcccggtgcccaaatttatggtgcccaagcttccgcccccccccccttctttctaaatcttttaaaagaatttttggtgaacatttttaaatttttcgaaaatgtaccacaaaaaaatcggtaaagaagagatattaaaattaatttttgaatattaaaataggattttaagcctatttagatcattttattgatttcaacctttacgaagaagtatttcaaaaaaaaactattttaaaaattttattttcacagtttgctacatattttgagttttatttatacatttgttttttttacatattttatgtaaatattttgctagagggtcgagtaaaattttctgaaaaaattattaggttcacggaaagaacaccaattccaaatactaaaagtatggaatcaaatcatatgttcaatcagggaaggatgttacaatgtgtaagttttttgtaatttttaaagtcataaaaatttttaggtggttttctgggtcgctgatttcaaatatggtaccatttcggtcaatttctaactctgaacccgaattcgaacaaaaagtcgaaatttaattccgcattttcgtctaaaaacggtataagaactattactcaacattttttaaatgcctctatattgatttggcataatatatttaatttgaccttaacattaattctccggaaaactaaaaaag

SEQ ID NO: 43750 - DNA, 1544 bp, Heterodera glycines
  misc_feature (1486)..(1486): n is a, c, g, or t
  misc_feature (1497)..(1497): n is a, c, g, or t
  misc_feature (1516)..(1516): n is a, c, g, or t
aaactataaaaataaattagtttttcaatcaatggttggttattccctttttaatgaatttcgttatatcgttctgcaaggatacctaaaagatatggcaaaataatgttaagaaaatttattttgatgttttaggtgatatatatttttaaataaacccttttttaaacaagctcgcgggcttaaaccgtgcctacccctaccgaaaattaaaattaaccaactgaacaatcaggcccaaagaaattctttttattgacccataattgcgagactgttcccatccaataaaagaaaaaattatcgtaaataatttataaaaataataatcattcttaaatataatatttataggtttgaaactaaattctaatttttttaaacaaaaattttataaacagaagtaaaaaaattttcaattctaattctgaaattttttcggtcatttttaggggtaaaacaacgattcatcaataaatctccaaaatctattttcatcgatacgcaaaatacaaaaaatttgcagttataaaggaaatagtgatattcaaaaataatttaaaatatatgttaaaaattattataaataaaaggattacaaaacggccattaaaaaataaaaataaatgatttgctaattaatttggtttcaattaaaatataaaattgttcactccatcggcatttcagtgacaatggagcatgagattgaaattaatattaattactttaatttaaaaaataattggaaaacacttaacttactacaaatctccaaattaagaattatttttagtccaaaatcaaaattaagcaaaaattagatgtgtcaaaatatggattggtgcgaaaaaataatttaattagaatattaaaaaatgcaaatataattaaaagccaaaatgaataaatgcattatttttaatgataaagaatttattatataataattatatcaaaataaaacaatttttttcaagtaaacgatttaaaaaattatgatcttaattaaacaatactaattttttaaatgtaatttgcaagaaatatagttttataatttaatacacaatttgtaaataaattaaatgtgcagccacattaaataataaagaataaataaaattaccaaattattgttattttaattaaattaaattttataagaaatgaatgtacagttaatcaatttgaatttccaacaattttaacaataataatgtaattatgtgtgcaaattaagtttagaaggggatacttgataaataaaattgaatataattataatcataacaagcattgatttaacaaaaatataacttaatttttttttaaagattgaataagcaaccattcattatctcaacaaattattaatggaaaaaataaaacttctctacaatttatagatataaaatttaatatttaataaatcaaattcttaaggccattaaatcaaaatataaaaatttttaatcttcattanacttaatttanaaatttaaatgattgactntgtacataatgaaatgataagacacgtc

SEQ ID NO: 43751 - DNA, 1052 bp, Heterodera glycines
gtgaatgtgttaaataaaaatattttggtataattaatttgaaaaaggaatgacaatttggcgtttcgttggccgcaaatgtccgaccgcatttgtcgggccgctatcggtttttctgtgtttttcttttctcttgagatttggactttttatttccttttcgggaaatagagggaagggggggggagtaaagaatttccccgaaaattttttattgccggaatttgaatttcgactctcctggttcgagttcgaagtcctgttttttaaccaagagccgacttgtttgattcggatacaaatttaaaaactcaccatttggccaaatgtttcctggttcgtaattcgctaaaaagcaattttgtttttttttatttgaaccattcagcttcgtctcacctcttttttccagtcgactcgattattcttcctggaagcgaaaaaaattaattaaaatttttttttgtttcagaaaaaataagatcattctactgattgtgaaccaggagaggggacacgcgagggaacccgaacacatttttggggagaaatattggtactaaatactgtgctttgtccaccccccttttttcgaaatttttttttttgtttcatagtcatgaaaacatgtttccaagggtttgcggggatgcctgatcagtgctccgaatgtcatgtcacggaaacttgaggaagcgcgggtaatcggcgggagaaactatgactctcttaaggtagccaaatgcctcggcggctaactaccgacgcgcacgagtgaggcgatactcggaacctccggggagcctgttaggagttggcctacaggtcgcgaaagacgctaggtgctgcacgggttgcgctaatccgagggcgctgggataccttcccatcggccacaaacgtctgggtcttcgtaggcgcgggtgcagatatttctgttgagcctgacagttcttcccggatatggcgaaagattacagggcggtatttcgtgaaacctaaaaaaggtcgggccgaatggcacggacagactccgcttcgagagtgagctc

SEQ ID NO: 43752 - DNA, 1113 bp, Heterodera glycines
  misc_feature (131)..(131): n is a, c, g, or t
cagaatgtggtcatagaatagtgggtttgaattatttgtatttttatgagtattatgtaaggatattttcgactaaacataaccaattccgagtttcatgaggcatcacttcattcttttcttgtcctgcncaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttattagtgaccgcaaatttttacatactagccattttttattttattgtgaccaagcatatctttcctcgtatttctgggatttttttcagaatgtggtcatagaataggtgggttgaattatttgtattttttatgagtattatgtacggatattttcgacaaaacataaccaattccgagtttcatgaggcatcaacttcattcttttcttgtcctgcccaattgtctcaaatgtatacataaaaatgcgctaaaaatgatcaaacccgtttttagccgaatatcctgtcaatatttccctattagaaacgatactgtgaattcttgcgcctctttaattcattcgtgctttgcttcggattagtctaaaaatttctggacgccaattttacatattagccaatttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgactaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaat

SEQ ID NO: 43753 - DNA, 723 bp, Heterodera glycines
ttccgttccgctaattcctaaattggctcttgaatcttactttttattattttttgtgtattaaatgtattcctaaaaaaacaaaacaaaaaagtttcttctgcccttctatatagacttcaaaattacatatcaaagagcagaattttctaattagattagactcaaaagttacaaacatcggcaccgacaaagtgccgaaaaccgaaaatggaacggacactcttcggtgggggggggggcgttgggcgaagtgatggcacagccaatgaatgaatgatgccattttgggggatctctggtaaaataagccaacggcacaaatgccacgagataattgtgcatgcttttattgttgtaaaaaacccggataaagtttcgatgaaatgagattttgcaaaaataaaatttatcttttacccggggggaagaaaaattgaataaaatccttcgccggaaagcattatgccattccaacacatcgcctgaggggaaagaaacattttgccgggggggggggggggcaaaatggcgaaaaaagggacaaagtgccaacaaacgaaacgcacaaaacaaacggaccatcgaagaagcgattaagcggaaatttgagggaaaagtgggaaaatgtgaaaagggaggcgaaagggaacagacaaataaatgaaataaaacacattttgacgattttcgagtaaaaaaaacgggggcaagggcaaaggg

SEQ ID NO: 43754 - DNA, 865 bp, Heterodera glycines
atttgaatccaatgaccttgcgaggcaattgcattttcggaattggcaatgattttctattgtcatttgtaatttccatttgctttgtgccattctctccaatttttctctcaatacgaataattttcagcgcccatttgcgagttttgaagtgttcgtctacgtagaagtcaaaacggtggctgatcagcgcaattccgaggccaagttgagaaggagtaagcaaatcgaacaccgaaagccaacaatcggcggagatgaaactgaaaaagggggaaaacaaaattcaaattgaaaattggcattttaaatttaattttacattgcttttgccatcttttcctctccttcttttcggcggtctgacattttgttgagcaaattattaatgacagttttcgacgggtttatattattagcttaaaacattatttttaaaacaatttaaaatttcaaatcaaaagccccccccgctgtggtttttcgtcgggcccactaaagcactaaactgcaaaattaccgaaaagtttttgatcaaaaaatacttttacattttccttaaacgttggttcatatttctgaagaaatttgcagcaacaaaataaccgcaaaaatcaggcgaatgatgaatgaatggaatgaggaggaggaaaaggagaaacgggcattcttatactaaaatttaagcgtagcgcaccaaatcgaaaaacttaaagaagagtgccaattttgagaaaaagccatatatgtaggcaaaaggcatagaaaagtaacatttaatgtcataattttttgtaatcacaatttacgactacctaattaattataagtgtgtttggcctaattgctgcaaaaattttttttt

SEQ ID NO: 43755 - DNA, 952 bp, Heterodera glycines
ccaggtgttcatacgaggaatgttataattagagacgcatacaagccgtatagaacaacccacggtggattcctcggtattaatagtggtaaatttggataagataattcgctaatttttaatattaaaagcaactgacaaagtttgacgaaagaatgtcaaagcagagttcacaggtgttcatacgaggaatgttataattagagacgcatacaagccgtatagaacaacccacggtggattcctcggtattaatagtggtaaatttggataagataattcgctaatttttaatattaaaagcaactgacaaagtttgacgaaagaatgtcaaagcagagttcacaggtgttcatacgaggaatgttataattagagacgcatacaagccgtatagaacaacccacggtggatgcctcagtattaatagtggtaaatttggataagataattcgctaatttttaatattaaaagcaactgacaaagtttgacgaaagaatgtcaaagcagagttcacaggtgttcatacgaggaatgttataattagagacgcatacaagccgtatagaacagacccacggtggatgcctcggtattaatagtggtaaatttgaataagataattcgctaatttttaatattaaaagcaactgacaaagtttgacgaaggaatgtcaaagcagagttcacaggtgttcatacgaggaatgttataattaaagacgcatacaagccgtatagaccaacccacggtggatgcatcaatattaatagtggtaaatttggataagataattcgctaatttttaatattaaaagcaactgacaaagtttgacgaaggaatgtcaaagcagagttcacaggggtccatacaaggaatgttataattacaaacccatacaagccgtatagaacagacccacggcggatgcctcggtattaatagtggt

SEQ ID NO: 43756 - DNA, 738 bp, Heterodera glycines
  misc_feature (682)..(682): n is a, c, g, or t
  misc_feature (687)..(687): n is a, c, g, or t
cactatcggtcactagaaatcactattttggcgcttcgtcactaaaatagtgaaaaatcgctattttggagttttgtcactattttttcactatttcgacattttttgggaaattccttaacaaaaatgcaataaaaccaaaaaatacacccctaagaatcgacaaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatgtcactatttcggactttttgacactattttggcatttttactcactattttagttaactatttcgggatttttcgtcactaaaagttgcgaccctacttataatcaaacgaagaaaattcataattacaatttcacaagacaagacagaccaataaatgctaaacatcctaaaataacccactcactccggtaaatactccgatgcgaaggacgagtgactaaatcacaaaactataattaatataaattatttaaaacaaaccataataaaaaaaatatataaaaaaacacaatttaaaatttaattatttaatnccaancataattaaaaagttgaatttatacaacaaataaaaattaaagatggacaa

SEQ ID NO: 43757 - DNA, 686 bp, Heterodera glycines
aatctgcaagaaattagattggcaataagtggttgttcttacttttgggtaatgaattattttttgaagtgagtcaaacaccctattagtgctttgctgtgccgagaaccgcaggcaatggatagctttaaatctgcaagaaattaaattggcaataagtggttgtaaaaaacttgtgggtaaggaattattttttgaagtgaatcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccctattagtgctttgctgtgccgagaaccggcaggcaatggatagctttaaatctgcaagaaattagattggcaataagtggttgtaaaaaaacttttgggtaatgaattattttttgaagtgagtcaaacaccctattagtgctttgctgtgccgagaaccggcaggcaatggatggctttaaatctgcaagaaattaaattggcaataagtggttgtaaacaacttttgggtaatgattattttttgaagtgtgtcaaacaccctattagtgctttgctgtgccgagaaccggcaggcaatggatggctttaaatctgcaagaaattaaattggcaataa

SEQ ID NO: 43758 - DNA, 835 bp, Heterodera glycines
tctctctctctctctgtctctctctctctctctgtctctctctctctctctgtctctctctctctctctgtctctctctctctctctgtctctctctctctctctgcctcccctctttctctccctctctatcaattcattctctccgtccctctctttctcttacccacccaataaatcgcttccatcagcgaatgcgctcctttgaaagtgaatgtgtttgccaatttcttttttaaatatatgtctcattcggtttacctcacaaatcagttcggccgtcacggttcggcccaagcgtgtttttccactataactttctataacttttttctttggcaaccaaatccaacatttttggtatcattcgaaagcttaacatgtttagaagctttttctaagctattgcttcgcgattagacaattaccaaaaaagttagttatacaagaaaattgcgaaaagccgaaattttttaagttttttcttaataaaattttttccaggcttgaaaaaattttcgctttttgtaaggctaatagagcatgttaagagctttcgaatgataccaagattattggatttggattacaaataaaaaagctatagtggaaaaacacgttggggccgaacagtgagggccgaactgagcgagtccggtctcattacctccatttgtgatcaacaaacgcgtccgatgatgcgcttaattatagggaaatggtgacggggtgtactgtatgaacgcaccaagcatttcgttttgtgggaaaaagctggtgatgttcaggtgaggcatgcgttcagaaagtccatcaatttgagaaggggaaaggc

SEQ ID NO: 43759 - DNA, 1014 bp, Heterodera glycines
  misc_feature (963)..(963): n is a, c, g, or t
aagaaattgttttttattccctcttttcagctacagtatgactttttgttggctgctcctcccattttacggttggtttagctgggaattgtgcgattttttctccccctgctgggggaggtgcaccgttcctgactgtaagtgcagtgtcaggccgatgccggtgcctttggcagataaatccaccgcaagcaccccattttccaaaaatttccgaggccagcgtcgctggtacagctccacggccaggcctcagagacagcgacgccctctaaggcgcacctttcgttcggcgtgtcggcgccgaagagaggggccgtcgatggcatcccgttttataccccgtagacactcatttgtcagtgagcatctgtgcaatggggaaaaaacagccgacataacgtcgtgctttcctcttcactggctcgaccatatgtgtgagctgaatcagtgaacgctttgacccaaattgagcaaaaattgtgcaaattttgcacgtacaaaaaattacagtcccttaaagttggatgggttggaagaaagggaatagaaaaagagtagagcattcgctatttcttaatccttctatctatgatcatctgctattattctttctgaccattggtcatacctttctccctcatctctcttcgtctctcttttccatttgatctatcttcacatcattttttgtattttttttaattggcaaagcaaacgtttctcagagagaatggaggaagagaaacgagggaagcaacgagagaaggtgcagttttgcttcccatcctcgcctaatcagtaactcataactaatctcctttttcagtttaatgccactccaatgcaggacaattcgtgtttactttcttaatggaaatcacgtaaggttagaaaagcctgaagaagctatttgtttaaattacatatgtaattaacctttaaatctcatttttgacattntatcggcatcaaaaagtagaattatagcaaatttgtgacataaatttaaaa

SEQ ID NO: 43760 - DNA, 1045 bp, Heterodera glycines
gttgattggaatgttggtggattgagtcccagtgattgaaatgctgttgggttgagtcccagcaggagaattgagtcccagcaggagaattgagtcccagtgattggaatgctggtgggttgagtgccagtgattgaaatactggtgggttgagtgccagtgattggaatgcaggagaattgagtcccagtgattataatgctgttgggttgagtcccagtgattagaatgctgttgggttgagtcccagtgattagaatgctgttgggttgagtcccagtgattgaaatgctgttgggttgagtgccagtgattgaaatgctggtgggttgagtgccagtgattgaaatgttggtgggttgagtcccagtgattgaaatgctggcgggttgagtcccagtgattgaaatgctggcgggttgagtcccagtgattgaaatgctggtgggttgagtcccagtgattgaaatgctggtgggttgtcccagtgattgaaatgctggtgagttgagtcccagtgattgaaatgctggtgagttgagtcccagtgattgaaatgcaggagatttgagtcccagtgattgaaatgctggtggttcagtcccagtgattgaagggatgcgccgaaggcgctgaccccgctagtaaccaaaatgacctatttgcaccagtttcgctgcgccgccaattaaaataattataaattacgtttggtactgaattggcactataagatttgaatcggttcaaaaaccggtttatacttgtcggtttttatatggcgcggttcgacttcatacatttatttttagacttagctcgtcaagagctttcgaatggtaccaaatttgtggggattcgatcgtttaaaaaaaggtatagtgcgaaatctctcaatttttcgagtttgaactggttcaaaaaccgattttttggcatttccgcaactcgagacatatttttccattcttagctcctcgagacgaatcgattggtatatcatttgacccattttttcacggagcgttcactatagtttatccac

SEQ ID NO: 43761 - DNA, 886 bp, Heterodera glycines
  misc_feature (63)..(63): n is a, c, g, or t
gaaattcggaagtggcccgaagcagcggcaatttcgagcagttcggtctcccgccagccgganacaaccgaaaaggaccggcgtgaattccggtcgtcgtcaagtccaagcagtgcagcgaaggaaggaagagccgagcggtgccaaatcgtccgacgaaggacaggaccgttcgtcagcgcaactcccaccagccggagaaacgcgcatcgatcaaagcggactcccaccagtcggagtgtccgccgcagtaagcgggagttgaaacccgtgttcgtcaagtcaaaggggtccgacaagcccttctccaaccttgtcggtggtgccgttaagcaagcagaaaatcgctgcacaattccctcaagcaccagtccaactttgtcacctctcccccctcccattctcgtccccctttggcgctgatcggatcggtcagcagcatcagacccatcagaacgaacggcaaaaagggcgcaattccctttacggcacagcgagcggagtgagcagagataaaagggacgagagcggtgaagaggagcgggaaccaatcccgcctcagcttggcccaccccaaccccaagcgcgcggcgtgaaataatagattggcgacatctctaattgccaaatttgaacaattaattttttttttgccttttttgcacaaattttctgtaatgttactgttgtgtccgtacacaaactaattcgacccggtcaattcttaggcaaatactggtttttgggaaatttattaaaagtcaaaaaggtttaaaaagaaatgtttacgctcaaaattaagataagcaaagtaaagttaaaaaggttttagtgagtttgatcgcttcaggcagggcacctgagattggaaaattgtgggtagaat

SEQ ID NO: 43762 - DNA, 1414 bp, Heterodera glycines
tccgtttctccccccccccccccattttccattctttcgtttgtttgtccgtcttttctctctctctctctccttttctctctctttttctttttctctttgtcaaagttcaaacaccgcacaaattcttccgtcttctcacattattcttcatttttctgcaggaaacggtgcggtgtcaacacattttagtgctgttgtgctgcttattgttattcacaggcggaaggcaaataaaaaagggaaagaaaggcaaagaaaagcgtaaaattcaaaggaaatgggcaaagtttggacataagcattaagcagctaattaggtaattagtcgcattaattaatcaattgtttggctgtttagaattaatctcaatttcctttgcttattttcgctttttgtttcccttttgtccgactttcattccgatcattcaatccattttctcctgtcataattccataataataaataatattaattttgcgccggcggatgatgccatcgtcgggcggtggcaccccgcaggggcggcaaatgcaaaagggagggggggggggatattgcacaaagagaccaaatggtatttgggacgggagggatcagccagtaagtaagaagacggaagatatatttcctatacttttgttttggcaaaatgccaaaaagcccgccgattttaaaatattgatgcttttcgattggcattttcccacgccatttgctccattcctccgatgaatgggctttattctccgggaaggttcctctcatttgattgcctcgtcttgggaaggatcttatctgttccctgatgagcggacggaaacagcgaacaatggacaaaaagtcgcgcgtcattagacacggaaatggcggggaaaaggggtataatagagggtaggagaaggaggaagagatggggtcggatgattaggagcaatttttttaaattattgaattgcaaaataatgaattaaaaagtatatatataattattttgtaaataataaaaagtgttccaccaaattttttggcaaaaatgattcgagttgttcttcggcagtgtgccatggaaatcatcagtgttgacgtttacagtgtgcgccattgttgcggtgcttcagcggcttgggcaacggcggaatgtccacgtcatcgcacacaccgaacggcctcggcaaaatttgagaaatttcctgaaaattaaaaaataaaggttttaaaaaagaatttttttttatgatgtttttgatttaaaaatatgtaatttaattaaataagcattaaattttgttgaacaaattaaagtatttgggtttcccttgctgtatttaaaattatgtggttacgaccaaatgaaagctttttgatcagtaaacattgatcatactatgctaaggaatgagtcgatcg

SEQ ID NO: 43763 - DNA, 1447 bp, Heterodera glycines
  misc_feature (1407)..(1407): n is a, c, g, or t
  misc_feature (1424)..(1424): n is a, c, g, or t
agtcagaagtcagagggcacaaaatattataaaaaacaatgaatttaatcttagtatttcgccgccgacgaacaattttcgcccgaagtatttaaaatcgactcatagagatacaaatcgaattcattaaatatacaaataaaaaagaatagttgataaaattcgcaatttaattatttaaaatattttaaaataaaataattaattataaatcgtgaattatttcgagaaacgctaaatcgatcgaagaaaaactcgaagcaaattataacggaaaatccccaacgttcgccatccgtttcctataattcttcgtctcgttcttcctcggcacacatcgccgccttaaatcggtgataaaattgctttagggccttttcattaaaatattttttaattttattttgcgtttttttaattgacctccaaaaaaccctgtttcatccacgtgatcaccgcttgcatcagcttcatccaaaccacttcgatgcattctcttcggtcataacggtcaaatgtttcgttatgaaacgaatgctttttcaaacgcggcgtcatcagtgacagatcgccagcacttcgagcttaaaacatttattttgtttattttagataaattcaaaatgcttacgcccacggcgtttcaaattcgaattggccatcagaattgtgtcgaccaccgaatgtttgacacaaagccaattctccgcttggaaccacactttcattcggtaatgcatttggccattggcttggcacatttcgaacagtgtctgttcgagttcggcataatttgtgcactgcccaaaggcaattgaaacctaaagaaaaagcgcaaatcaaaattaattttatttagcaaattattgcttcataataaaatcaattttcaagaggacataatttgcttttgcttttaattctgccgctttaccctctcaaaaaagcgcgtcactccatcgcccacttggacggccctggggcagaattgagccaaactttgtacgtcaaaaacctcaatttcgtgcgcttgtgcagcacatctggccaacagacttttgaatagggacctcaaataaaactcattagatgttttcattatttctactttgctaattaggactaattaggaaaataattatttttttcactacattaatttgtttgtaccttttgtcattcagcaaacgaatgacaatttcgttgccaaagtccacttctctaagggccctaaaaccaaaaccaatttaaagtaattacaatatttaattcaactgctgatgttctgatgacctgttcagcgtgcatctgacaagttcaatttcgtattggttcagcagttcgctttggctttggcgctctctgtccgttttcgtccccccatttccatttccattttctcttttntgtcgtgtttggcgcgngctgcacctgaaaactgtgtaat

SEQ ID NO: 43764 - DNA, 1006 bp, Heterodera glycines
ttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcctatccttctcttgaaaaaaattgtcactaaaaaaaacacgttttctgaatattaaaaacaaaaatttttagacactttctgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattataaaaaactatcgaaaatataattacataaaaatgaaaaaaccttttgaaatgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatggaaaaatggcaaatccaaacggatacacacaaaaa

SEQ ID NO: 43765 - DNA, 610 bp, Heterodera glycines
tgcacctcttctaatcacttttgtacctcaaaatttataaaacgggcgcaaagcgcccgttctaggccgcgaagcggcctaaaagtcccagataattttttaaaaattccaaatctccacaaccagagctaatctaggtagcgaagctcccaaagcgcgaagcgctttcccaagcgccaccctcgcatgcacacacccgctagtttatattaccatagagaaaagttgcatttcgtttcaaaaaacaaaatctcccggccgaaggccgggagcgccctgaatgtagtggaagggtcttacaactttttgaggcgcatctgggaaaaataagggttttccggtccggtggccaactgagtcccggcggctaatttctcacttttgcttgcgtttgaaggcccataactttttttctaaaactctgatcaaaaaatgcccgctgcgagggcaccccgccaaagggtcctctacatgctggtattttttatttttttaatagagccaccccctggcctgcagaaaatggcaactgaagcgtgctcaaaaagtacacttcagtaccaggctaataccgcgtcagcgtttgatctgagagaaaagtgcccagcag

SEQ ID NO: 43766 - DNA, 1503 bp, Heterodera glycines
gctgccattttgagtacaggtgaacagaatgccaatgccaaaatgccaatccgtctaattgcccttccctttgagtgcgtatccttttgatgagcagcagtgcgccgcccgtctgtacgtggccaacgtaatgactgaggttgagctgtccgtctactacaacttggagccctccgtcatgttgggttagcagagggaatggccaaacttttaccattttgtattagcaactatggtgaattgatcattaggaaaatgccaatctctctccccctctttctctatcttttcccctttctatcgctctcaccctctctatccctccctctctctctccctctctctctctctccctctctctttttccttttccctgtaattcaattcgatttgtcgtcccatttgtccaggctggggcaaccaatcggccaaacggcacgtctccgactgggagctgttggcggtgaatgccaacctgtccttctaccgcaaccgccggtacagctcggcccggcccaccaccgcgttcgaagcccagtccagctggtctctgcttctgctcggcgtccgtctccgtcgcaatgcgccgctcttttggctgtctttggcattgccttcgctgtgcttttccctcgtcaacattctctcctttctgctgccccggcctgaacattctgttgtgcttctgctcatcaactttttcctacacggaatgttcattcgcgacgcaattcgcgcattaccaccggcggttggggacccgccacggattggtactgatcgggcacggcttttaactgcggttggggaccctccacggattggtactgatcggacacggcttttaactgcggttggggacccgccacggattggtactgatcggacacggcttttaactgcggttggggacccgccacggattggtactgatcgaacacggcttttaactgcggttggggacccgccacggattggtactgatcgggcacggcttttaactgcggttggggacccgccacggattggtactgatcgggcacggcttttaactgcggttggggacccgccacggattggtactgatcgggcacggcttttaactgcggttggggacccgccacggattggtactgatcgggcacggcttttaactgcggttggggacccgccacggattggtactgatcgggcacggcttttaactgcggttggggaccctccacggattggtactgatcggacacggcttttaactgcggttggggacccgccacggattggtactgatcgggcacggcttttaactgcggttggggaccctccacggattggtactgatcggacacggcttttaactgcggttggggacccgccacggattggtactgatcggacacggcttttaactgcggttggggacccgccacggattggtactgatcggacacggcttttaactgcggttggggacccgccacggattggtactgatcgggcacg

SEQ ID NO: 43767 - DNA, 1033 bp, Heterodera glycines
  misc_feature (43)..(43): n is a, c, g, or t
  misc_feature (80)..(80): n is a, c, g, or t
  misc_feature (104)..(104): n is a, c, g, or t
taaatataaactgtttaagtggtgcagacggatcaggttgatnagcgccaataccctcagattttactattttcgcgccnccacttttttgaattctgacattntcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataagctgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaat

SEQ ID NO: 43768 - DNA, 1375 bp, Heterodera glycines
  misc_feature (1364)..(1364): n is a, c, g, or t
attgagctaccgaggcaaatacgaccattctttggcgccttcaatgtttttgatatgaatatttttgaaaattcttaaactttattaaaagaacacagtcaaaattagaaaatgcaaaggcaaataaataaatatatatatatcatttttattgtccaaaaattctccctataaaaaatatgtttttaacccccccccccccataaattcttaagaaatttaaaaaaattctcttaaaaattgttcttgttcaaaaactctcccctaaatttataattgaatttattttaaaaataccccccacataaatttagataaaattgaaaaaaaaattcgctaaaattttattgttcaaaaatcctcaccataaataatgtttttttaatccccccctccaataaatcccgacgaaattaaaaaaatattctctccaaaattgtttagtcaatcaacaaattcatatcaaaattgagggccatggaatatcatcgaggtgtaatcataatttcaatggattcattttaaattctttcgtcagaatttcaacagtcaatttttgtcgttctgcttcatacaaattgtttggctcaagtgtcaacagttttccaaaatattcaatcgctttttctttttcattaagatgctgataacattttgccaaaaagaaattgttttcaattgaagttccgcgaagcgcttcatcggccttaataattagagaacagattttgtggcatatgcctttttatgcgtactaatcaagatatattaagtataaaaaagcattttacgcttggtctgaagcttctacttgacttttattatgcctttttcgggattttcgtaccttaaatgccttttttggcattttgcccttttggtgcctcttttggcgtttttttttacaaaaaattccattaaaaatgcaataaaatcagggaaaatacacccctattattaattataacagcagcagcaacacaatttttggtattatttctaagacatataaaaaattatggatataaaaatacgcgaaatatggccataaaatatggatacaaaaatcgcggattatgggcaaaaatggcaaaaatatggaaacataaatttttaaaaattgagttgtataatttaaaaattcctcaaatttgctaaatcttgaaaagcgaaatttttgccttttccttatttttgacacaattgagcaactttatggaattttaaaatttagtcaaaatcataagaaaaatttttttcgggtatttagttgtcaaaaaggtcaattagctaatggggtccgttctaatagaggattttcgcaaaaatgccaaaatatgcacaaaaatatggacataatccanaaagatgacat

SEQ ID NO: 43769 - DNA, 1019 bp, Heterodera glycines
atggaattgtgcgaattgagcccgctctgtgccgtcctttgcccaatgtgcggctctttgcgctcattcggcgccaatgccaccggcgatggcttaaagtggcgaaggcgaaaccgaaggaccagaaaaggtcgtccagcacaatgacatcccaattggtgtcgagcagctgaacaatctgaaaaaaggacaatcgttgaaaaataaattaaatttgatttcattcggaaatttcgtttaaaaaggaccaattaatgaattaacagactatttaatgtaccatacatataactaataattattaataatgatttatttattaatgctttagtgcttgctttttggctgtgattttgcatcaaaattccgagttccttgtcacatgtcccaaaataaagggccaaatcagtggcggaaagacggcgtgaccaaatgtcattggcaaagtgacgtttagactgaacaaaaaacatttttattattattttcaatttttaattgccattaactgtttcatcgttatggtgtttgggcaaaagcgcccgaaagtgatggatttcaaggctatggtcctgctcataaactgtgtccaaaacggacacattattgccccgactcgccagcctaaacaaaacacacatccaatttaaatcaattaatattaattaattagctagttaattgattctatcttataaatcccctccaattttgtaaaatatttgtacttttgcatcaatggaaacaccgattggaaatggcttcccgtgtcatggaaaaaggtgaacagaatgtttgtacatcggcacttgtcaattgaaacaaaaagcacaacaaaaatggcaaaaactgatgttttaagttttgccaatgccattttattggccactttaataaaataaaattaatttaattaatattttttatcttttggccattcacttcgaatgcgaatgaatgaaagtgagtaacaaacaaaataaagcggcaaatcagcgacagcttatcggaaataattg

SEQ ID NO: 43770 - DNA, 1432 bp, Heterodera glycines
  misc_feature (293)..(293): n is a, c, g, or t
tttctgtttaaataaagtaaaacaactttttgtgaaatgtgacttgaaaagcaaaacactgacagacatttgtttgtccactccccccctcacatgcccccggggaaaggaaaagggagcgagtggaggggcgtaaagggagcgagcgtaggtacgaaaagggagcgagcaaggaacggaaggatgaaagtgagcgatcggagaggcgtaaagggagcgagcgtgtacgaaaagggagcgagcaaggagcggaaggatgaaagggagcgagcggggggggtgtttgtccgccnccgccccctttgcccctttgcccctttgcctttctttctctacacctcaaaacaccaaacccttgccaaaattgcactcttatccccccaccctttctacctcactttgtttttgtctcccccccccctctttctctctttcttcgtctgtgtttgtctgtctgtctgtcgagactctcgacgcgggggatgactatgactatcgcttgtttacgctccccgtcgccaaagtgacgaccaccaaatccaccaccactccttccatccatcttttcacacaaacattttcatccagggaagctcacgagaaatggccgagtgggcatatgcaatttgcccccgggggtgtttttcagccgtgggatgaatccagtcacaccgaaacgatgaaaagcagcaggtccaaaactgactgatcgctgctatttgttggcactttcgccaccgttggtgccatcctttagcattgattctggcactaatcatttgccatgttaaaactgacaccaatgaatccgattttcgctgattacccatttgctttgcagcaacggctccgattggcctttctgctccgatcggatgaaaatgatgcagaagctggccaaactgaacctgaacgaggcgggccccgcccctccgagcccgtgctcagtgaagacaccgcttgagggcgtatcgacggaggacactttgcaaagactgaggccgaaggaggaccaagcggaacaaagccccacggggacactcgcgcttcataaaagtgctcggcgaggggtcattttcgacggtgggagaagcaaaagtgggaagtgaagactaagaagagaccgttaaaggtgtgttttgcgaaagaagtgaccacgggggacgaatatgcgataaaagtgctgctgaaaagcgaaatccgacgggaggcaaaagtgcgctatgttctccgcgagaaggacattatggccgcgctcacttacgtccacgggggtcacccttttgtcattcgcctttattgcacctttcaagacaacaacccgactttgtgagttggggaggggcaccaattcctgatcagtggatcatttccatcattttggattgacattgatcacaattccctcggcctcggctgattgtcttttttt

SEQ ID NO: 43771 - DNA, 1137 bp, Heterodera glycines
  misc_feature (1109)..(1109): n is a, c, g, or t
aaagagctcgataatatttaacgcgatcataacatcttttgttcagagttagtttcaggtaactaaaacctttcggtattttttctcgattttttttctaaaaaactaaaaaataaaaaatcgcggcgacggttacgttccggcgacgtttcggcggcgaagtttaatcccgctccggggggaggggggaagtcacggattcgggtactctcacaattaggcgcctctggggtatatgagaatactttccgaaagcaggtcattttcctagccgaaaaaaatttaaaaacaaattttcaaacctagaaattttccaataaaaaacttttaggaaattctttgcaaaaaaatttcaagaaaaaattttttgaaacaatttcagccatttttttggaaaatttttggaaaaaaaaatttcgtggggcaaatggatggaggaaatgaagtgcacccaataccaaatgcaacgcggcaaatgcggcgcggactgtacgcgtgggcattgttgactttagttgataattttattttcacaaagtcggattaatcttttatttttgacgttttcgtccatattagatccaagtttaaaaaaaactaaaaaatatatatataaatttaaggaaatgaaatgtaatatttttaattttaatttgatttacaacagaattgaccagtttacgagcaaaagagaaaagggcttttttgaatttttgggcttggccaaattgcggcgcgcttttttcaaaaaattttcggggaacagggggggggtggggggtccggcggtgccgacaggcgccgccggggaaaattttatttaatccaaattacttcttgaattcaaggatactttcaaattttcaagcggaagggcccaatttcaaggacgtccttaccattcaatgacggatgggagccctgatttatgttactttttaatgaataaataatattaattattaatgtgttagatgctttttctataaataaaattttgtaagttataaattttaatcttttgttttggtatcaaaagtattcataattttactaacgatttattttagcgtaattcagcataagctcattaactgttttttttcaanaaataaatctcttgtctcatgattaatg

SEQ ID NO: 43772 - DNA, 326 bp, Heterodera glycines
atcagtttttactgggagctcaatcgaaaatcataactatatttttaataaaaataaaaaaatcactaccatgtaaatatttattttcgaaatccgggccattagtatgacctttaaaaggataattgttaaattagaaattctatcaatccaataaattttggatgttttaattctgcgccgcaaatgtcgctttaattgggcgtcgcaagggctcccggataattcgacagtgaggacaatccgatagtggataatccgacagtaaaatgcacaaaaagataagaaaatgccatcgccgatcgggaccaatagtgccatgttgt

SEQ ID NO: 43773 - DNA, 1267 bp, Heterodera glycines
aatttaatacttttttagataatgaataagttattctttccactagtgaatctttacaaggataatagccttcaactgatgcacgaaaagctgaaaaaccaacaattggacacttgggaacaactgcaaaatgccattttgaaagaaaaggaagcgaggtaaaaatggggaaaataattattctaattaaaaataataattttaagaaagcaaaaaatggaagaattaatgagccaacaaagaaacaaaagtagcacaaagatagtgaataaattgacgagaaaaagcatcaaaaaccattcgaagaaacaattggagacaaatttggaaaaaggaagcgaatcgtttgaaggtgtccaagttccaatacttaatttggcaaaagatggacaaaaatgccaaacttttctgacagaagggcccaacgacggtaagcaaattagacgagggcaattacatatcataaaatattatttttcagacattggcatggattctgatattgaatatggcaccgagtctaaaatgttgaagccaaatccgcaaaaagagagggtgaaaaagatatacgcatagtagttgtattaaaccctaattaaatgccatttcgttacagaaaatcgactaccattacttctaccggtttgatgccaatgcgatcatttgccgttactgtccgtattgccgaccgacccaaaagcggtttaagccgacgaacgcgttgaagagccacctgaagacgcaacatatgagtgtgctaaagcagtacagaaggagcaactacattttgaaggaggacagcggaaaagagcaaaaagaaggaggaaccatcaaaacaccagcaaaacaatgggagggcagcagcctcaaaaatttagaagacacaactgacgaggccaaattcagaaaatatttaaatttttagaatttttttttcaaattttgcctgcaaatgtccgtcttcacaaaattctataagccggtcgaaaacagaaactgaaacgataataccatcggcatttctcggtctcaaatgtacgaatccgatttttttttgttgtgaaatattattatgagtaatagaaaaagacaaaatttgttacaaaatgcaaaaaaaccgtgtgcttctacgagttctttacgttgagatttcatacgtttcaatttcgaactcataaaaattactacaaaatgcactgaattacagacttttttatgttatttagggtggagtttccggtaatcacccgattggtaccgtgcgata

SEQ ID NO: 43774 - DNA, 931 bp, Heterodera glycines
ttatgtttcgacaaacatcctgtacaccataaatcgattagcaaatttagtagaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtcccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagca

SEQ ID NO: 43775 - DNA, 1461 bp, Heterodera glycines
cccgcttcttttcatgctgcgcaaatcgctgaagctgcgcgacatggcatcggactcccgcaaaaaacacctttttggagattaataaaaattaaattcaattaaaaattaaattgcgttatataaatgggtgcagttttcgtttccactccgtaccgtttacccaccaaaaattaaattaaaaaaattgctaaaaaattttcaaatatttttatttaaaactttttttttgtacaaatttttttaaagttcaaattgaaaaattacaagtttgagaattaaaaaaatttcttattttttttccttcagtgttcttcttctaaatcgccgtcgggaaaaaactttattttttttttgtaaatttttaaattttcagttgccattaaaattttttatttgggtagaaaatgtgcgcagggcggaagaaatgtatttaaaaatgtaaaaaaatatttatttaattcaactaaaattcaaaaagattggaagaggggtaattgaagcttgcttgcttgtttcccaaaaaataaaaataaaataaaattccattttctaattatttaaatttggaaacgcacttcagcaaggccaaagttggccgtgcccgcctcctccagcccgtacttgtccagcgtggcgcgcacaacctgctccgcggtgtcggtggcgttcaccaacagagtcacatagggccgatgcgggaacagttcgactccgtaaattttcaaactcccacctgttcagcagggtaaacaaattaattcaattaaaaatgggtaattaaaattaaaaaaaaaattaatcagtgcccaactacaataattaattattgtaatttacaaatccgttaaagattttaatatatttttaaaatcctttctaacattaaaaatttttgaaaaagtataaaaaaaatttaaaaccatttttttgaatagttaaagcaaaacagcgaaaagaacttgaactcacaaataaaccaaaactcactatttgtatttcaaaaaattttattgttagaaaaaaaaatttacaagaaaattcaagaaaaaaaaacttagtaattcataataaaatttaaaaaatcgctaggaaattgtttaaattttttttcttgaaattttcttatatttaaatgtttttattttactttctctctctattactctctccccctcctctatctctattactctctctctccccctttcctctcactctctctattactctctcttccactgaccgctgttcatgtgccgtagccggtcgtccagcttctgttcccgacgccgtttcagcaccaattcgggattggacagtgtacgagcaaatggtgccaatgtgccgcaaagcggagaaattggtggcaacaatgccgccgacggtaccgagtcgtacaggtgggtgtttttgtttttgagggctaattgctaaaaatattttcagcagtttcagtat

SEQ ID NO: 43776 - DNA, 1133 bp, Heterodera glycines
  misc_feature (1040)..(1040): n is a, c, g, or t
agcattcctctggtttgggttcccatcactccaagctccaccgtcaccatttttccaatcattgcattcggttcgaatccactacaaaaagtttcgcttttctccaactcatccctcaaatactctataacttccttttccagtttaacacccgcgacggttgcgtcggttgcgtcggttttaacttcctcttccattcttatgcaattttgcttaagaaagttttgtgagcgtaccgctggggttactccatttttggaattttgaacaattcggttcgctcccgtagctggcgaattatgaaactgttgttgttgctgattccgtggaaaaaatgcgggtgcatttcggttcgactgtacccctgctttattacagtttctcgaaatatggccgggctcgttacaattgtaacaaatagggcgtggcgaaaaatttttagaaatcatttcggaatttctttcaccctggtgcgtatgctggaagtttcgctcataatatggttttgagcgctccccgttttgtatctttgccgctttttgggttgtttctgcgcgcgaagccaacgccataaattcatcaaatgacattccattacggcgatgaagctccaaactcagtgcgagttcggggttattcaaacttctaatcagatgtttgatcgagtattcatctgccagatttcgcgttagtcctggatacgccctgcgtacaagactcgaaattcgatcggccaaatcgtccaggttttcactggattttctgagtaccccattcatcaaatcattgaatgcactcatttctctgcagtccgtctcctccaattgttgtaaaatacttcttttgatgttttcgtaagcgaacggttcgctggccagagcggcattataggctctttcagcacggccacttaattttgcctccaatgattcgatacgcttcttgttaggccaatcaatcgtgtattgactgtactttttaaagaaattgcgaatcaaatcgctgccttcgtttccctttatatccggcagacgatccanaatcatcgcatattcaagtccactcaggcccgcctggtgtaggaccgcctgttgctgtgcattttgaaatggctgctggttcacctgctgacg

SEQ ID NO: 43777 - DNA, 1150 bp, Heterodera glycines
aaaaagcaattaaaaaattttaaactttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatca

SEQ ID NO: 43778 - DNA, 1533 bp, Heterodera glycines
gacgaaaagcaaaccgaaggggaaagcgtcgaaaagcaaaccgaaggggaaagcgacgaaaagcaaaccgaagggaaaagcgtaagggaagcaaaccgaagggaaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaagggaaaagcgtaagggaagcaaaccgaagggaaaagcgtaagggaagcaaaccgaagggaaaagcgtaagggaagacggacggacgacgccttttgacgaccatccaattcatggccattctgtcattttattttattcgtttttatgggctcaatatcaattataaaggtcaaccaattagtctccccctccgacttattcggtgctatgacgaagcgacaaaaatatgggtgtgggcgaagcgacaaaaagcgcataggtctgaatcttcagacccatttgaggtagcaccaaggcttcaattaacgaaatttggagctctaaaactaataatggggaaaacaatcatcggaacagagtggatgagatacataaccgtgaaatttatcattttagcttttgaatccgatccaagatcgcgaagcaccatctatcttcatttataatcaaatgggtcattttgaagttattattcagcctgaacgtctgtcccacaaaaacgagtaactccatatttttatcacttcactcttcacataactcaaaattatttttttaaatcaaatttaaatgaattgattggtttaaaattttgttcataaaacgtgtgattggttaaattttgtcataaaatcaaaatctcaaattacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaaattataagaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtacagctccaacttcatgcatggagctggagcagtacaagctcagggttaaaagatagatcagatttaaggccatattcgggatctactggtctaatttgacagaaaaccttctttttgtatatcaggttacttttttga

SEQ ID NO: 43779 - DNA, 275 bp, Heterodera glycines
ctcacccaaattttccaagaaattttctaaatttttcaaaaaatccacaaatttttcgacgaaaatctgctaaaaatggctcaaaatcacaaaatttggtcattttttggacaaaatctgttaacaaaccgcatttaaaaccgcaaaaattttcccggcggcgcttatcggcaccgccggacccaaaagcgccgcaaaaaattttttggaaaaaccgcgccacaaaaaaacgggtgtgaaaagcaaaaaaaaaaggcgttcgcccggggggaggt

SEQ ID NO: 43780 - DNA, 391 bp, Heterodera glycines
cgatgggggcgctgctgattgttgatggatgaaaaacgtgccgaaaaataatcaaaaacactcgccccccccagcgttttccccctaatcactttccacaatcggtggcggagagggcggaatatccgaccacccaccaccacgcaattaataatccccttaataacccccccccccccccccccattcccgggcttctcctctgttctcgccccttctggcgagggccgccgttttcaatacatataataatattgacacaacaacaaaaaccacaaaaacaacaacaataaaacaggggtaaatggtggaaaattatatgatgagaggcgagaggggtagaaaaatgggagaaatggtggaaaattataggataagggggggggggggt

SEQ ID NO: 43781 - DNA, 1016 bp, Heterodera glycines
ttttttcccccaataaacttttcatccccccttttttcgcgccgtgaattttttttttattgaattctgaaccggtttgagtagattagagtacaaaaatttaaaatttcgaaatcatgtttcccactctcttctcccaggggtattattttgtaaaaagtcttgttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtagtctttttttccccaataaacttttcataccccatttttcgcaccgtgaatgttatttttattgaattctgaaccggtttgagtagattagactacaaaaaattgaaaattttgaaatcatgtttcccactcccttctcccaggggtattattttgtaaaaagtcttttccccaataaacttttcataccccatttttcgaactgtgaatgttatttttattgaattctgaaccggtttgagtagattagactacaaaaaattgaaaatttcgaaatcatgtttcccactcccttctcccaggggtattattttgtaaaaagtctttttttccccaataaacttttcataccccatttttcgcaccgtgaatgttatttttattgaattatgaaccggtttgagtagattagagtacaaaaaatttaaaatttcgaaatcatgtttcccactcccttctcccaggggtattattttgtaaaaagtcttttttcccccaataaacttttcataccccatttttcgcaccgtgaatgttatttttattgaattctgaaccggtttgagtagattagagtacaaaaaatttaaaatttcgaaatcatgtttcccactcccttctcccaggggtattattttgtagtctttttttccccataaaacttttctaccccatttttcgcaccgtgaatgttatttt

SEQ ID NO: 43782 - DNA, 1212 bp, Heterodera glycines
  misc_feature (61)..(61): n is a, c, g, or t
  misc_feature (63)..(63): n is a, c, g, or t
  misc_feature (69)..(70): n is a, c, g, or t
  misc_feature (1181)..(1181): n is a, c, g, or t
  misc_feature (1203)..(1203): n is a, c, g, or t
cagctttcgaatggtgtatcaaattaattgtttactgaaaatttcacagagatatgtccancngatctnngaaatgaataatggcgtagtattctataaaaaaaaatttttcttaggaattttacagtgcccagggatttgaattatcccataaacacatcatagggtaaatatctagcaaaaacaaattttttttacacagaatcctagtccatcagacagatgaagcgacttaataaatcgattatggatttgcaagagttaatttctcaactcacactagctaacacggaatttgccgagtgtaggcgtaaaatgagccattatgaattataagcgtatatcttggtccacattgagtgtgtgggcgagattaagtaattttctgaaagagctcaaaagcagctttcgaatggtttattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacagaatcctagtccatcagacagatgaagcgacttaataaatcgattatggatttgcaagagttaatttctcaactcacactagctaacacggaatttgccgagtgtaggcgtaaaatgagccattatgaattataagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacagaatcctagtccatcagacagatgaagcgacttaataaatcgattatggatttgcaagagttaatttctcaactcacactagctaacacggaatttgccgagtgtaggcgtaaaatgagccattatgaattataagcgtatatcttggtccacattgagtgtgtgggccgagattaangtaaattttctgaagagctcanaagcagctt

SEQ ID NO: 43783 - DNA, 1015 bp, Heterodera glycines
  misc_feature (14)..(14): n is a, c, g, or t
tattgatgggttcncgcgggttctaaattggccaggttccttttttgaaaaactggctcatgaactccaacaataaaaatttcaatattcgtgaataattaaccctcgcatagaagtcaacatcacttttcttgcaaagcttcataggcaataatttaaattgcttttgattatattcaatcgctggaaaagcattcttttatacgttaaacctgcaaaaagcgtccgaaattggttgctgaccattctattccctaagaaaagtctcacacggacgcaatagtaggaacgcaagtagtacttttgacagtcttaaaaatacagcgcactgattcgtgcgatttatcacttttaaaatatgtttgaagtcaattgatgggttccacgggttctaaattgtcaggttgctgctgttctgaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattctttatacgttaaacctgcaaaaagcgtccgaaattggttgctgaccattctattccctaagaaaagtctcacacggaagcaatagtaggaacgcaagtagtacttttgacagtcttaaaaatacagcgcactgattcgtgcgatttatcacttttaaaatatgtttgaagtcaatattgatgggttccgcgggttctaaattggccaggttgctgttttgaaaaactggctcatgatctccaacaataaaaatttcaatattcgtgaataattaaccctcgcatagaagtctacatcacttttcttgcaaagcttcataggcaataatttaaattgcttgtgattatattcaatcgctggaaaagcattctttatacgttaaacctgcaaaaagcgtccgaaattggttggtgaccattctattccctaagaaaagtctcacacggaa

SEQ ID NO: 43784 - DNA, 1116 bp, Heterodera glycines
gcctaaatcgttcacaattatctttctcctcaatcgctaaattccgctcaaacaggtgaaaagtggtgataaatacgtcgtttaaatatttttacgtcgttttacagtgaacaatcgacctaaaaaaattgccgggtttttgaaaatttttgccgggtttttcaaccggtttttaattggcgtatcccttgacatttagggccaaaattttgcactttttcactcgctggcgacgcccttaaatgaattttcggattttttaatgagtcaccccttttggttattgataaaattcaaattaagtgcgcactttttaactagcaccgtaatggcttataataaattaaggaagtttacatttttaattggcatatttgtgcacataaaaaatgccaatagttctgaacaaaatctatgaatttttcaagttgtccaaagcgagttcattgaacaaaaccagttcactttaagccgaatttgtcaaatggttcggatggaattaaagaatgaagaaaagggaaattggaaagaaagaacaaaaacgacgactaattattggtaaattaagaatgaaaaatgaaagcaatttttttattcgataaaaatttctttgatggctaattaaaaaacatttttaatttttaaatttttcaataaattaatcccattttgtcattttagagcccttaaagaagaaaattctccatcaccaccaacaaaatattagacagtattacgaaccttactagtacagaatgaccgggccaaaagtatggcactttttttgaaatattttaaagtgttcattgaacattaattgacaaattaattactgtttaaagaatcagcgacaatttctacacggcaagaacatttgacattctgtatttaatgctctcataaaattgtctttcgtctatttggtgagaaagcggagagtgattttgattaacacgacagatgaggattatagactcgttcgcccctcctcccccaccttcattctggcattttctcattcatttaattttattttgcatcaattattgggcatcaattactcaaaaaattaaatttaacgacaaaataattaaatttttttgaataatttatttt

SEQ ID NO: 43785 - DNA, 1322 bp, Heterodera glycines
ttgtcatcgtggcgatcttcatcctcctcttcccccctttcctcctgctccttctctgccgacaaaatgttgttgttgtctgtcggtgtgtttctacggctgcttacactctttgcagcagaattgctgccgcccgattgagcagcgaccctttttttagcgacagcatttttcatcactgttcaaaaaaacccattaattggtcagcaacatactacatacactgaaactcaagaacttgaattttctaccagaggtcggcgcctcttgcatttttacaagcgcattttttttaattagcgggattttttgacggtttgtctgtgcgcactttttggtcaaattgatgatatgggttttgtaaattctacctgttttgtttaatttcaaattccaatttttgctaaaaaaatttttttttttttttaataataggaatgtatgagacgaacttttcagtttaataaatttttcgggtcggggaaggatgggacgataaggtggagggaggggaagagaggtggaggtaaaggtaatgcagacaaaattaccagaaagtgatgccgctcggccaccaccaccggcaacagaaaacgaagatgcccgatcagatttcttcattttgcagttgcggtgttgaaccataccttcacccaaagaacattttggtgttgttgttgttgttgtgccatcctccgctgaagtctgttcacaaccaatgatgctgtcagcaatgtttttgttgtgcaacaatttgaattcgttgtgcaaatgttggaatgcttcattgctcagtgaaggcaaagcggctgtaacaagttcaatgccttgcgttttgatattacaaacctaaaaatgattttattttttttaatcatatttattatgcacgcctcgttaattctccgctcttcctcttcgcagatttgagagctgatagaccaattcgtttgatccctgcaaaattacacaaacaaaacaacaacaacaacatatattagagacaacaaattgtgaacaatgtccgcaattgtaaaagagtgtgttgctactgtataaaacgggccaattttgcgtcatcgacacaaaatcggcacgcaagtcggcaattctactgtaccgacccttttcaaggttggaacactattgttgaaaatgcattgaccaaccgatgggcatcccctgcttctcactgacgaccgtgtcattaaacacctaaaaaacgatctgacaatgatcactatattgtggcaaacgaaattttattgcgttgacccttttgattttaaggtccttgatcacgaatcatacatctattttga

SEQ ID NO: 43786 - DNA, 757 bp, Heterodera glycines
cggattcgtcgaaatgaaacgaacttcgaacatttatcttttatgtttgttcgtttttattctttggcaatttctcgcaactgcttttaatgtgtcataacgcaatagaaaaaaagcaagagggcgtcgagagaatgaataatcggcgtggttatcgaattgattaatttagtagtgtcaaggaaaagcattggctgtatgtctgccgatccctcgccaacactttgcctcgcttggaatatgcacgaataatgccaaaattaactcccaaaatcttaaataaatatttcagattttagccaaataattttctgacgagggaagggaacggaaatcgaacgccccgagggggggggggggcaaacaaaaagataatcaaaaagagaaatgctgctgccctcgccattctttctgtctatgccttaacgattaggaaattctgaaagtgcatttaaggaggaccattgggaaaagatttcttccgtaaatttaaatttgaattttgtttacattggaacgcgcatgttaatccatcgcccatccatgtcccccttccccctctctttccccctctctttccccctctctttccccctctctttccccctctctttccccctctctttccccctctctttccccctctctttccccctctctttccccctctctttccccctctctttccccctctctttccccctctctttccccttctctttccccttctctttccccttatctttccccttatctt

SEQ ID NO: 43787 - DNA, 1170 bp, Heterodera glycines
  misc_feature (1141)..(1141): n is a, c, g, or t
tcgccttgctttggacattttggtcggtgacttcggtcgtttaacgccaacttgcgcagacattctgatgcaacggacaatgccaaaaggacgattcgcatgggacgaggaggacaaaggaacggagaggaaaagcgacggagggacaatggcactcggagggggaggacgggcaacggggcgggggcatttttgagtcagaggattaacacagcagcagaatgacgagatgatggacacaaacaagtacagattacggtataaaacggaatgggacggatacggtaggacgaatggacacggaaaaacgcaaaacaaaagctgataattgattaaaatgataaggtatacaataagtgtgtaaaaggggcgtaagttgcaacattcgtaaaatcaaattttggaatttgtaaacagaaaaccccaattttacggccaattattatattgaccgatatttcttagaatttttaaaaataacgaatttctttttttggagatttttaactctttaattaaaatgttgcggcactgattcttaaattccgttttttcttgtagaaattaaacttattgttcccttcattatatcattcgttcaatatttttattaatagaaaatattcaaaatgatgtgtttttgtttaaaaatttaaataattaaaagcaaaaagatggaaaaaaagaaaagacagaaaagacccaaaaatgtgtgaacaaaaattgatcggatggcttaattgagaagcagctgccaatcagaactgatcacgggcaattccgaccaacaaagtgtgccaaattatttgcggatttgaatgatcaaaaatcaaatagaaaagaaatgaaagaaacacgaaacaacggtggaagaatagttggagacggttatcacttggaaagggaaggatgagcatttggagacagacaatggtgtggtcattttgctgacgatggcacggcacgaaaattcactccccggggaagggaagggcacaaaatcagatgtaattgggaatttcttggccagtcaaaagccggaacatcgaagttggcattgttctgagcattcggtaaaggattagttccattccatctatcagtgctttctcattagcttatcccatgttcatcccctccncatttgtcatttttacttcatgtgaattt

SEQ ID NO: 43788 - DNA, 772 bp, Heterodera glycines
agcatcttctatatcaattaaatgcctattttatttgtctttcttatgaaaaaattaatattctttttgtattataatacaaattttattttatctgataaattagctggagtatcaaaatatatttaatttcattgaaaaaatttgatagttattatcgtcgaatttaattatgtatattatattaaaaataaattatttacttctattatttattatatttttatttaattgctaagttattaataatctttttattttataatttgatttttgcttatcatttagtagagtaccatttaatttacatttacacatcatttcctttcctttttactatttataaatgaatttttttatatgaaaagatgaaaaaaatatttttattggaaaaggttcaccaatttaaataatcagaatttttaataaatttataaataataaatatagcgttaataatttatacgaaaataattatgaaattctttcattttttcctttaagttattgaacatattagtaaatgagaaaccaattattaattgattaagaattcaaatatttatatttaaaatttatattacaaatttctaactaaaatgacttttttaatattcataaaaggtatttttagaaattaataaattgcaaaattaagtgatttacataaataaaataaaaatttttactttttaaatcacattcataaccaaccattcattaatataaaaaaaggcatgactaaaaaaaggaattacttaatttttaattt

SEQ ID NO: 43789 - DNA, 990 bp, Heterodera glycines
  misc_feature (62)..(62): n is a, c, g, or t
ctctcccagcacggccatcctctggatgatatttgaaccgtagagtttagtaaagatttaantcgaagaaaattcttggtattttttgtgtttaccattcctcttctttgtgtttttggaaaaatcgctcacattcctgacgaagaacatcgaactgaaacccatacaatgtaaagtaagaatgccgcttttgacttccaaatttactggttaattttggcaatgtctttctgttctctgtgttaccttgtattcgttgtatttggtgatcgcctcctcgtcgctaagtgattcgtcttgtgtcgcaagaaatttcctaaaagtcagcaaagtggtcgtcccaccatctgagtccagtgccgtgtctcgtttattaaatatcggctcatagctgtcggatgccgaatcactgcttgtattaaatatcacaattttcatttctatcaaaatgtaactcacaagcgcccccgtttaagcggttgctgttcatcttcaagccctgaccctctgaatgatcgtttcatcgttccatttgcagcaaaatcggcacgtcttgacctaatagcacaaacaaaatgcacatgcaattacattttatttcagtgttatcaaacctatcaaatgggcgacgaaagtcttgctgcccgactcccctttcgcggctgaatttttcccgtcggcgttcgtctggttcctcatcataaaccatgatttcaagttaagcaatttcgaaaatctatgattttcataatcaatgatagaattaatgactgatatcatattcgcgaccagaagccctgaatactcccgggttgatcttttcataacagaaaaacaattttttgggtggaccccagattctccaggagtattacctcaattttgttatcattcaaggcctaagtgttctctattatgcatgtgcacctttttgcgacgtttttttcaaaaaaccggtgtctatagcagggcgcgtatctgtccttattt

SEQ ID NO: 43790 - DNA, 1306 bp, Heterodera glycines
  misc_feature (17)..(17): n is a, c, g, or t
  misc_feature (1162)..(1162): n is a, c, g, or t
  misc_feature (1172)..(1172): n is a, c, g, or t
  misc_feature (1177)..(1177): n is a, c, g, or t
  misc_feature (1184)..(1184): n is a, c, g, or t
  misc_feature (1186)..(1186): n is a, c, g, or t
  misc_feature (1194)..(1194): n is a, c, g, or t
  misc_feature (1196)..(1196): n is a, c, g, or t
  misc_feature (1200)..(1200): n is a, c, g, or t
  misc_feature (1206)..(1206): n is a, c, g, or t
  misc_feature (1212)..(1212): n is a, c, g, or t
  misc_feature (1248)..(1248): n is a, c, g, or t
cgaacagtgccaatgcnatcaaacagtcgccgcgccagtcgaaccagcaattgtgccatccttcgccacccatcggctgccatcagccgacaaacggagagcaaagtcagcagcagtggcattggcagcgcaaataatgagtcatcggcgttcggtttgtcggacattggcaaagggacgagtcgcaaaatgtttttttgttcagagaaagtgccaaattcgtcgaaacggcgttcgacctgtccgagtcagtgcagtgccttcacacctttggccaattgtaagtgcacttccgctgcttctcatcagaatatcccttccccattaaattagcctcaactgaaaaagcggcagcgaatggaatttcacttcggggaaatgtgccaaaaatgcagcaaaatacgggcgaaagagaggacagaaagaaacggggcggggaaggggaaggggcggcggaaggcgaagcaaatgcgcgaggtgacaagcggcgcgagaagggccgtgccgcgaaagacgcgccgactgaggtgagtcacccgcgagaaggggccaagaaaaggcccaattaccaagtgcccccgcccccattagcgtggaatcctccgtcggaagagccgatgccaattcgacgtcgcccaataacgaatcgccggagatggccgtggcatcggcacgctccaacacagcttcgcaacaatcattcggatctgttaacgaccttatgcccgcaacttacgacagctgttcagcccaaaacatgtctccgtcctcctcgcagtcgagcgaatcgccgacggaaacaaacgcatcgccgatggaacaggtcaattgggaagggaatgtaagggaaagcgaggggggggttaaatattgtaggtacagtaggaaagaggtcagtggataaaagaatggggcatcaggtactgtattttatgggcaatgggaaagggaatggaaaaaggtgaattaaatattgtaggggaaggagtcaatggggaagagagagagagtgaaagggagagcaaaagaaaactgtactaattacagtacaccgaaggaaattgaacccattatttttaaaacaatgcccttttcttcttaggatggcgaagtgccaatcgctgactcttttcaatgcctgtggcataaaagggacaaaatnttcaccaaanaaaanccttttntntacctatntnaatnaccatntccganccgaacttttgaaggaaaagaaaacccattaaaaancataattaatacttgtagggataataaatttcatttttaaatttgtttttctttttag

SEQ ID NO: 43791 - DNA, 1264 bp, Heterodera glycines
  misc_feature (1185)..(1185): n is a, c, g, or t
  misc_feature (1219)..(1220): n is a, c, g, or t
  misc_feature (1236)..(1236): n is a, c, g, or t
  misc_feature (1238)..(1239): n is a, c, g, or t
tcatcagtatcatcttaattttccccccagtgatttgtgagtgatagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattccagaggaatttccaaggaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaaataaaagaaattcagggattaattcctgaggaatttccaaggaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttccccagtganttgtgagtgataagaaatagaagaaattcagggnnatatctctgagaattncnnaagacacgtgcatcattgctacaac

SEQ ID NO: 43792 - DNA, 1129 bp, Heterodera glycines
gaaaaaatcgaccgataaatttttgagtttttcggtttcggtttttttcgggtttttaaccgaaaccgaccgaccgaattaatcaaaaaaccgaaacaaccgaccgacttttttaatgcgatttgttaacagattttgtccaaaaatgaccaagtttttgcaatttttagccaatttttaagaaaattaaggatttttagggtacggttgtgccgataggcgtcgctgggggaaattttgagaattttattttattcatggtttcgagaatttgtctttcgaaatgaaatttaataaaaatcacaaattatttaaaagattttgtggacaaattattttaagttggcaatcttatgcctgttaatctatctaattttatttttaatcgcaaaaatgctaattttaatttcaagaaaagatttggctaaaatcacaacggaatctttaaataataaaaaaaacaaattctttttttttgcgaatacataacaataattaataataaattgcatgaaaacaattagccaagaattaattttggcgactcaacaaatcccttacagggatggtctttgaaaaaaagaaaatcttcaaaatgttttgcataaaatttgtcggcatctttcagttgattggcatggcatcgccgcaggcgcaacaaataaatcactcgttgttgctgttgattggtgatcacatgctcaaacaaaagcacttcatcagtcaaatcattgtgcacacgccacggttgtggaagctgattaaacgtatggcgttgttgctggtgatcagctaccgtaacggaagttttggcatgtacgataaacgagcgacgatcaacaggcgattgggcttgggacaaattcttaacaaattaataaattaattattttgtatatgtaaaaattaaacacaagtggactcagtctgcaacctccagcagatcccacgattcaaccaaatataaaaaaaatgtttcagtgatcatccatcatcagtttcttaggcaataatttttccttacctggtcaatcagcacattcctggtatgaaccgaatgaaatttgagttttatcattgtatttaatgggttaatgcgaagtaatttgctcttttcttttttaagatt

SEQ ID NO: 43793 - DNA, 933 bp, Heterodera glycines
aatttacctcctctggaacggcacggattgaagtaaatccctatagatatatttatttattgatgttttacgattttagagtccgattccattggattgtccaaatttggactcaaaaaaattggtgctcaatgactaccaaaaaaaatattcattcgaacgatcctttgaaaaaataaaaacagagttctaaataattgtcgctcaataagtagacctttctgaatacaacagtgacccgaagggcaccgcatcgaagtgccgaagtagcgcaatcgaacgctgtgtcaccggcacctgtactcaaattttctttcaatattttcggttggctaacatatatatttttaaattttatttaaattaattttaatatttggactgacctaagacaattacacgaccagataaacgaggtaattgagtcttggcacaatggcacattcctttaaaaaggaacaacaaaaaaatattttttttcattaatggcattaattttcaataaaattaattgtttatttatggtcttgacctgatttactggcctttgccaccaatggtaaaaaatctttagacgtgtaaaagccgttttccggtgttagaccatcaaacattggtgcccgtttcggctccggcattccaatgccaataaacaccgctttaacgccttgtttttgcaatctgtctaaggtcaaatcatcacgatgcagagaacggccagtttcaatctttaaaaacaattatttaatttaatgattaaatttgatttcttttatgaaaaatattcagtttttcaatatatttttaaactatttttacttttaaataaatttaatttgaaaaaaagattccttcttaccttaacaccaatgtcttttgccaattgaatttcaaaatcgactacattataaggcagacgaaactgaggaattt

SEQ ID NO: 43794 - DNA, 704 bp, Heterodera glycines
  misc_feature (42)..(42): n is a, c, g, or t
ccccgaaaacaaaaataaatcgattttttcaagtgtccgttntggggtactcaaacaattatgggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaattt

SEQ ID NO: 43795 - DNA, 816 bp, Heterodera glycines
tttggttgctaggcctcaatttcagttctggctcaataactcgtcaggagttgattttatcaaaaaatcgtctaagagcttttttgtagagaattttaagcccaatctaatgtgctttatctcatgttttaaccatgagtttaaaaaaagttatgaaattaattgtgattttgaaattaaaaaccataggggggaccccatggttttgcatttcatgaaaaatttttttgctcctaaattagccaaaatgcatttttatggcctaatttaaggtgctgaactcgaatatatactttatttttggtttcagactttttggaaggtggttataaatttttgaaaaatcgtcaaaatttgagccccggaaaatccagtgaaattttgaaaattcataactctcttcgtttttggtcaaatttagtggaataaagtttgaaaaatagcaaaaaattaggagaattttatgagatttatttggaatttctatcttccaaaataaaaaagttattccagaatttctggaaaaattcgatttttcagaaaaaaattcctaactcccttctaaaaaagtattttataaaaataatatactcaaaaaatccgcaattttttgctctattttataaattttattttagctttttatcacttttttgaaaaaagttatagaaataaaagtgattttggaatttgggaccacaggggtgtgaccatgatttttgagaggaaaattttttcaccaaaaatcttccaaaaaacatgtctttaggggttatttgggccgctgatcacgaatacgtgatcagattttacttt

SEQ ID NO: 43796 - DNA, 1086 bp, Heterodera glycines
  misc_feature (1021)..(1021): n is a, c, g, or t
  misc_feature (1035)..(1035): n is a, c, g, or t
aaaataatacgcaaaatatctctcccgtacaaaatctgaagagtaaaatattcgaaaatataacttaaaaataatcggccccataacttcttttatttaaataaaatgggaaattaaaataattagtttatatttctatccccgaattaaataataagaattatcgtttccttcgaataacttatgccatggacaagaatcgaatagcaagtagataaattcgaaagcattaaaaaaagaaaattaacttaaaattaaataaattgcgtgagcaaatattaatttcaatttcattttaagaaacttagatttttatgaagaatttaaatgaaattttatttgaaaatttaccccctaaaaaatatttttttaacaaaagtatataaactaataaaatgtattctaaggcatacgtcctttttatggattttatgcttatttgtaccaaaaagcccaatggtaaatgcatttttaggcccacaattggagagaaatttaaacaagtcttcgttattaatttgtagaagcgaaagataaatacgtgttttaatgaaaaattattaactatgttaaatataaactcaaaatagtaaagacaaaagaaaccaaaagtatcttatatatatacttagaaatatattttaaaaaataattgcagaggtacaagaaatttttaacaataaatgaccataaacataatattttttaaaatttttggtaatacatcaaattctaattttgaataataaagaaaattttaaaaagaatacggaagattcctctaatttaaccttaatcgtgtaagacaattttgaacccagaatttctgagtcggattatgcgtgtaattcttgccgtggcatgggctggaggaaagttgtcgcgattaatgaattatattattaaagataataacccctaattatgtaaaacattaaaaaaagaaatatttatgtaacatttgtaaaacgcacacaaaaattaaacaattatttggcaatctgcatcaattatggcttanaataaaaattatanacatttaaaaataaaaaataaaaatgaatgaatttcttttttttaaatttc

SEQ ID NO: 43797 - DNA, 1318 bp, Heterodera glycines
ttttagtccatattttatgtccatatttgccattttttaatccatataatttacaaccctacttataaccctagtgattgctcaatttgacaagaaatttgaataatacagaatgccaaaagatttttaaactttacagcagaaataattgccgattccaagtgcactcatttaacctttatatttttctataagaatcaagtaaagagttggatttccaaaagccgtttagactcctccgattcaaaaagcattctaagtctcttttccaagagaataaatgctaacataggaaattggacattcagaaacaatgaaataagcaattatttcagtcttttgctgctccttattgctcaagcagtacagaataaaatgaattttcctggcaccgaaacgtttagagaaatgccaatcattcaccagcagaagaagcaggaagtggtggacagtgatgacgaaagcacaacctccttctcgtcctcatattcgtcctcctccagctcttcgagttcaacagagtgccaaagccctctgttgaaattgggcggccgcacgctgttcaacaagccgacaatttgcagaaaggttgccattacaaaacactcatggacaaagggcacggcggaggccaatttaaataaaaatgccgttcccattgtatgaaggtcaaaattaatttggataattcggattaagatggattgggcagttcgatggcgagcgccaataggcccataaatttaaaaaaaaaaaattgaaattcggagaattgatggaaataggcattttgatgtaaaagcattacaaatgcgtaattcttgttcttattgcccatcgaaatgtttgatgccattccccctacattctccagcagaaatggcatctccaacacccaaaaaaccgaactggatcaaattttaatgaattgtaaagaaaataaaaacaaatttggattaaaagcgtataactgagtcagtgcagctcatataaaagcaatcgtacaaaataaagcctaaacttggcttagcctaagcctaggcctagtctaaatcttaggcctaagtctaaagcttaggcataccctaagccgttgtacgagttgtcatgacaccaaaaaaccgggcacagacctctcaaaattagtcagatgctggtttatagggaaaatgcccttccggactaaagcaactgtataaggcagaggatcttaatgacttccaaaatttgtttgttcttacactctctccccatctaattaagggaacgccaattagcgccaatggcaccgcttttgccgatcagcaaaacaaaatgt

SEQ ID NO: 43798 - DNA, 1204 bp, Heterodera glycines
gttatgaattttcaaatattaggccaaaatcccgagggccaaaaaattgccaaaaaataaagaatttttaaaaaattccaaaaattatgaaacttaaaacagacatcatattcgtactcagcaccttattttaccccagaaaaatatttttgacccccattttcaacccaaaaaaaattttcgaaaatttctagggggcctagctcgaaaatttttgaaattttccgaacatgaagtacaccgttcgatagagtttaaaaagctctacaattttgctctaaggccatttttggctaaaagcaacccctgacgagttatgggcccgggactcaaatgtcccgctcaggcccaaatttttttctatttccgggaaaaaaccgaaattttttcaaaaaaattaccaatcgatagagcatcaaaaacggttgcttgaaagtggtctccgtttgtctgggaaaaatcgttaaaaaatcataaaattcaaaaaccccaaaacctacttttaggcctaactcggaaaattttgaaaattttcgaaattttaaaaactggaaaaatcgggcttttaaagctctacaatagtcccgctggcacccccttgatcaattcaaaccctgacgtgttattcacccgggactgaactggtcaaagttggtactgaatttctccatttttctgcagcccttcctattataggtagaggcctggatttttttttgttttttagtcaacacttcaacttagtttcctaccagcggacattttttgattagagtgtcagaaaaaaagttacgggccttgaactgcgagcaaaaacgggaaatcggtccctggtactcagttgggcctcggaccaaaaaacctatagttttcccagatgcgccgtctcgagttaccccttgctgcaaaatttcagccccgcagctattcccgaacttctcaaattagtttttgaaacgaaaccccttatcattctaacatatatataactagcgggtgcgtgaaccgtcggctatttagctgggataaagcgcttcgcgctttgggagcttcgctacctagattagctatcgggttgtgaaaagatttggaatttttaaaaaattatcagcgatttttaggccgcttcgcggcctcagacgggcgctacgcacccgttttttaaattcggtgatttttaggctgcttcgcggcctcagacggg

SEQ ID NO: 43799 - DNA, 968 bp, Heterodera glycines
tcgttgagcgttcggatcagcgagtagaatcgagcgcctgccggactcatcggcggtgacgacactccgccgccgccaccggtggaggaggcgggactgccactgtaaaacaccacacgggcgggcgatgccatggcggacgactgctgttgttgcggcgattgatggtggtacgggtggtggtgatgatgatgatgcattattactatttcaacactaacaatttaataaaagtgatcaaaaaggaaaaacgaacggaaataaacggtctgagaatgatcaaaaaattgataaaccggaaaagtgattgtagatgatcaacagagaataataaaatatgataaggaaagaagcaacaaatgttctctctatagcaaaaaataaattaaataacgactttttatttggtttatcccaaaaaagaagacaaaaaatcacatatataacaaaaaagtgctcatttttaacgcgcgcaaaacaatcgaggggaattgttgctggtgatgtgtgtttatttgccggtctcctccttgccctgggggcgcggtttgccgaacgtaaacggaatgtaacggtaccgaatcatatgctaaaatgggaaaaatggatgaaaatgaagcaaaaaattcaaaatgagacatttttgactatgctgaaaaccaagacttcgaatttgccatggaatttttaaatttgaaaaaaaaattgtcaatgaaaacctaaaaattttctaaaattccttaaaaattgtttttattataaaataaacattttcaaaaactgtatgtctaaaaataaaccgaaaaccccaaaaaaacggaccataatctgtcgcttcatcgtcagagtggtgagcacgataaagtacatcaccaaaattggccaaaacaccggtatgtcgaacatttcgaagaaagtgcagccaaagacgacaagagtggacttcatggtggacaacctgacatttt

SEQ ID NO: 43800 - DNA, 784 bp, Heterodera glycines
ttttctctctttttaatggattattatcgttaatcctgagaaaccatcaccgtgttacgaatttttcaatcttatacaaaattccagagggccaaaaaattgaaaaatattttcgaatttttaaaaaattccaaaaattccgaaacaaaaaacaaaggtcaaattcgtgctcagcacctcaaaataccccagaaaaaaatttttcaccacccttttcaagcctaaaaaaatttccgaaaatttctagggggcctagctcgaaaatttttgaaaatttcccttcatatagtataccattcgatagcatttaaaatgctctacaaaaaagttttaagacaatttttcgctaaaatcaacccctgacgagttatgggcctgggactgaaatgtcccgctcaggccaaaaaaaatttctatttccggaaaaaaatcgaaaattttctaaaaataccaccaatcgatagagctcgaaaaacggttgcttgaaagtggtctccgtttctctgggaaaattcgttaaaaattcctaaaattcaaaaaccaaaaaatcgttttttaggcctagctcgaaaatttttgaaaattttcgaaatttttaaacatggttggatagagctttaaaagctctacaaaaagtccgctgggcgccccctggctcagatcaaacccgggcgtgctattcgcctggtactgaagtgtccaaaaaaagtgattcttacgttgcctaacctacaggtcaggcctttgatctgatcaaaaaatttttggctggcaaagttgtagc

SEQ ID NO: 43801 - DNA, 1015 bp, Heterodera glycines
cgagtgttgttctcagtctttggggctcaaacaactagaaaaaacaattcgttcctccccagtctttgggaaaaagcaacgagatgaaatgtcgacttcgaattgaagcgacaaaattcctatccccgtgctgaaacaaaacggcaaaatgagcttactcagttgagtccaggagcgccacgttgaacaaaaattggggagaggatgtgctcgaacctcttcgacttgtccgggggttgtaattgaccacggcgtaaaagacaaaggcacaacgattgagaaaactcctaatcaaaatcaattcaacaaattaaaataatccaattttattgaagtccgaagcagatgaataatatcaaaataaattaggagaccacaatttgaagatgagaagcaaaaagcacaaaattaccaattacataaaattacggaaaaatgtcatcggggaaagtgaacaattaaccaaaaataatgagaacaaaatgccgccaaatttaaaatatttaaatcaaaaatgaattgtctttataacacattcggagcacacaactttaaaatttgggagagatttcggaatttggatgaaattaatgttcataatcgtatcaaaagtatcgtttcgcttcctgttgatcctctcgctaccaggttttgcaattgctccagcaattgctgcatttgttgttgaagcgcattaatctcatcttgcacatcttctccccatccaagccgacgttccaattcgacgagttggaaggcaatgtcgagcctttgttgtaaaattgggaattgcgcttgctgaggcatggcggcacgtccaacttcgccttccaatgcgagaatttacacaatgacttcaagaacttgaggggtgagaattggtcgtaagaaagcatttcccattaatttatttcttggggtgaaaaaatgtgattattacgaatatatatttaatctgacagaatgtttcacgataaatcataaaattatttataaatgaatgtttacgtagtgt

SEQ ID NO: 43802 - DNA, 1002 bp, Heterodera glycines
aaaaaaatagatagccatttttttgggtatatctattaaatttaaaaatatttgaaaaataaaatgcccacggcgccccgcacttcgttttcatgttcgagagcgtttgtggcatagaaaatttctcaaaaaaagagatgccatttttctggaatatgtattaaatataaaaattattggaaaaataaaatggccacggcgcaccgcacttcgtttcatgttcgagagcgtttgttgcatagaaaatttctcaaaaaaagagatagccatttttctggaatatctattaaatttaaaaattatttgaaaaataaaatggccacggcgcaccgcacttcgtttcatgttcgagagcgtttgttgcatagaaaatttctcaaaaaaatagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatcaattaaatttaaaaattatttgaaaaataaaatggccacggcgcaccgcacttcgtttcatgttcgagagcgtttgttgcatagaaaatttctcaaaaaaatagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgccccgcacttcgtttcatgttcgagagcgtttgttgcatagaaaa

SEQ ID NO: 43803 - DNA, 1213 bp, Heterodera glycines
gtcaaaaatatgcaaaagaatattttttcatggattctacgtagtctaattagtaggaaaaacagcttctttttggtatttgcatataaaagttggacttttatttgcatattttcagattttttgcatattttgccatttttcgacaaatattctcagatttgaatatccttagggaaaaaatttgattatgcctaaaataaatccaaatctgaatggatgcgcgagtgagtcaacagtgagtttcactgccgaaaatcttgagaaatttttgatttgcaattgcaaaaacaactgataaaatttataaggaataaaatttcctaattttcaattttttttgtgcttatttggtgcatatttcacgactttatttgcatatttatgcgcatattttggctacttttcgtgcatatttttgacattcctgattttcatattgaaagtttggttatttttggcaaaatctgtaaaagaaatcagggcaaaaaaaattccccggcagcgcctgtcggtacccgcaggcacctttccctaaaaattcgctcttaataaagttattttggacaaaatctgttaacaaacccaacaaatttcaataattttcaaccaaaaacttatttttttcttaagaattggacgaccaaaatgatgaaaaaaaaaatgcaaattatgggcgcgcttgccaatggacacttcagtacgcgcttttttacttgaaaaatgtcaagcgtacgtatatttccaattttctcatcgttttttgcctttttaatcggttaagaccttttttaaacggttttttgtttgggagctaagagacatattttccaaaaattggctcaaattcgccagaatttatacacaaattgcactcaaatatttcgtctctgatcgtttcgtcactgttcagttcgttactgagaaataattatttggctaatttcaataaaatactcttataaagtacgaattagtttaaattctctttaatttagttttgggtaataatattgtaccacgggggagcaccatttttcgaaaaaaatatttgagattttaaaaagtcagaaaataagtttttaaggttttcgagttcgctgatcacgaatttaagtgttgtcctaaatgatattgctctgagaaatctggagattttctgctgctgttttctgctcaaacccagcaaaaatttgatgcaaattgttgtctt

SEQ ID NO: 43804 - DNA, 974 bp, Heterodera glycines
  misc_feature (50)..(50): n is a, c, g, or t
  misc_feature (103)..(103): n is a, c, g, or t
  misc_feature (964)..(964): n is a, c, g, or t
gattagagtacaaaaaattgaaaatttcgaaatcatgtttctcactcccnttctctccaggggtattattttgtaaaaagtcttttttcccccaataaacttntcataccccatttttcgcaccgtgaatgttatttttattgaattctgaaccggtttgagtagattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaaagtctttttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtcttttttccccctaataaacttttcataccccatttttcgcaccgtgaatgttatttttattgaattctgaaccgngtttgagtag

SEQ ID NO: 43805 - DNA, 1213 bp, Heterodera glycines
  misc_feature (10)..(10): n is a, c, g, or t
  misc_feature (28)..(29): n is a, c, g, or t
tacagatttntggtctaaaaatattgcnnctccctccttatctccgtaaaaaattttcaaaaatatttcccttaaaaaatgaaattttggtttcttcccaccttataacaagatgcttgagtgttttcgtcaatttcatctgatccgtcaaggcagtcatcctctccatcacaacgcctaaattaagtgtaaaacaattttttattgaacaatttaagacacgagttaaattttcattattgagaaaaatgccaaaaaagagaaaaattaaaaaataaaatgtaatgaaaattaaaaacaacaacgaaattccatataaatgggatcaaattaatcattaattaatttttgctatattaaattccgaatttaatccatccctaccattccaacggaatgcatcgcccgttggcacattggaattggcttccattgcgcggacacaatggctcaacaggctccatgatatcgcgaatgcaggccaactcgttgttcggattcactttgtagcctgaaaaaatgagcaaattaaacgtctttttttggcatataattaattaattatgataaaattaattaattaattaattacctaattatgtgttctgacttattgttaaccaaccaaaaatgattctttattttcaaaggtgtcctgatttttcatttttgtaaatgattgcataatccattttttgttataatttaataaattattcttttttttttacattcatctcgccccaaaattaaatgatttttttgttttttgaaaggtaaggattttttaattgacccattaatgcatgtcaagaatctcaagtctctcaatttggattcaaaattcaccttgtttgcatgcacatttcctcttcaacggagccgactgatcactgcttggcacggcaaagcaaaagtgtgcacaattgtggccaaggcacggatgttttagatgatcttttagaaaaaaaggaaaattcatccaaaaaaatggttggcttagcatttagaagcctatttaaagtaatctaatgagggtaattaacgagggatttttattaaggaaatgaggttttatttgagcattaaatttaaaaaatatatttttttgaaacattcgataagactaagtaaatcatattaattgttaaatttaaaaaattcgaaaagggagaatttctttcggtattttttctttttaattttaatttaa

SEQ ID NO: 43806 - DNA, 1134 bp, Heterodera glycines
acatatatcatcattttgacaaaaattgcctaaggacaaaacgccaaaaaaccccactaatttaaaaattttgccgagattttcccttgtaaaaatggaagagccgatctcgagatagaaaagaaactttcagaaaacaaaagagaattcgatagagagggccaaaaaactagcctaggtaaaatttcaagaaaagttacccacaggaaaaaattttttcccatggcaacaaatttacaaaatcacctactttttaaggcaaaaaatggtacttacacgtaaaaaaattgataaattaaaaagaatgagtgattgtgggaatgaagcaaagcgaaagcgcaaggaatggcgccaggagtacggtcgcagggttggttcaaccccaaaaagtgatgaaaattgaacaaatttattttattttaaaaacactgcatttttcaggactaaagcagaccgaaaccgtgccaacagcagatggagaggggacatcgacccaagccgccgaaagtggaccatcaacgtcagccttggaccttcgtaagtcaaaaaagtcactaattttagaagcaaaaattaaattaaggccctcgttcaagcccaaggccattgtcagcgactccgatcaggcgccatgagcgtgtacggccaacaactaccgaaaaagcaacacacatggatttgacaacgatggataaggcaacagacgtggatttggcttatgaggacgccgcgacacaaaccaagcaattggacaaacagctgaaagagcaggaacaagtgatcagctttcttcaacagcaggtccgcaacagagacgcactgatcgctgatctgcgccgtcgattggaacagcaggcgaaggaccagccaacacgtaaattctgcagaatttttagagccatttatcatccaaattgtttttagcttccacacggcgcaaaaaaaatgcggctacattggagcggacctcgcggagaaatttggccgagaaaatcgttgatgtgatcgatcgagaccgctcccgatcagtgagccgatgttcgctgcaaactctacatcgtgaagtccgccacaaattcggacactacacaccaatggagaaggaacaactcctacaacaacaaacaatccatg

SEQ ID NO: 43807 - DNA, 1410 bp, Heterodera glycines
  misc_feature (1357)..(1357): n is a, c, g, or t
gacttattgtagagttttggaagctcgatttttccaaattttaaaatttcgaaaattttcaaaaattttcgagttaggcctaaaaaacgtttttttggtttttgaattttaggattttttaacgatttttcccagagaaatggagaccacttccaaaacatagtttttcgagctctatcgattggtgatatttttgaaaaaatttcgattttttcccggaaatagaaaaaatttttggcctgagcgggacatttcagtcccaggcccataactcgtcaggggttgattttagcgaaaaattgtcttagaacatttttgtagagcattttaaatgctatcgaatggtgtattttatgtttggaaattttcaaaatttttcgagctaggccccctagaaattttcaaaaaatttttttgggttgaaaaaggaggtcaaaaatatttttctggggtattttgaggtgctgagcacgaatatgacctttgttttttgtttcggaatttttggaatttttttaaaaattttgaaaatttttcattttttgggcctcgagaatttgggctaaaatttgaaaattcatatctggcctaaggtttgaccaattttgattaaataaagcattaaaaatggagaaaaatcaggagaattttatgggttttatttggattttctagcataaatatgaaaaaagttattccagaaattctggaaaaattcgaatttccagaaaaaaattcagaactcggttctgaaaagtcattcttgaaaagtaaaatactgcaaaaatccgcaatttttagccctattttataaattttatttcacctttttatcacatttttaaaaatatatacaaaaataaaagtgattttggtgttcgggaccacaggggggtgaccaggatttttgagtgaaaaaatttttctcacaaaaatcttccaaaaacatgtctttaggggttatttgggccgctgatcacgaatacgtgatcagattttacttttgacatcgttaagacctgagaatccctgtgtgattggggattctgagggggggggggaaggggggcaggttcgaatccggacggtgtacataatttttctgtgcatttttacgttatttacagtgatttaaattaatttaaaatattttgttgagttaataaataaaaaattatatttaaattaatttttttgatgaataaattttataagtttaaattaattatttttttaattgatagaatttcattatttttttaattaaatttgttaaaaaaattttcattttaatttaatgaatttactaatcactgttgtaccctttttaatcactgttttacctttctaatcattngtacacctcttctaatcacttttctacctgttctaatcatctttgtactgatt

SEQ ID NO: 43808 - DNA, 976 bp, Heterodera glycines
  misc_feature (951)..(951): n is a, c, g, or t
gtgaaaactggagaagaattgtttagccaaggcgtcagatctccccttatcggtaaaagcaaccttttttataaacaggtatagtattgctttttgttttgacaaatgaattaatatagccaaaacgtttcttcgcagaggtcgaatttagtaatttgttctccccgttcttataaaacttcgaggtttcaaaagtaattttcttagaaatttcaacatatttttccaattctttcttttttaatgtctccaaagtaattttcgataattaattaatttctgaatgtgttcaggcaatttgggctcaaaattgctttggactaatgggacatattctctaattaaaaacaacaaaaattgaataattttatgaaacattgaatcaatctcagtgcaatctgaaaagaaaaaattccagttaatcgaagaaagaacagagttaatcgctaaataattagctctacgaaaatcgaaacctttttttagaattttcttagaagtttttagcttaatttcacatgaaatactgttatgatcactaaggttaaagggagggccaacaagcacatttgatattaattgtttattatttgtaaatagaaaatcaagaaaatttcccctcttgtcggtgagataactaattgctgaaggctaaaaccatgaaggaatgataaaaaagtttttctaaagatttgtcggtcagattttttgagacatcaaaatgccattttagactaggaaagttaaaatcgccaaaaagaagacaattgtttgattgttcaattaaaagtgataatacttctaaaagttctaaaaagtcttcatatttttcttgtgttactggcctataaaccaaaattaagcgaaatttttggtcggaaaacggagaaagaatatctatacagcttatttcagcatttttgattttcggtattttgataatttcaaaanggtatctgatttgagatgatgaagg

SEQ ID NO: 43809 - DNA, 1731 bp, Heterodera glycines
  misc_feature (952)..(953): n is a, c, g, or t
  misc_feature (974)..(974): n is a, c, g, or t
attcatggacaaaactttggagttttgccatgatcatcctccctggttgcttaagaaattttacttttttttttatttcaggttaagttttttaaaataaagaaaattataaaaagaaaatttttaaaaaagaaaaactgcaaaaattttcttttttcaatgttatataagtcatttcttttaattcttgtaaatgagatcaatgttattaaatatatcatgacatctactccttttttatattactttttttaaatttccttatttttcctttttatttgccacttaataacttattttttataaccgggttaaaaatatatacaaaattatgaaaaacaggtttacgcggccttcacaatattattcagctcttatcattgttcttctttcaaaaattttcatttttgcataatatccaagttttgctctcgcttcttattaatggaagataatcttaataatatataagaattttaagcaaatttatcatttcaaaataattgattgtaaatttaaatctttcaatattttataatatttattttaataaggtttaaatattttagtttttagatgtattaattgtttgtgctgtaataaacttactgaagccttttggctttcactttttaataaattaatttcataatgataatatttttatgaatattttattttattattttttaaatttaaatttaaactattttatcagaccaataatatatcgagcaaactaaggtttgctactttagcgaaacgataatttatgtctttttaattttaattaaaaaatgagacaaataacgaattgttttatttatatctgatataaatcaaatcacaaataaaaatgtcacaaaggtgacgatagaaaaaaagatcatgtaaatatacatgcgataataaaataaatcttaaatcagaaattataaattacaataacctnntagaaatattgcataaaatgnaaatcatagtatgaaaattggtgattaattttataaaaatttttcaagaaaatcaacacattgaatttaaatttggaggtctgtttataattgtttacgcaaaacaaaaaattcaaacaaaattaataatttatatacttaatcattgaatctataaatttgattgctcattttgtggacggttttcatttaaaaataaaatttaaattttcgcttcctttcgaatctattgcaaaattcatattaaagtacatcactttaataacgccaaacgtgaagtactctcatttcggttatcagattttttttacttcgattttattgattgggtaaagaaaatatatttattaaaaatttatattccttttaaatttttcgaaaattcgtcaactttcgtcgtaataaataatattgcaaataataatcatgccgaattggacaagcttgttcacatcgcctttgttcaaaatagggttaagccccgaccctcggggagcaaaatgtcggtgaacggggaggaaattccccgaaagaatttgtcggggatggctggaggaatttgaaaaatgtcggggtgcaacaccttcgtctgggaggaaattttcataaaaattctaaaaaaacacaaaaagaaaaagtccagaacaaaaaagtcttaaaaactcatttcaagatacttccatcttatttcaggtgcaatttacaactttcataattccccgaaacatgtcggtgcttaaccctagttcaaaacatt

SEQ ID NO: 43810 - DNA, 984 bp, Heterodera glycines
  misc_feature (857)..(857): n is a, c, g, or t
  misc_feature (883)..(883): n is a, c, g, or t
  misc_feature (888)..(888): n is a, c, g, or t
  misc_feature (944)..(944): n is a, c, g, or t
cggattcattccgcccgttaagcatttgtacagtcggcattgtttacatgatgataaatctttttaagaaaattttatttttatctaagattaatttaattttttaattactttcaatatggaagaaattctttcaaatttagcttataaaaaatgcttatccaattaattcattcaaaaaggcaaatttaaattttattattattatttatttattttaatatttatatttgcgctttatttttccctttttcacctttgcactctccgccttttttgcagttgtattccttcatcaacgaaattgtgcgacgaaaaaaatgtttacaacctgaaatttctaaggcattctaaattcttgtgtttcaatttttccaattaaatggtttaatcccaagtttaattaaaaattaaaattttattaaagaatttaattttttggaattttgtcgctttttcattttattggtccattaaattaaagttaatgcaatttaaattaaaattgaaattttattaaatagtttaatttttggaattttgtccctttttcattattggtccattaaatttaattactttcacaacatttggccccataatagaaatattggcacgggcaattgcacaccgaacattttaagagataaagtgactttttgccagtgataggattcatcttttaaaattcataaatgccatcgaattattacaaatatgaaataataattaaatttaaaataaaataaaaagtgaatagggcaaaatgaatccataatataaaaaaaatattatttgttatcttatgagagaaatggaaatggaatatggagtaaaataagctgatgtggatatcnaattgattttgtcgtgaatgaattanatganaaaaagaaatttacaaaattctacttatgggatttcttttttttaaattaagcaantttataatttaaaattataaaatattattagagaccgcgg

SEQ ID NO: 43811 - DNA, 1000 bp, Heterodera glycines
  misc_feature (895)..(895): n is a, c, g, or t
  misc_feature (934)..(934): n is a, c, g, or t
caaaatgtgagaaaataattggaaatataattttaaaatataagaaattaaaattcaaaaggtcgaaaaataatttaaaaattcaggaaaattctgaaaaatgagaatttttgatttatataaaaaaatgatttgcctttaatacgcaaaatatttaaataatagagcagccaaatgcggcccaacaacctctgccagcagccggaggagcacagcaccaacaaactcaaaatgccaatgccgccgactcccaacggcttgtccaacggacggaatgccggaatgacattcgaaagcattgtgccaaactgttggcacagctgaaccagggcgaaatgctcactgacatggttttgaaatttttggatggttttactaattaacatattattcgttaaacaaattatgtgcaaactatttttgaaataatgtactgttttggaattaaaatgtcacagtagtcaattaaattaacggtctcttcagcaatttatttgtgaaaattgcacaccaaaattaggctaattaagctaaataatggactaatttgaaatgattatgtttttgtgtatacacctacctatccgataattaagaaggatagaataattgatattagttctcctaattccaatttttcgtgttctttaattaattaattgcattaattatatgcaaaatcggaagtttatataggtaattagcccataatttgtggccattaaggacgcattggactgtctgcaagatgccggctttagtgaaactgagagtttggaggcacaatgtgcgcaagccgtgtgggaattcaaagtcgaactgactcaggtgtggcaaatgatcagtcaatcgataactgaccgggaattatattcggctagtcgagactttttanatctctgtccaccgaattatgctacatccaattgattanataatttggacactaattggctaatatttggccaaatttgctcttctttaccagacatgcgcttcg

SEQ ID NO: 43812 - DNA, 821 bp, Heterodera glycines
caggtccatttttcggagttgtttttgtttggcctcgaaatcgatactcgtgtgtccgtccttccgtccgtccgtccgttcgttggtcggtcgccccgctttcgcttggccactcatattcccccacttaagcctccctcttcaccccccccccctccctcccttgtccccggcttcacctgtgcgctgttactgacagccgccgccgccgataagtttaggctttgtcatcggtggcaccgccagctgtatggcattccggctttaatgatagcatttgcatacgccgtcccccacgagtgggcgttacctgtgtgctactgcaaaaatgccatcatcccttctctccactggaccacccattaattgctcgattatctttcgcctctctcttctctctgcccgtctgtcctgtgctgtcattattggttttataccaattggctaatgctaatgattttgtttggaaacatgcttttgctcgtatacatattctttcgtcattgcgcatccgtttacttttccttatttttttttaattaattccctaattaatttatcttaaaagttcaactgaagtgttcggcaataattggaattgtataatttttaacttatttttattaattattttctaatgttatttatttgcttccatcttttagtttccaatcctgcattttgcttcacctgttttttgagcaaaataaaaaaaaacttcccgcaaaagcaggaatttgcgcgacacattcacattattattatgcatgagtgttattattacttataattattggatgatgatgcttatgaattatgat

SEQ ID NO: 43813 - DNA, 920 bp, Heterodera glycines
  misc_feature (7)..(7): n is a, c, g, or t
  misc_feature (63)..(63): n is a, c, g, or t
tcaactnggagcagttcaaagagaagctggaacacaccatccacggccgagaccagaggcatntggtgccctcaagggtggcatcgaaggacttaccatgcgctggctgaaaagcatggtcgacgaagtcatcaaatggtggatccgaatcgcctgtgtctactcaaccttcttgttcctgcgtgacattgtccttccatgcacactcgcctacttgttcaaccctgttcgggtcacatttctcagcttaatgggagttcgacgtcagccgcttcaaccaatgctcggcaaaacgctacgacaggaggaagtgccgcttcgagaagttctccgatcacctcagccacgcacttcaccgcaccgttctctgtcacccgtccacctggacgtgatcgctcgcagtgcccgttaccaacaaactcgagcgcaaagcgatgcaaatctggcagaagtcgacaccccgttcggacgacgaacgcgacgaagagaggagcactgaggaccacgaggatcaaggaacagacgagcccaccgagaaggaacagattagcccccacgagaacgaatgatggatgaacccgatgcctcgggaatgtcgaaattttcgtaaaatcaaaatttgattttagcgttaaaatgatgtaaaaaagggggtgataaggggatggtatgactgatcgatttccctcccgtgtttgtttgtttttaatcccttccccgcccgttcctcatcctgttcctccccaaatctccctccgccgcaaatttgccccacttttttctcccgcaatcgcaactgtgcgaaattgtacgctcatttcccccccccccaataaaaaatcgtttgttcgccaattttgccccctccaaagtctctgggaagcaatttgtagtgatcggcccattttaattgtaaattt

SEQ ID NO: 43814 - DNA, 743 bp, Heterodera glycines
  misc_feature (634)..(634): n is a, c, g, or t
  misc_feature (719)..(719): n is a, c, g, or t
aatcgatggcaaagagaacggcggcaaatttttcccctcctatggacaacaccgccccaaaaaaattcttgacttcctttgaccagcttcaaattccccccgaaattgacaacgacagcaccattcccgactacgcaaaactgcttattaagcaattgcagtcgctgttggccaccgcgtcgtctctggttcaatctcaagtgacggcgaatgacgcgattgaggaggaccgcagacaacggaccgttgtcatcaccaatgtgccggagttccaatccgggaaaggttcggaacgtggggaggcggacagagcactggtcaatttgattttggacacagtggacctcgatcaaaccccagtggtgttccgtgtcggcatgcgaacgcctaacagagcgagaccgctcaaaatggaatttcccacaaggcatgcggctcgacatgtgctcagaatgaaaggcaaggctctggctttgaatgctctacatggtgcgcggatcagggaaagcatgaccaaggagcaattggccgaacgtcggaaattaattgagcagtgcgcaaagaaaagaaaagaggacgcgggcgattggattatctacgcgaatcaggtcatcctgcgcagtgacattgacancaattcgtaaactttttaaatttttcatgtcaaatcaccccaaaatcatataaattttacaaaaaaaagttttgcttttttccgnttgggtagaaaatttttataaaaa

SEQ ID NO: 43815 - DNA, 955 bp, Heterodera glycines
  misc_feature (876)..(876): n is a, c, g, or t
  misc_feature (923)..(923): n is a, c, g, or t
atatttcaatataatttagaaacttctcgagaacgagcccaccagttcatttttgtttgagatcacgcattttacattgacatgtttaattggttgtggtggtggtgctcttttcgctgatcagcgagttttgtgcggcggcgccctgacgttttaacgctttttttttgcaccattttaggtcacaaataaattaaatgaaagagtggttttttgctgctgctactgctgctgttgcgctgatcacaatcattaatcatttattgagaatcgtcgttttgtgatcagaaattgttgtttttttcattcatcataccccccccccccctcccaattgggaaaaggaggacgagggcgaatcggagagaatatttaattaaatttcaatttaattaatttgtttttttcgttattttgaacaaataaacaaatgatgaaatttaatcaaattaagaaaaaatgatttttaaagaaacaaacacacaaacaaacaaaaacaagcacaaagattaatttgcgaaattttttttgtccaaaaataaataaaattcacatgcagaaatctgtacatacatattttcgtaactttaatgcaaataaaaatttaatttataaaaaattgcgccaagattttcctgttttaaaatttgagttttgctttttctgctttaaaatttgcctttgcttagtgttattgacggaatttgaaaaatattttggcctctcttatcataagttgctatgatgacaatcaaaagttgcacattcactttttgtctccggtattcaaaagatcgaaaaaggatgacaactagtaaaaaaaaattcccacagcattttcggctcccatggccattttcgatcagccattacaanaatgcacatattaattaagcaaaacaaacatttaaaggataaataanaccaaattttatgcaaattttacccaaataaa

SEQ ID NO: 43816 - DNA, 1027 bp, Heterodera glycines
  misc_feature (112)..(112): n is a, c, g, or t
ctttttttttataaactgatcagaagcgacccagatttgcgaggggcatcaaaaagacaaggaaaagcactgctatgattctactcccagtaattctgaatttaaaattttntattatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcattccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttat

SEQ ID NO: 43817 - DNA, 1165 bp, Heterodera glycines
  misc_feature (1110)..(1110): n is a, c, g, or t
ggtccaacttggctttggaaatggcttgtcttctggaaacccacctaacttgtgccgcgggcggaagatttcaaagggcacgacacttcggtgaattttcggtttatttagattaagacacgatttgcattccatattttttcagtacgtcaacatcgatcatacgacaggctctcgacacttacaaagatgtccaactttctcgcggaaaagtaccaagtggtcttgaggacttcgtcaatcggattttcaatcaaaacttggagctgaaagaatattctctggttgttggcttttcctcggacacgcgaagaattgatatgattgagagaactgttaacgctgtttcgaaggacggtgggagtacaacgacaattcttatggacacattgaacaagctgtacgagtctcatttggacgtcgaatttcatgaccaagttctcgggttgataatccgttttctggagtgccaaaaagagccgaattatttcgccttatcgcaggtaaatatatgtgtggtcggctgtttgttttatcccagtgattttagtgtttggttgaacttaaaaaagctcaatcagtggccgaattgttggaccgtcttcttgtccaggcaggcgtgcctttttttgaatttaatgccctaatcaaaaagatatttttgatgtttgcagaacaacgctctgatggcgtatcagttggcatttgatctttatgaaaatgcaccgcaggagtttttgaaccaaatgaagatgcatctctttccgagcagtccatccaccgaagaaccaaagacagagacaaaaacgcctgaaaaggaaaagttggaacgaattttgagcggcgtggagaccatcaaacatcacatgcaatttctcataaagaacaatcacaccgatatgttgatattgaggcagctcaaagacgcttcacgtgtgaattgcacacataatgctgtggtaattgccaatggattaatgcattgcgggaccacttgtgatgactttctgaggtaagaatgtctattcctttacaaaagcagttacatttgaaaatttagggagaatttggattggatttcgaaggggactaattggaataaatttaatnccgtggcatcttggaagctcattcacaaggcatttttgattttatatttggttat

SEQ ID NO: 43818 - DNA, 952 bp, Heterodera glycines
gggtttgaaaagtttatggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttggaaaaaagactttacaaaataatacccctgggagaagggagtgggaaacatgatttcaaaattttcaattttttctagtctaatctactcaaaacggttcagaattcgataaaaataacattcacggtgcgaa

SEQ ID NO: 43819 - DNA, 1269 bp, Heterodera glycines
cggtattgtgtttatttcctttcaattaattaatcatgtctctaataatggtcataatcacacactccattaaccatccatccctctgtttatgcatctttaccgcgccgttgtccaacagcagcagcacaaccaaagccattggcaccagcgatcgcttagcccagtgatggcggtgggcaacggaccaatgcccggcgggggtgaatctctgatgggactgagacgaagttcaggtgaaaacggggggagggggaggaagacaatttggtatttaaatgggaaaccaaaagcaattaatggggggggggggtggataagcgatgtgaaacgcataacgggacgcgtaaatggatcaaaaataatcgaattggcgaaagagtctgctgaccaaagaatgtatacattcgaaaagtaattaatcttatcgcataatgccaaccgttcattttgacaagagttgtcgtgcgagatcgatgagtccggtgtcgctgaaagcagcttcatctttgtcaagccgataaatgaaaagactcactcacaaatcttccaaagaacgcgaccttttgtatataaagtcaaaaagctacacatttcaaattgttttttttattgtttttttttgtaatttttgttgaataatcctttgatctcagcttggataatgaattttaaaaatgaaagcaattcgaagatgttttattgcctcttttctttctgttgctggcaaaacaaaaccatttgtccaatcgatccgatgcttttcccttccgttgcttcttctgatcagtgaaagcgccgctaatcgctcatttaattaacttcctctctttctactgatcttttacaaaaacacaaaagcattcattatttatttttgtttttattcatttctttcgaatttgataattttttattttatttcgttttgttttttccgctttttctttggtgtggcggacgacgaacatttccacccatctgttcttgttcttccgcagcgttctttcattgcttaaatgtggtcataaattggttgggatttttatttcgtttaattttttaactttattttaaagataaatacacaaaatatataattttcaccgaaatatttggttttaatgtcaagcaatatcaataaataaaaaaatcatttgagctttaataaaatatttatgaaaatattgttgatttatatcatttagtgattagaaatgaccaattaaaggtatctctctaatagaaatgattcatataattttgttg

SEQ ID NO: 43820 - DNA, 922 bp, Heterodera glycines
  misc_feature (49)..(49): n is a, c, g, or t
tttctgctcaacagtaataggaatcccaaccgcattctcagaataatancgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataat

SEQ ID NO: 43821 - DNA, 569 bp, Heterodera glycines
aatcattcgctttttgacatttcactttttggcatttcgcgtctttaaggctttattgaaaacatgaaaaaatccatgtgacgcattttgcacaacactcatttgtcagcaatgggagtgagcaaatgcttattcaattaaaagaatgggatgagcaatattttttcatttcaaaagcaattcggaaagaatgaaaagcaaaaggaaaaaatgtgaagtttgcttcatattttgttcacatattttcagcggaaattttgaaggaaaacagaaaaaacaatagcagaataaaaagagaccgactaaaaaaacaccaaaaatcgcgaaaaagccatgaaatatgcatttaattccttttattaaggatttttagagaacaaaacatgtaaaacttgattataaaagtaaaatgatggttatttaaatgattaataaaattttatataattcttttgattaaggaaatttttaaacctaaaattttttatcaagaaaaaaaaattaaattttggcaatcaatttttgagaaaattatttcaattcttggagtgtatttctgaaaatttttc

SEQ ID NO: 43822 - DNA, 758 bp, Heterodera glycines
aaatcttaattttaacaaaacatttttttaataaattatcatattttttaaattaaaaaacatttttgtttatttttagcaaatattttggggtgcattacggttccccccgaaaaattaaaaaaaaaaattataaacattttggataaaatgggtaatcgaatttaaaaaccaatttatagtgaagcttgtcgtttttacagtagaaaattagtcaaaattacattgaataaagacaaaaattttaagccgttttcaagacaaaaaccacaatttttatgtttcgatctagtaatatctagggaatttgggggttcggcgctgcctgttaaaattttttttgaaattctaaagaattttgtttttcctaagtccactctggtgcatccaaaaattttgccgggacttaatttcgccgccgaaattttttttttaattttttgtttggaatataacaatgaatgcactttatcatatgcttagggaagaggatgacaaccccaatatgaacattcacgcgtctgtgccgtattgatggtttcatcaaagaatgccagaagccactccacgaacaaagtggcatttgtattaatttaatgacttttgaatttattatagtcatactaaacctagagaaacaaaaaggaaaattgaaaataaaatgaaagactttattataagaccttcgtgctcgagagtctcggctagtaaaaatctcgggctttttgacttttagaaaaccggcgctttgtttcagt

SEQ ID NO: 43823 - DNA, 1179 bp, Heterodera glycines
tataaaaagtcaaggaaataatctgtcataattgataaatagatcaaaaaacgaaaggaatgaaaagaaaagcaatataaatgtaagtagccattagctgtagaaaatacaacagattaaatattatatatattttctaattactataaagctattgaatgttcattaaacaaataattaaaataaattttaaagttatgtaaatcatctttaagaattattgaataaatgtaataacttcgataatttgatcaacttattacaaattctgctaaccataaattaaataaaactgaaaatgatttaatattgaaataaaatatataataattaataaaagaattacaaaaataaatatttaataaatcatttaaaccgtggtgagtcgaaagacaaaaagtgcaaatttggcgaaggacaaaagtgcaaaatttgctaaatttttgactaaagcaactcataacttttcacagacacaaccgaattgcacactcttggtatcatacgatagcccttgaattgcattattagcttactaaaatcaaaaaatctattaagtttttcaaaagttctagccaaaaaaactgaaaaattgtaataacttatgaaaaacttaataaaattttttgaaatttatcaagcttataacacaattcaagggctatcgaatgataccaagattgtgcaatttggttgtgtctgcgaaaagttatgaattgttttactctcaaattttcactttttgtccttcgacatagcacccatttagacattgtgccgcaactccgttatttgaacgaaagtacgaatgacacttctgttttatttagtagcaaatttaatttctaaagaaattttatttaataaaattatttttaaagttcaaaactacagatttacaaaaaaaaagtttaagtatatttacacacagaaaatttttggttttcatatttttatgtgatgttaaatcgattggtcgaattttaaataattaattaaaattataaaattattttatttttgaagaaatttttttattatcttttaactttttaaaaatattcacattttaatgttgtcaatttattttataatttggatacattttttggtttttaaattaaatcacgttgaagtgatatatatctttactatattgtgttaatcattaattttatt

SEQ ID NO: 43824 - DNA, 1153 bp, Heterodera glycines
  misc_feature (992)..(994): n is a, c, g, or t
  misc_feature (1001)..(1001): n is a, c, g, or t
  misc_feature (1005)..(1005): n is a, c, g, or t
  misc_feature (1017)..(1017): n is a, c, g, or t
  misc_feature (1025)..(1025): n is a, c, g, or t
  misc_feature (1028)..(1029): n is a, c, g, or t
  misc_feature (1031)..(1034): n is a, c, g, or t
  misc_feature (1040)..(1041): n is a, c, g, or t
  misc_feature (1062)..(1062): n is a, c, g, or t
  misc_feature (1066)..(1067): n is a, c, g, or t
  misc_feature (1076)..(1076): n is a, c, g, or t
ctgagcagtgatcgaatggaacagatcatgacgcatctggcgattgagtttagcggtcacaaaatggaaagtgccaactctgaatttaagattcacaatcactgacgaaattcctgaagacaaacatttaaattgggttttgtttgaattctttttgattgcgagattttgttaaatacaaagtcttcatcgccattcacaatcagccccggccatgttaagggcgtataaaaattaccgtaatcccccagccaccgtagcgaccacagtcgtaccagtcaatatcaaaatggaattgaccaactcgctcatttggcttgcccgaaccataacagagataactcgcgcaataaacaaaggcatacaaacttgagctaaatgggcattttggaaagaaaatcaaaaagaaacacagaccgatggactcagttaaaagaaaaaggaatgccaatgccaaccaccgccaataaagctcacagtaacgcgaaaggcacaaaatgagcgaccaacgggaaatgttgggtgtttttcgggaagaatttccaacgaacccttggcattccttttcagatgaagcatcgcccactctgaaaaatttattactcgcaattatatgtatttattataacctttttaatccccttgaaaaatgtctctttccttttgcatctccccgcacaagcatttcagtctttttattgtacagaattaaaaagggtatttattattttaagcacatttaaaaataaaaaagtgagcgagctttttaatcaaaatcaaaattgcaaaaaattttaaatgtttacggataattttgtcagaatcaaccattttcatcaaaaggtagatattttgtagtaaaatttagagctcgaccttgatctggatctaaattgttcgcgtgggggatcgctctgatcagtgatcatgaatctgacattatttttgaccatccctaaaaaggatgggggggggggggcggtaaataaagnnnccgcttnttcntctctcctttcnccccccgnttnntnnnnagcccnntcttcgtccctctttatgatntttnntatgtatgnttattatattttcgtgccccatttgaattggaagtttgaaaacgatttttaatataatttttgccggagcgctgcag

SEQ ID NO: 43825 - DNA, 1215 bp, Heterodera glycines
  misc_feature (1195)..(1195): n is a, c, g, or t
cggcaagcattttgggatcagcacatttcaatggacaattgggatgtaaaatttattaccatttgttcctcgtccatctcggaacgcgaccgtccactcctcacaccaatcgccagttgcctttccgccctttccgttacttttgaaggcattataatacaattaccaccaattgattcaaactcaaatgcaacacgttgttcagcaaactcgaaaagggagtttaaaaaatttcaattttttatttatcatttttgataaaatttgataaataaattgaaaacaaaccgaagaatatgcatttatccgatcaaaaatgttgcaaagcaatgttgccagttgttccatcctaaagcaattgcttgtataaaatttgtttggataattaaaggagcaagggcgtagccagaactaccatactttttttttcgccaattatgggaattttgtggtccaggcaatgtcgataaacaccgcctgcaaatctgtttccatcttttaattacaaaactttttaattttttcggagggggtatgggggggggctatagctcctcgttcagtcatcgccctgacatggcccttgcagaagacgtaagaccaactttgtttttggcttcagctttaccaccagcggagcccatttgggcatggggcgaaactggtgcgaaatattgcgaattcatgggccaactaaacgatgactttcatgttgaaaaaatgcatcaaaagtttgaagaacctttaaaatgagtgggttttcatttcactttgatctgttgaatttttttgagttcatggtaaatgagacaatgtttaggaacataaaaaaagaaattggccaaaaaattttatttttaattattaaaataaatcgtaattagaataagttctgacctcatttctttgtgacttcgaaacatcaaattcaaccatatttgcagaaaaaacttttgaatgatgttcggcccaaaagggactgctgtccgaaatcagttggcgaatgatatgtcccgttcggtgttcaggataggcattgaatactcgctgtaacacatttgtacatccttaaaagggcgatatttttacttatccaaattgggtggattaggtccccctccgacggtttaatgaaaaaaaaaaaacaattgagaatttcgtatttttcaataatgttacaaattgttgaatccgnttttgcacttgttttgatcg

SEQ ID NO: 43826 - DNA, 1166 bp, Heterodera glycines
  misc_feature (1076)..(1076): n is a, c, g, or t
taatgtctttgtgagttcggcacagatcgagaccgagaatagaccatggaaagagcagctcgagctctacaaaaagctgtggtcagaaaaaatcggcactttaggagcggttttattttctgagaaaattccaaatttgtagaacaatttcccttatgtgaaaaacaaattttcaatttctcttaatatctttgtgagttcggcacggatcgagaccgagaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacggatcgagaccgagaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatgtctttgtgagttcggcacagatcgagaccgggaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacagatcgagaccgagaatagaccattggaaagagcagctcgagctctacaaaaagctgtggtcagaaaaaataggcactttaggagcggttttattttctgagaaaattccaaatttgtagaacaatttcccttatttgaaaaacaaattttcaatttctcttaatatctttgtgagttcggcacagatcgagaccgagaatagaccattggaaagagcagctcgagctctacaaaaagctgtggtcagaaaaaatcggcactttaggagcggttttattttctgagaaaattccaaatttgtagaacatttcccttanttgaaaaacaattttcatttctcttatgtctttgtgagtcggcacagatcgagacccggatagacattggaagagcagctcgagctctac

SEQ ID NO: 43827 - DNA, 944 bp, Heterodera glycines
tcatttgaatttcttgaatttgttggcattttaataactcccacatttttagtttgtttaattactggcgtaattacatcaaattgaatggagtcaactgcgacttggccttggtgttgtccattgcccggttttgtggtcgcttctgcatgcaacaactaaattaataaacaaatatataattaattatatccgctttaaatatatattcgactaaataaataaatatccgatataattaaaaataaattaggattaattgatttatgtattacaagtttgacaggttcatccgtggttggaatgtcaacaagtaccttgatgaaagcaggaatttaaaagtattttattcaaattctcatacttcttcctctgttcggctgtcttcaatctccacattttggcaatccaaaatttccattgtattcgctcgtacaatacaaaccttagaatgataattaaagtaattaaaatctatatctatatttttgtttaaaaatttatttaattgtttttttattcaaattaattacagataaacgggcatttccgttattccatgttctgagcttcagcgttccgtcattttgaagaacacactaaaaagcaattaatttatgtcgtttataatttaattacattccaaattaattaattattttatttatgcctgaattgtttcggacaccaaataggcgggcgcatttttgtgcaactgtgccaatgcaatatcaccatctaaaatagcgcatttaatgacaatcaataaacctatgtttaattaattaattaccaaagagtgtgttggctgcatctttttgcttttttctgacaccaatttcccatgcattaacatcgccagccaagccttcagggtttgcccatttacaaccaattgcacgctttgaaaaatcacaggacaatttcctaaggcacattaattt

SEQ ID NO: 43828 - DNA, 411 bp, Heterodera glycines
ggtgagaattgaatgaaagaaaatagtatgtctttcatagaaagaaaggatggaaaagcggccattatttttgtaacattctttattttagcaaataaatatttatttttaaataattttattctcaattaaaatgttttttgttcgatggaggcggagtgtttccctgtcccaacaattttcttctgctgctaaagcattcgcacatttcacttttaaaattgcaggtgctaaccccataaatttcatttcttattcaatttaaattttattttttatagaaaaaatcatcccagggcagaaaaatgtctgcactctattccaatacactaatccaaattgtcaaaatggtggtcagcagattcaggcaatttattatgttttatttcactaaaataaaccaaaaatttg

SEQ ID NO: 43829 - DNA, 971 bp, Heterodera glycines
tcttcggttaagcgcctctttttgattcctctggcaatcattgttttttctcctttttcctccgctcttttttccacattttgttgttgcttctcagacttctttttttcttcttcgtccttttttgccttctcttctgcttccttctgtgctttttcgtccgcttccttcgccgccttctcttccgcttccttccgtgattttcttccgcttccttccgcgtctcttcttccaatttaaatcgattagcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattttgcatgaatccttcgctttaattccatttatcttataaagtcagattaaataattaccc

SEQ ID NO: 43830 - DNA, 670 bp, Heterodera glycines
ttcagtttggaaaaatatttatgttagttatattcgtccacttctagaatattcccctgaatcttggaatccacaactaaaatcgcatattatcaaaattgaaaaatgtcaaaaatatttaactcgaatcgctttcagaaaatgttgtcttccatatattccctatgaccaacggctccaattttttaaattagctactcttgaaaaacgaagaaaaatttttgacctcctaactgcttacaaaattttacatggttttacacatttggacccaaattctctgtttaaaagaactaacctaaatactcgaaataagtcatttttccggttaaatgttaaattacaatctaaaaaatcttccaaatcttttgttaacagatcagtcaaggcctggaatgcccttgataaaacgttaatgtctagctccttaaacacctttaaaaaattattagaattgactcttgattctcaaagcaccaatgtataaagcaattattaacttttgaggcatctcactgactctgacttccattttttttttttcattattgtttgttttaacctgtgatctcactcgatatttattcacttactctgagactactttactgtgaacagtcatcagagtaagtggtctccgcccttctgatggcaatttttctttatcgat

SEQ ID NO: 43831 - DNA, 1163 bp, Heterodera glycines
tccgcctgagaaagtgctcctcctcttctgctgctgctgctgctgttgatattcaattggcaattccaatataaattcgttgttttttaccttttccttggcatcatttcgctcaaatggcatttcggcccaacttttgtccttttggagttcgacgtaccgtccgaattccgacgggggtggcgaacggtgaggggacgagggactgccgagcagacggattttgtgttcgatgacgtgaggcattgaaattatacaactcgaaaaaagggtaacggtgaaagtgagaagaatgggacaaaaaatgaggtgtgagtgaatgagggaaagttgacggggcggcgagggataaataaataaatgttggcgaattttgggacggacaccgccgcccaacgcaaaacaccgaccgaactcaaagaaaagcccattgtcaacgccccctcaagcgcaacccatcgaaacgttctctttgcaccccgtctttgccttttgcattctctcccgacaatgagcagaaaatggcggaaaggtaaataaacagcggagggggaaaaaggaaaaaaggaggggaaggagcggataaaggggataaaccaaagccactggggagacaatggcattaatggggggagggggcaacggcgaagatggcacttttacaaaaaaataaaaaaggatttgtgagcaaatacatatattgtgcgtaaatgatattctcccttctaaaagcattcctttctcaatgctcgtttttttggtacagaatatgacaaattcggttccccccattttcagtgaggcaacgatttgcaattatttttggattttaataaatcaaagattattaatttagcattaatgtatccattaaaaaacacagttctttatgttatacaagacgtgacatcccttcccaaattgcatttttcgtttgtttggtccgcgtggtaaacggtcgcccaattcagataaaaattccctgtgtaaatggatcagcgcttacaaatcaggctcaatgattttgatttttcaattatttttttgtgtatttctcggtcctcttctcccctaaaattcccccccccccctttcacagttttttcccctcccccgccgtccccttttattttttgttcccccccaattcgcccccccccccc

SEQ ID NO: 43832 - DNA, 1453 bp, Heterodera glycines
acatttatttgttcggatggacgaaggagggatgaacaaaatagtgaaagcgaaggtatttcttccgctcaaataattccaagaaagaaaggcttggtgttcgcgtgggttcgattccacccgccaaggactaacatttggccatttcttgttcgattgagccttctgccctcccttccccctaaccccgcaatgcttccttttttcgggggatggcatttgttttttcatttgacttttcccccccccccctttttttttctccgcccaaattttccatttccatttctgtattgagaaacatttttacgagtccctttctcatttaatctcttcccgatttccaatttttggtcttttgttcgctaattgattgcttttccttttattgtctctcattatgccctcctctttactcggcttgtccttttcatcgtcccccgctcgtcgtcgttcaaattcgaacttccgccaccattccctcccctcccctttgacttctctctcccaaaattccgctaatttagtgcgccgtctctccaaagcgttcttccaggagaaagatgagcagcgaagcggtgagtcttttttggggaatgccaagcaaaacagagattaatttgccgactttttgaagcgaaaaggtgtaatttataatttactctctccgcctttttctttcccttcgcttttcccttttttcggtgccaatagcgcctaattcatttgctgtcgttgtccgacatttgagaaaaaagggaaaacaaaaagaaggaacagaaaggagctactgctaagggtgggaagaaataatggaaatttgggaaggattgcgaaagaaacagtaaaagtggagaaaagaatggagagacggcgagagagagagacagagagagagagagagagagatagggggcgagagagggaaaagagagcgggacagagagagagaggcgagagagagtaaaatgtgcagagacagtgccgaaagatataagcgttgaaaagtgccgttgagcttcctctcccgctcagttgcttgtgtgccaatgccaatccgtcttttttctccgtgccgtaatcgatttgagtggtgacagagaaagaaaggaaaaagggaagggaaaaggagaaaaatgcgccgggagagggaatgaatgggctaagtaagtgagttttgctgccaccgatgcatctgtcaccccatccctccgcctgccttttgaccaaattcttccaaatcgggcattccttctcattattattgctctgccgagcttttgtcggcgttgccatttcccccggcccataagccaaaaatggtgccgttgtcgccctcactttcgccgcccttggttggcactttttgttgttgttattccgcgttttgtcaatcaacaaaatgcataaaaacagagcaaaacgcaaaacgaccattccttggaatcattca

SEQ ID NO: 43833 - DNA, 1312 bp, Heterodera glycines
acgatcaagaccagtgatattccgatcatagtaaattgatcgaagattgggacaatcgatcagaaatgttgtgaaagtgcttgcgagcagtccacgcagtcgtatattgctactataaatttggaaaaattactatggatgcaaattttagataaaaatcgcaaaatgtgtacaaacaaaaaaatattaaagatttttaggtggaaaaaaagcgacaatcgatttttattgtttgacaaaataaacaaatcgaaataaatataaattattttaaaacaagattttggtcaaggaaaaattaagtcttagaagattaattttgaatttttttagtgttgaatttttaaatatttcgattcttataaatgttttttcgtctttaattgcatttttgttaagaaaattttatgaaaatactaacaaaaatgccaaaaataggtacaaaaacatattatttttgatcattattttcttaaaatttagtgatttttttgtagtgtaattccaccccccccccaccctaatgatcagagaagccaaaaaattggatgttttttttcattttttcatgtttcaattagtagagatttttcaatttttaatcaatttttaaaaattatttatttaaatttcagtattttatatataggtatatattatatatcctactgatcaatgagagatggattttcggtgatttaagagcgttttactaaaacgtacctgctatacaacttgtggatgttggtgaagccgatcagaggaagaaaattgtggatgaacagtccccaactccgctgattccccttcccgtcttccattagttgtaaagtgattcccattttgaaaagcggcataaagcgattaagcaatgagaacacagagttgtcaaagtaactgaacgtaaattcttctcattaacgccccgattcgttcttaggaaattttggatttttgccataaattagaggcattcctattttgacatttcgaaccaattcggcattttgaaaaaataccaaaaattcaatatacagaaaatcaacccataagaaaggagccctgataaatttctcaaaaagttgtaaaatgaaacaaaaaaattttttttaataaaaataatttaatattttttctttaaatacaaatcgaactttctttattgaaaacttatattacttatatttttattagtcaaagaaatgatgaaattatattcttttgtaattaaataagttaagtcatttacatcgattttaatttattttaattgaaaaaagcacattttccaaaaattttcgcttattttttt

SEQ ID NO: 43834 - DNA, 752 bp, Heterodera glycines
tgattgaaatgttggtggattgagtcccagtgattggaatgttggtggattgagtcccagtgattgaaatgcagaagaattgagtcccagtgatataatgcaggagggttgagtcctgttgattggaatgttggtgaattgagtcccagtgattggaatgctgttggaatgttggtggattgagtcccgttgattggaatgttggtggattgagtcccactgattgaaatgctgttggaatgttggtggattgagtcccagtgattggaatgctgttggaatgttagtggattgagtcccagtgattggaatgttggtggattgagtcctgttgattggaatgttggtggattgagtcccagtgattgaaatgctgttggaatgttggtggattgagtcccagtgattggaatgttggtggattgagtcccagtgattgaaatgcagaagaattgagtcccagtgatataatgcaggagggttgagtcctgttgattggaatgttggtgaattgagtcccagtgattggaatgctgttggaatgttggtggattgagtcccagtgattgaaatgttggtggattgagtcccagtgattggaatgttggtggattgagtcccagtgattgaaatgcagaacaattgagtcccagtgatattatgtaatgatgattgaggcctgttgtacgtaatgttggagaattgagtcccagtgattgcaatgctgttggaatgttgccggattgactccc

SEQ ID NO: 43835 - DNA, 1077 bp, Heterodera glycines
cccccccccctctttcgttctttcgctcctattcagccacttaacccattaatttatgcgaatggcgcaaaacttagcaattaaaagggtcagtcactcattcactgagacgccatttacttatttagaagggataaaaattaaaatggcaaaaatctccgttgcccattcaaaatgccaccattcctcccccactccttctttcccccctttccccccacctctccgccaactctccgcccattagccacactgccaatgtgccaaaatccaagaattttaagttacttgacacattcctcccatttacttgcggttgcccgggtgagtgtcgccgtaggccaacaacagaattttggggggttgggtttgtttctccggaagggtttgacctttctgccagtgagttgactttgttccgctccagctgaatgaaaaaaagctgtcacctctcgacgacgaagtaaagtgagaaaggacaaatgccaacaaaatatcagtccattgtcaaggcaaaccgtcgtcaaaatgccaaatttaaattttacatggcatttcatttcattcttttctcctcccccgccccccaaacacttcggtcgcgccattcattcagcgccatttccctttctttctgatgctcatctcaatatccaattgacttagtgcacgcgagggtaaaggtgagaacatttgggacgaggaaaagcggggggaggggggtaaagggttcaggagaagccattagcgacttggcatgggtttgggtgtggcatgggtcggctcacattcgtgtgtccccagcgtattgaatgctcacttagtgtgttttgttcagtgaatgtgtcacctttttgtgcccacatacggtaccaaaaagagcagccgaaattatggcaaattgcccaattagcacattaatagcagcgcataaatttcgtacaattgccgcttcttctttggatgggcgggggggggaaggatcgccggtcgctatttgcttttaatgccaataaaatgcttcaagtcgggatttttctcgctctctaatgggttaatggcacctgtaaaaagaaa

SEQ ID NO: 43836 - DNA, 1079 bp, Heterodera glycines
  misc_feature (87)..(87): n is a, c, g, or t
tcagtgtgttatgtgcctgccacaacaaccgctcaacgacgcacagacgccaacacagccgttaggtcgccccacgagcgtgcaccncacattggcgcagcgaccaacaaaagcgaggcagcccgccaccgacacattgccacgcagcagccatacacaggcttacccatgtgcagcactgagcggtataccacagctcccaacgtatggaagcaccccaaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagact

SEQ ID NO: 43837 - DNA, 1068 bp, Heterodera glycines
  misc_feature (66)..(66): n is a, c, g, or t
aaaaatggtgtaagtaaaaatcgtaattacgctcaaaaagctcctcaaacattttagcgctccaanttccttctacaatcgcctttatacatcccattatgaacgctaaaattatcagagtgccgaaaatcgcatgtgacctaagcctagcaaaaaatggtgtaagtaaaaatcgtaattacgctcaaaaagcttctcaaacaattttagcgcttccaattccttctacaatcccctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttattcatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaaatctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgcccgaaatcgcatgtgatctaagccta

SEQ ID NO: 43838 - DNA, 936 bp, Heterodera glycines
ctatctctttttttctacaccgttgtacatgggggggtttccccaaaaacgcattactatctgcggttgagccctacaaaatgtcgggttgaaaattgctttctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaatgtcgggttgaaaattgctttctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaagggttatctctttttttctacaccgttgtacatgggggggtttccccaaaaacgcattactatctgcggttgagccctacaaaaggtcggtttgaaaattgctgtctcagaagaatagatattctcagaaaatggctatctctttttttctacaccgttgtacatggtggggtttccccaaaaacgcattactatctgcggttgagccctacaaaaggtcggtttgaaaattgctgtctcagagaatagatattctcagaaaaatggctatctcttttt

SEQ ID NO: 43839 - DNA, 1649 bp, Heterodera glycines
gggttgaaaaagagggtgaaaaatattcttttctggggtaaattagggtcctgagcacaaatatgatgtttattttaagtttcagatttttctggaatattttaaaaattctttattttttggtaattttttggccctcgggattttggcctaatatttgaaaattcattgctcagtgaaggtttggtcaatttaagtgaattaaagctctaaaaatagagaaaaatcaggagaattttatgggatttatttgggttttctaacatcaatatgaaagaagttattccagaaattctggaaattttagatttttcagaaaataattcagaactcgcttctgaaaagtcattctgtaaaagtaataaactacaaaaatccgcaatttttttctctattatataaattttatttcacaattttatcactttcttacgaattgttacaaaaataaaagtgattttgggattcgggaccaaaggggggtgcacatgatttttgagtgaaaaaattttttcgacaaaaatcttccaaaaacatgtctttaggggttatttgtgccgctgatcacgaatacgtgatcagattttacttttgacatcgtttagacctcagaatccctgtgtgattggggattctgaggcatcatttttggggggaggaatgaggcatcacaatttgtaaattttttgtttttttttctaagcaagtcatggtttttacggcattttaaaaacgcatggtgaagtttggctgtacctgagaaggtatgcgctctctacattgcgaaacttgggcatgggccgaagccgactgagtgacgaagtgaatttattaatttttttagctttatccacgacccgaggccccggattttttttttgccattttttttaagctcaaaaccgactgtctatttccgtcgataatacccataacaaatgaacggtataaactattcaagccgacctcattaaccctattttccgactttggaatttggcaatactatcgaccctgatattctttttttggcattatgcagaccgattgcaaatgatttcaaataccattagccaaaattccggaaccccgaagaagcttcctacaaaagggcggaatgcacttaatttaaaattaaattttaatgcttttttagatgctaattggtctacgtgaaatgtcggctaaactccgttccgacatcaagcataatggtccgtgtagcattgatttatgcaaaccaattagtgtgctggtcggctcctccattagcatgcttttgtttggccacccgctgaaagaggtaaataattagcgattttctgaagcaaatatatacataactcataattgtggtttattaataaatttattaaattaataatatataattaatagagactggctggccgattcaaaagattcgatcttattgaaaaagccaaaaaaacttcaattaattcgtggtaaatttttatgcttattatttattaggaagacgtggatgattttttgaaagtcaaagcgcaaacgaccttgcttttcttgttgttctcatggtaagattttgaatatttttgaaatataaacaagcaaatgaaattgtaccgtaattagagagatacgatcgctaattacaaaaaagagac

SEQ ID NO: 43840 - DNA, 769 bp, Heterodera glycines
ttgagcaaaattatatcaaaaaatattttcatttgatggtttttttgactaacgcccattatgatggtttttgactaacgtcatagcaccgaggaggcaggggctttcctgtttttggatttatgcatatttttattccaaagtttttggattaaatatccaatttttggatttttgggtcacttagtgattttttgagctcgagatcgatgccatctcagattattcaggatttctaattttattaatttacaattttctcgaaattaagaatttacaggtctcttgaatttcacttgacagtttaaaatttgtaatttttatgctttatttgagcaaaaaaataaaaacaaaaattgtttaatggattcataaaaacagtgtcagatgctttgttacttttacaataagaaaattgtgcaacggaaagaagattactgtataataataatgatagagaattaaattttatggacatgcctagaccgtaaattgaaaatgtacaagaaaacccaggtccaggaaaaacccaagcgtatgaaggcctagtttttttatcggtattttttaaagttaagtactggaccttggacgcaattcagaagctcgaaaaggggaatttggaagtcgaaaatctgtaattcctttgcatgcgtgcataccagagtagccaaatctgctgatttatcatcattttgctgttttcaacaggtcaatggatgggttttctttgaaatgtttttaaagcgcaaaattgacctaaaaatta

SEQ ID NO: 43841 - DNA, 739 bp, Heterodera glycines
  misc_feature (62)..(62): n is a, c, g, or t
aggaatatgtgccgtggtgccccgccacatcgacggcacagcttttccccccgcccctcccnccaactccagtggcattgtgttgtgtttgtgagtgtgttattggattaggttttatgtgagcaaaatgtgccgtgccattatccgtgtccatcttccgatcctatctttgcgtcaatgttgtgctgcttttgccttccgcctccttttttgttgtgtcaacaaatcagagtatggcacgggcacacaacacaattaggccacttttttggcttgttaaggataatatatttttttgagtttacattaagcattcccgctgcttttttatgtttgtccaaaaatattcttatgaaaccggctggtaaatttttaaaattataaacaagtttaagttttccaaaaaatctattttttgagtttctgtttttaaaaaaggaggatttagagtaatagtgaaaaatagatgtgtcgtaattttaaaaatatttcggcataaaataaagaaaaaatgcattatttttgtgggtggcgtcaatggccaaattgactttgatacccaatgccgaatttttgggggaaagtggcttttaagtggttccacgcccaataataatatcaataataataatgaatgtctcaagcgagtaatacaatctttatggccgactggcaatgataatacaataatgcgaaattggaaaccattattggcaccaacctctccccaccccccccc

SEQ ID NO: 43842 - DNA, 1193 bp, Heterodera glycines
  misc_feature (784)..(784): n is a, c, g, or t
cctcaatttttcgcctccgttctgagatacgaaagccgcatcattagagacgcgcctttgccttggccaatgtctccggcaaaaagaacaccaaaagtgccaattctgccagtgtgagtgcaattgccagtagagccggggacgggttgaactcgccactttcccgggcaccgatcgagaaaaaggcgccaatggaagggccaatcaaaaaagccagggagaaggagccaccaattaaagcctataaataaacaaagattaactagaaatagcaaaaatttaaataattgtaatttaaattaaattaaataatgtaaattaaattcaaagttcgactctctttttggcatttgctcattaactcaccatgcctttgccccgctcttccgttggcataatgtcagtgacaattgcgatcgctaccgaaaccgacgctttgcttaagcctccgatcagtcgagaaacaaagaaaattgaaaaactttcggatgacagtgaccaaagctaaatttcaagaattaatgaattaaattttaataattttattatttttacgcaatatgaaatcagtgagccaatcacagcaaccaaaagaagcgattttcgtccatgcaaatcggacaatgagccaaaaatgggcgatgagagaaactgcagaaatgagaacagcgagccgagaattccttttaattaattatttcatttttaataaaacttaaaaaatatttcgtccatttaattaattaattcgatttaattaaattgcctttttaatttttcttanattcaaaaacaaagaatgtacctccaaagaaaacaccattatttcgttcaattgaaggaacgtttagaaaagtttgaaggccatgcgcaacagaatcaaacacagcaaaaattggatcctcaaacaaattaaattataataataaaaatatttattaaaattacagatttaattttgtgtcgttttgaaaaatggtcgattagtgacggaaacaaaggcaaaatgagcgtaaatgcgagcagatcaagcaacaaaatgacggccaacagcggaaggggtttcaatgcacgcgtcagcatactgtaaaaggagggaagaacgagtagagtactgtaattcattttttgtataaattgggaagaaaatcctaaagacactgtgatgaaggaactctccaaatttacacact

SEQ ID NO: 43843 - DNA, 985 bp, Heterodera glycines
gtcattcattccattcactcatcttgattattcatttacccctctttatatttatttatttttgttagttcgacgcttagaaacggaccgatcgatttcgtcatttttatttgatcaatgaataaattatttatcataaattatttgaacaataataattgattttttccacgtatttctttggttgggaataaaaatttaaattatttaacaaataaataataaataaaataaatatttctcttttatttgctcatcaaatcatcgtcgatggcacttgtgccaacattcgcttcagctttttgttccctccaaccattgccatttcctccgacgcccttttctcttcagaagcagccgcatttgcagcaacattaaacaaatcctttaaatttatttattttaatccttttttaattatcccaaatttgactctgctcatgtcctccgcaagttttgtgatgtttttacgctgtaaaagtgcacaaattccgagcccagaaaagccaagaagaagcattgtacagccagccacgtggtaataccatccgttttgaattgcttttgcgttttgccaattctgaatgccaaaacaaaaaaagtgaaattctcccccctcccctcccctttttatgccttccctatttaccgttattagaacaataagaccactgatcagaaggatgaggccgcacacaaaaaggccggccaaaacgagaattgtctgcggggaactcggcacggatttgcgcagtcggcgatcactctcaaaaagggggggggggggagggggtgaaaacggaggcaattgaatggcatttggaattaaacgaatgccatttggaagtattttccaattaaaatgcgtttatgtacttctgtgaattgcggcatctcttcccacatcagcgaatcgtgtcgaaaaacggaataccgtcgtttcagctaccgtaattttgttcttctgagttttaattgcggacga

SEQ ID NO: 43844 - DNA, 903 bp, Heterodera glycines
  misc_feature (855)..(855): n is a, c, g, or t
  misc_feature (871)..(871): n is a, c, g, or t
ccggcccccgggtaccgtccttgcctcggctacaggtaactccgacgtgttgctccgggagtattagacgcgaattatttatttatatttttacatataattcgaaaaagaaaaacggacgacggacgaaataaggaaaaaaagcaaaaaatttcgtcggggaaatcaaaagatcgattttttattttttttataagtttaattgatttttggtttttttgagtcccgctatcgatttgcgaagtcaagtctcgagctcgggaatttttggtctcgaacagcactagtaaattggacaccggcaaaattacttatttatgatatttcagaaacagacatcaccactcattcggataaaataaacaaattgaccaatgctgttgaccaaattgaggtttcaatgatgagtgcagcagaggtgaatttaaaattaaatttcgagaccaatgcttttcatgcttattaattagcccaatgccttttaacaaacaattggataatatatacttagggttatgaaatgtaacaacccttttcagcaaagagacatctttttcattgtcataatttttatgaaattttatgaaatttttactaattttgcaggctaaaagggaacagaatgataaaaaacctcaaaaactttttttctaaaatggtattttaaaattagtggtcacttacgggttccctctacgacctaaataggtatttaattccaaaattttaaaaaatcctggcaaaaaatcgcctaaaaaataaaacaaccgaaaatacgtaaaaaaggacgacaaaaaaaacatgaattttattctgctggaaatttgttttcattaaatgagagtgatcaattanactgatcggctgattngattgattgtttactcaaaaaaatcgcattta

SEQ ID NO: 43845 - DNA, 1167 bp, Heterodera glycines
  misc_feature (67)..(67): n is a, c, g, or t
gatcagttatgtcttgtcgcgcactgaagacgaccgtgccaaaaaaacatttcgcctccaattcatntcgtcttcctgactactcgagagtatttgggcaattcgttcgttgcaaaacctaaaaaaccaaacagaattcgacttatgcgataagcaaatttactgtagaataatacagtccctacttatacaaagtggccattgtctgagaagcttttgcaattttcatcacgcacatttgtaatgtacccaaagcataagaatctttccaaaagttgtctggacttatccctaaaaatggaaaattaaatcataaataaaattaaaggacctggtgttgcataaaggaaaaactgatggaaagatttgttcggcaaaatccaacgcatctttcccagtgaatgtttctgtgaatgttcgcaactggcgccggtgagtggacaatggcatactctcgtgaaaatttttgagggccttcctccactgaaaaggaatgttgtattaagggttaacacttaaattagtaacaaactttttttgtcgcttcaaattggtctttctttacaccgcttatcgaaggcgtatcgcaaattggtgttggcatattctcaaatataaataaagataaaaagaataggtaattaagagggtaaaagtccgatgtcctttcattctctccggttcatcaaattcaaaaaataaaatagagctcaatatttcgtttcgaaaataaattttgttcaatcttctcattgaaatattgtaataccgtgaattctctttttctgttttcttccaaatccaaatacctaaagttttgaagtcatagcaacgaagcaatatggctcttgtgcataatttcttctacaaaaataatttaaaagaaataatttattcttcgcttaaaacttcctcgcctttgggcatgttttcgtgttgcttctccaattcagtgattttttccataatttttgaaaattgatccgcaaaagcttaaaaattaaatcaattatttaatttacaaattttatttttgttttaatttctcgccgccttttgactggtcttctcgctgcttctccaaatctctggttttttccaaaatttttgacaattgatccgcagtggcttaaaaatttaatcaaataaattaacatattttatttt

SEQ ID NO: 43846 - DNA, 1172 bp, Heterodera glycines
  misc_feature (1045)..(1045): n is a, c, g, or t
taaattaagggatacgaaggcggtgttccggaggaatctctcgactttttccgctcgccaatgtttttgctcagtgaacgcgctgcgtccacagaagaacccttggcgagtgaagcggcgcgtccgtctgaaaatgaacggcagcggaaggcggcggtgatcgcctgtcattatcaggtgatcaaagggaccgaaaatggcgagagaaaggcgatggcatttgttgtgggagttaaaacaaaacctgatcaggtccaaatcttcttcaacgatttgattgtttgtgcctctgatcccgtgccgctccattggccttcgttttgtgtcccatttgcccgaattttcgatttacgtgtgtttgaaagacccgagaaggtccggtgatcaagattaaattaatgttacagactaaaggttggtcttttttagattcgaattcgcctgatggagcgtctgtcacgaatggcaaaatggcaggaaattggggaagttttcttgcctttgttagctgaccataaaaccggcacttctgctgacgataatcgtaaggaagaaggatcgctggttggacttcaatttgcctccaccgtacaccggggaaggtgggactgaaaaagccgggaccaaatgggggaatgggggtggggtcagccgagagcactttttgtttttttcagtttcaaggacagtttgggctgtggcgggcaagcgccatttatgcaaggacgattattctgtgcactcaaatcaaccagtggaaaaagaggcgaaaagaatgaggaaagaaagggacaaagagaaaaggtaggaaaagggaaaagcaatgaaagagaaaatgatcagaagtcaaagggagatcggaatgaatgaaaagttgaaaagagtgattggaataaatttataaggggacaaatatttaaattcgtaaagcgcaaaaggaaacgattgaatgcatgaaaagcataaacttccaaccccttttcgttttcttccgctgtttttgctttttctcatttcccctcattcccaaaaggtcactgccaantatttgtcgtcctcttttcccttcgcttttcccccgccgtgccattctttgctcttctcaaattctctcttctgatttgcgtctgaacgcattggaaaaagcgtggattgactggagcagtcggcct

SEQ ID NO: 43847 - DNA, 978 bp, Heterodera glycines
  misc_feature (31)..(31): n is a, c, g, or t
aaaaaaaatacatttggatgcaaccttattnttcctcgcctctctttcgaaaagaaaagctattagcaagcgtgttgaccaaattctaaaacaaatcggagtaattaatataatctgactttataagataaatgggaatgtaagcgaaggattcatgcagaataataatctatataaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtatttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacgataactcgtcaggcctttaagatagacctgccattgctattcctgcaaatatgcagtctagtcagcccaatcgattgctattagaatggtttggggtcgttggcccaaacaaaagttg

SEQ ID NO: 43848 - DNA, 1236 bp, Heterodera glycines
ctgtttttgtcataactgttacaatgttttttttgccccccaagagaaggaaaaacttataatatctatgtttagctactatataaatgaatatcccaattagaaaataaaaacaaagcgaaaccttcagtttggcaccgcctttttatagcttcaggcaaagtaaaccctaatttttttttcattcaacgggcttttgcttgtttatatccaactgttttccgcttcatcaacacaattcgatatgagaaaagtcaattgatgcagacatcgcccgatgcatcgctggtgaagtccctcctctaaagaagcccaaatatcgtgccgccgatgcgagaattcttcgacttttgcaggaatacaatgccatcaacaataacccggctatccaaaatgaccacaattaccatgccaatgttaatcccgataatatcatcaatttgctcgttggtattctcgaaattatgaaatgcgcccgtaatttttcaatgcttgttatttttttgttgttgttaacacattgataaatatgttatgttattaattttaaacattttttcggaaaaaatcagtagaatctattttggacaaaaacagcttgccgtactaaactgaccctcgtactaaaccgaccctcgtactaaaacggccgtactaaaacggccgtactaaaccggccgtactaaaccggccgtactaaactgacccggtccgtcaaaatgtcgccaagccaaaaaataatgaaaagtcgaataatgattaaaatttaagaattttagtaaatttaatgaatttatttgtaaaattttgtagatataattcacaatggatcgaaaaaagactgaaattcttcaaaaatgtcgtaaacgcaaattcttggataacaatgacagcgaaaacgaagggaattctgagcaccgcgaacaaaacgccgaaaatgatggatgcgatgacgattttgaagaagaacgcgccatcatcaacttcgaactactcaaaatggaggcatttgtctttggtctgaaggtgggaaatttgctagaaaaggatgaaaatttgtcaaaggctttcggtacacacacgaaaaaaacgaccgatggaggtgcactgtgcgtggctgccatgcccgcgtgacaattgcggacaaagtgacagcagcatgtccgggtttctcggacaaaaagagcacaatcatttacctgagcccccgaaacaaaatgttgggaggcatttaat

SEQ ID NO: 43849 - DNA, 884 bp, Heterodera glycines
  misc_feature (857)..(857): n is a, c, g, or t
tcaagggccgactcagtccacaaggatagaaaaagaaatagggattttggaaatatttttcaaatttcacgggacaaccccgtactgaaaaattccaagaaagtgtgggtttccctgatatataatttcaagggccgactcagtccacaaggatagaaaaaagaaatagggattttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaacccgtactggaaaattccaagaaagtgttaggttccctgatatataatttcaagggccgactcagtccacaaggaagaaaaaagaaatagggattttggaaatatttttcaaattttcacggacaaacccgtactggaaaattccaaggaagtattgggttcactgctatataatttcaagggccgactcagtccacaaggatagaaaaaagaaatagggattttggaaatatttttcaaattttcacggacaaacccgttctggaaaattccaagaaagtattgggttccctgatatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactgngaaaattccaaggaagtattgggttca

SEQ ID NO: 43850 - DNA, 968 bp, Heterodera glycines
ctgatgtgtgatcctggccactgcggtgtttgggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaacccatctagtagctggttccctccgaagtttcccccaggatagctggagctcgttaagccagttatactcggtaaagcgaatgattagaggacttggggacgaaatgtccttaacctattctcaaactctaaatgggtatgaagccagggttgcttgactctgaacccaggcgttgaatgtttgagctccaagtgggcccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtagtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgaagaaagggaagtgggttaacattcccacgccaggctagg

SEQ ID NO: 43851 - DNA, 1089 bp, Heterodera glycines
atgcgtggcaccggtgctcagttggaatgggcatgcgtggcacccgtgctcagttggaacccgagggcttggcgaatgggcatgcatggcgcccgtgagcagttggaacccaagggcttgcgaatgggcatgcgtggcacccgtgagcagtgggaatgggcatgcgtggcacccgtgagcagtggaaatgggcatgcgtggcaccggtgttcagttggaatgggcatgcgtggcgcccgtgagcagttggcatccgagggcttggcgaatgggcatgcgtggcacccgtgagcagttggaatgggcatgcgtggcacccgtgagcagttggaatgggcatgcgtggcacccgtgctcagttggaatgggcatgcgtggcacccgtgctcagttggaacccgagggcttggcgaatgggcatgcatggcgcccgtgagcagttggaacccaagggcttggcgaatgggcatgcgtggcacccgtgagcagttggaatgggcatgcgtggcactcgtgagcagttggaatgggcatgcgtggcacccgtgagcagttggaatgggcatgcgtggcacccgtgagcagttggaacccgagggcttggcttatgggcatgcgtggcacccgtgagcagttggaataggcatgcgtggcacccgtgctcagttggaatgggcatgcgtggcacccgtgctcagttggaacccgagggcttggcgaatgggcatgcgtggcacccgtgctcagttggaacccgagggcttggcgaatgggcatgcgtggcacccgtgagcagttggaatgggcatgcgtggcacccgtgagcagttggaacccgagggcttggcttatgggcatgcgtggcacccgtgctcagttggaatgggcatgcgtggcacccgtgctcagttggaacccgagggcttggcgaatgggcatgcatggcgcccgtgagcagttggaacccaagggcttggcgaatgggcatgcgtggcacccgtgagcagttggaatgcgcatgcgtggcactcgtgagcagttggaatgggcatgcgtggcacccgtgctcagttggaatgcgcatgcgtg

SEQ ID NO: 43852 - DNA, 1088 bp, Heterodera glycines
  misc_feature (879)..(879): n is a, c, g, or t
  misc_feature (977)..(977): n is a, c, g, or t
tgtcattgtttccaaagagatttctattaccagattgcccttctaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttcaaagagattctattaccagattgccaaaaaaagagatagccattnttttggaccgtccataccccacatatactccaacggcccgaaaatcatttttagagcataacaactgatgacagccactgtcattgtttccaagaganttctattaccagattgccaaaaaaagaaatagcatttttttggaccgttcatacctcactatactcaaaccgcccgaaatcctttttagaaattaacaactgatgacagcc

SEQ ID NO: 43853 - DNA, 1387 bp, Heterodera glycines
  misc_feature (547)..(547): n is a, c, g, or t
  misc_feature (591)..(591): n is a, c, g, or t
  misc_feature (655)..(655): n is a, c, g, or t
attaaaattcggccgttagcctctcgatttaatataaattagcaggtcttttcggcccgcttccgaccttccaccgacgttcgtctcgctcaatcattttgacgtattccggtgaaatctcctggccctcctgtggttttccgtaaatcaaattcctgaaaagtttaagaattttataaattttccacccttctcgccctctgttagattttcttcacctgtagtcttgccaatcgagcaagccattcttcagctgctcctccttgtaatttttccatgtccgctcaacatcattgttctgtaaaaaaaactttattttatttttaaggattagtcagatataagaaaataaattgaaaaatttaaaaataaaaaacgaaatttataatcaaaaatttcaaattaaaaaatttcaccgaaattaattaaaataaaaaaattataaacccaagaagacagtcaaatttttcaaaaaaaaaaaaattaaaatctttcagctaagttaaaaaaaataaattccctcaagtaattaatttttttttcttanatatacgcaccacataacgcttctgcatgaaattgatgtgctcncgtagttccaactcatccacttgaccgtccgagtttaggtccatttttggcactaattttctgntaaatatttaatactttttttttgttgtaattttcgaaaattacgcgagtcgttctttgctcttctccggcgtcaactcctcgtactgtctggcctcgtccttgccaaggaactgttcatggtcatgcttcgggtcggtttccttgccactcttcaaaaatgaaaatttcttaaaaaatgttcgtaaaatattgaaaaatgtcatattaattatttaggaatttatgcaacaaactttaaatagttttaaaatttaagcgattgtttaatttaattaaattctataatatctctggttattcaattagagtaattattaattaggctcggattttgtcgaatggatgacggattcgtcatcagcgacctcgaaaaccctttgaagaataaaaatttgccatccatttttcacaagtctcaattaaaattgtcaaaatatttttttatttttcattattacctgtgaatttgtgtcgctacgttcatcgatttgttccatgtctcccagggctttgattgcgttcagtcgagttcgaatcgctcttttgtagccggtttccataagactggccaattcgagggatggtggcgtttgaagatttgaaaataactgcaacagaattaattacataataaaaaaagaatcgtctccttcgaattcattttatttgcaaatatttataatttttctgttttcacaaagttttgagtaaaaacgaacacccaattttt

SEQ ID NO: 43854 - DNA, 1246 bp, Heterodera glycines
  misc_feature (300)..(300): n is a, c, g, or t
  misc_feature (1176)..(1176): n is a, c, g, or t
ctgaaatttttcaattctaaataattattacaaaaatatatttggattatatatgtgaaaatttaatttttttttaataattgtttatttatttatgaaatgagtttggtttcaattttcgcaaattaaaaatttaaaatattatttttctagttttttaagtcccacctcgcagccaatcacatattggaaaattcagaaatttaactattttatagtcctgatttttgacaattttaagaaaatctattaatcaaaaattctttaaatttttattttttactcatttcaaaaacaganttttgattcaagagaattgtcttttgagaaaattgtttaaaaatttgtatttgcatattttatgtatattttgggcctcattaggcatctatttttagggtttttttcgtgactaaaaatctcatcccatttttgctcattttataaaatgttcgagcacaaaaatttttacgtgataatgagcaattcaatgagaaagccgatagccgagctcaaattggccaacaaaatgaataagtgatagtaaaatggtaggccgaaatagctccacgttatactaattgccgaggtaattatggcgcacaaattgagcgataatggagggattagttgcttgccaatgcgaatgttctcagaaagctaaaacgggaaaggtcaatttctttaattgcttcagtacctgcttcaaaaatttttaggatgttgcttaaaatttttgaaaaagagaagcaaaaattattgatacaaaagagcaaaaaaaagaggtcgttcccgaagaaaatttttttgggggcaaatcttagaatcggagctttttatgcttttgcaaaaataaaagttgggaactctgtttaaaaaagcacaccgaaaacaaagaaaatgctttaacagaatcaattctcatttgacatttgaattgattaaattttgaaaaagagcaaatgtaccttttaaaataaaacttatttatttaatttctattttaatttaaattaaatttgaaaaattcaaaattgcctggtagcgtaatgataggctgtgttggccttcattttgcatcattttttgataaatttttaagttatagcggcaaagtttcatgaaaatggccaattccacacttcctgccaaacacttcacagctgttgtaattanattggcaagcggtcgggcactatgaggagatgtagtgaaagcaatgtaaatgcaaacggtcaactaaaac

SEQ ID NO: 43855 - DNA, 1249 bp, Heterodera glycines
atttttaattcctcttatttatttgacctatttatattttcatagggaacatgtttcgcgcattgggggcatagccagaaattatcaaataatgatgtaccgaaatgcaaaagactgtgctttttacacctgctacaaatctcgtaatgacagggacagtaatgacaacacttaattttatgtgggcagttcatttttcaatttaattttatttttggttgctatttatagaaggggtatataaagggagtgaaaggaccatttgattgatacacaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaaagccacggcattattatgggaatccggaaaaatgatatgtctggggacgaaaagtctgatagactgtgaaaatgctattaaaaaatttatagaaataattaagggttcggggtgtccgggggcttcttacaccggacacacggttgaaaatattgtttcgacctttaaattcggacgtgaaattgaactgaacgagtttcgaaaaaatcgtcgtgcattttatgaaccggaaatattttgtggtttaaatttcaagcggggtaaaagcatgacagcgttaattttctggaccggtaaagtcgtaattacgggaactaaaaacaattctgaaattaaggaaatgtatcatcatattctcccctatttgaaaatggctcaaaagaagttagggagacgataaaaaaattttcatttatgggacggtcccccaatttatagttctgttggctatttattttgttatcgattacttcgcgcggcgccggcattgcggcgccggacgggcggggagggaggggagaggtgataaaaaccgcacggttttggctaattttcaaaaagaatttttaatttcaggatccgaaaaatcatcataaaaaaattcaggattgagaaaataaaaccggcccaaaaggtttgggatcaaaaagatttaaatttgcaaaagaaaaaattgaatttccttcacctgtcactttggtgacaggtggatgattgatgaccttccgcggcgctgcgcggcgcggagaggggggagtgaaaaaaaatcgccagtgcggatttgaggaaataaaatctacaaggcggcagacttcaaagaa

SEQ ID NO: 43856 - DNA, 1065 bp, Heterodera glycines
  misc_feature (1033)..(1033): n is a, c, g, or t
aaggaattggatgcgctaaaattggttgagaagctttttgagcgtagttacgatttttacttacaccatttttttctaggcttagatcacatgcgattttcggcactctgataattttagcgttcataatgggatgtataacggcgattgtagaaggaattggatgcgctaaaattgtttgagaagctttttgagcgtaattacgatttttacttagaccatttttttaaggcgtagatcacatgcgattttcggcactctgataattttagcgttcataatgggatgtataaaggcgattgtagaaggaattggaagcgctaaaattgtttgaggagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttagaccatttttttaaggcttagatcacatgcgattttcggcactctgataattttagcgctcataatgggatgtataaaggcgattgtagaaggaattggatgcgctaaaattggttgagaagctttttgagcgtagttacgatttttacttacaccatttttttctaggcgtagatcacatgcgattttcggcactctgataattttagcgttcataatgagatgtataaaggcgattgtagaaggaattggaagcgctaaaattgtttgaggagctttttgagcgtaattacgattattacttacaccattttttgctaggcttagatcacatgcgattttcagcactctgataattntagcgctcattatgggatgtataaaggcgatt

SEQ ID NO: 43857 - DNA, 1087 bp, Heterodera glycines
  misc_feature (24)..(24): n is a, c, g, or t
  misc_feature (972)..(972): n is a, c, g, or t
tcggcacaaagtataaattaattnaggagaaaaaactggttgcttccccgaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatatcttccagaaagttaaaaaatttgaaatgtgaccggaaatgccaaaaatttcaatctttttaataattaagggaaaaaaattttcatttaaaagatttttttatttttcccatgatagtctgctaatatgaagactgatttacataaatgtgatttgtcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatatcttccagaaagttaaaaaatttgaaatgtgaccggaaatgccaaaaatttcaatctttttaataattaagggaaaaaaattttcatttaaaagatttttttatttttcccatgatagtctgctaatatgaagactgatttacataaatgtgatttgtcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttattctatgcttgtttangaacagaaacatttaattgttttatttagtgtctgtatttatttggatatctcttccagaaagtaaaaaatttgaaatgtgaccggaaatgccaaaaatttcaatcttttttata

SEQ ID NO: 43858 - DNA, 1273 bp, Heterodera glycines
taatcactgttgtccctcttctaatcacttttgtacctcttctaatcacttttgtacctcttctaatcactttttacctcttctatgggaaaattttttcctccaaaattgcttaaaaatgacttttctgaggaatatgacatatatttgagatgaagaaaaaattttttgaaattccggcttttttggccactgggaatttagtgctatattcaaaaattcataactcgggatagggagggtgaatattcacaatcaaatacttagcaaatgcagaaaaatacgatgaattttatgctttttatttggtattaaaataacgaataagaaaaaagttattccaaattttctaaaaaatttcgaattttcagaaaaaaattcataactcccttcatattaggggtacaggtaaaatttaatcatccaaaaatccgtaatttttagttctacaaaaaagttattttcactatttatccatcacttcttcaaaaaaagttatcacccgaaaagttgtttcgaatttcctgacccaaggggagacccttttggttttcagatggacaaaatttttcttcaaaaatagcctgaaaattatttttctgggctatttttggccactgatcatgaatataacatttattttgagtttcatatttttcttctggcgaaaaagtggtctgatcactgttgtaccttttttagtcactgttgtacctcgtctaatcacagttgtatctcttctaatcacagttgtacctctcctaatcactgtggcccttttttcatcactgttgtacctcttctaatactgttgtacctcttctaatcactgctgtacctcttctaatcacagttgtacctcttctgatcactgttgtacctcttttaatcactgttgcacctcttctatcactgttgtaaatcatttaatcacttttgtacctcttttaatcaccgttgtacctctcctaatcactgttgtacctcttttaatcactgttgtacctcttttaatctccgttgtacctcttctaatcactgttgtacctcttcaaatcactgtcgtacctcttctaatcactgttgtacctcttctaatcacttttgtacctcttttaatcaccgttgtacctcttttaatcacttttgtacttcttctaatcacatttgtacctttttaatcaccggtgtacctcttctaatgacttttgtacctcttctgatcactgttgtacctcttctaatcactgttgtaccttttctaatcaccttt

SEQ ID NO: 43859 - DNA, 1229 bp, Heterodera glycines
cccccccgcccttcagagcacgacaaatatttcaacaaaaatttttaaaaattgactggagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcacttcctgaaaaaaatatttatgaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggagtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatatggaagctattccggaaggattcggtctccccataaatctgggcgcatc

SEQ ID NO: 43860 - DNA, 800 bp, Heterodera glycines
ttccttttaagcagtgccgatgattactacgcgctccgtttgctgtacaatttgcccgtcggatttgcaattgcgctgctcatttaccacttggcttggtaccggatcaacttcgccgactccattctgatcaacccgttctggaaggagttcgtcaaatggctgatgatcgtctctgccgccctgtcctattcgcttaatcccgttggtggtggtgatgttctccaacaactgatgcttgcttccacactaatggtcacttcgttttcagttggtccgtgcttctctcggctgtgccctgttcgccggactgggcagcaccgggcaggggtcagttcagtttatgggcatggtcagcacggttaccccacatttgcgccccggacatctgcgcataatgtccaaaatcggattcaaaatggttttttcaatccatgatagcctaaacagctttttcacttaaatttaatgctgttcaagacctctaagatgtaagtttgaatccaatttttgatataaacacaaatgtctgggcatgggtcggcacaacggcgcgcattcactcacaatcagtgaatgattcattccaattttcagattactgtccgtttttgtggtcgaaaacttaaacaaaggtggtgatgaacatctcatcctcattttcaacatgtttattatgtaatattcacattatttcaaaaggacccattgcgaatgtcatccaaaacttcaacatttccacgatgataacggtgtgtcacttgcagctccaagcgcgcataaccaaaagtcgaattgaa

SEQ ID NO: 43861 - DNA, 1099 bp, Heterodera glycines
  misc_feature (32)..(32): n is a, c, g, or t
aaaaaattttaagagaatttttgattattaantttgacgtctttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttccgtttgttttggcattatgatacccgaatacctttcggaaaattatggaaacaaaattggagaaattccaaataatttttttgactgcaaattttttttcctttttttgaattggggttcaaaaaaaattttaaagaagaatttttt

SEQ ID NO: 43862 - DNA, 964 bp, Heterodera glycines
tgtatccaacagagaagcatagaatgtcatttacggtcctcccctgactcattaaaattccaaaagccgatttgacggatcttttttctaaaaattcaacaaaaggactaactattatttcttcccgtgtatccaacaagagaagcatagaatgtcatttacggttcctgatttactcattaaaattccaaaagccgatttgacggataaaatttctaaaaattcaacaaaaggactaactattatttcttcccgtgtatcaaacaagagaagcatagaatgtcatttacggttcctgatttactcattaaaattccaaaagccgattggacggatagaatttctaaaaaaacaagagaagcagagaatgtcatttacggttcctgatttactcattaaaattccaaaagtcgatttgacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaaccagagaatttcatttacggttcctgatttactcattaaaattccaaaagccgatttgacggataaaatttctaaaaattcaacaaaaggactaactattatttcttcccgtgtatcaaacaagagaagcatagaatgtcatttacggttccctgatttactcattaaaattccaaaagccgattggacggaaagaatttctaaaaattcaacaaaaggactaactattaattcttaccgtgtatccaacaagagaagcatagaatgtcatttacggttactgatttactcattaaaattccaaaagccgaattggacggataaaattttctaaaaatttcaaaaaaa

SEQ ID NO: 43863 - DNA, 624 bp, Heterodera glycines
caattatcataacagttatgcatgaaaattgcgaaaagtcgaaatttttgaagttttttcttaataaaatttttccaggcttgaaaaacttttcgtttttgataaggctaatagagcatgttaagagctttcgaatgataccaagattgttggatttggatgccaaagaaaaaagcttaagtggaaaaacgagctggcgccgaaacgggagcgccgaaacacgagcgccgaaacgcgagcgccgaaacgcgtgggtcccgtaactagcgcctatttattcaaataatttaatggaccttcgctgtcttcacaattgtgtctctgtggtcgctaaattccgccccgggcgccaattgcgggtttaatgagccggatgtggcgaacaaaatggttgtgtccaaatcgccaataattccggaaacagtttgtgccgcgttgatgcacgcctgcgtgccttgggagccttcgctgagaacggcaacaatttcgcggattcgctcttggataagcaccgaatgttgtgaaagttgctgataaacgcgcttaatggagaaggaggaaagaaataaataaacactcaaaacaaaggcatggccaaaagaattttgaaattatttccaaaaa

SEQ ID NO: 43864 - DNA, 1132 bp, Heterodera glycines
ttttttagaaagaatatcgtgaaatattgaagacgcgccccggttgggtcataaaattgtgctaaattcggattcgaatttcatttgcccatccaaaaaccaatcaaaatgcttctgctgctgttattgttgtgtcaagaactttgaaaaattcaaacaccaatcgagtgcatatccgatgaaagaaaagaaaatgtttggatacaaaagctaagaaaatgaaaaaaattaaaatatttttctttaaatttattaatcaatttacacgccaaactttgagattttgattatatcactgtgaacacattaaattttctttaattgtaattaaccacaattctttgaataaccaaattttaaatgcacagaaattcaaaatgctttttaaaaatggaaattgataatctgccaattcagaataagcctttgcaatcgaaagtttgtattaaatcacgattaaattatgtgaattatttgtttcttaatctttatctggtaaaaacagtaatgatcactttacatagattttaaataaaaaaataataataaatttccctaaaatctcccaaaattcactttttaattcttttgaccctcacaaatgtgtttcctttttgccaacattgaaaacaacagtttttggcgttttgtcaccgtcgtcaacagggcttgaattttttccaaattttcaagacggatttttttattttcttcataaattcccttaactctataaatttcggctcttaatgaaatgcttaaaaaatctgcatcgactttgccaaaaattggcattttttcttcatttccgatgccaatatttggcgcacatcccccattcaaaaagtcgataattgctgtggcactcattcgtttttcagggttaatgtcgagcatattctgaaatggattgttgggtcaatttaataaacaatttaaaattataagctaattctcaaatattgaaattagaaacattattactaatatttaaaaaaaattttattttattttttattttatggaagaaaccattattaaaaagaaaacaacgttctttgaactattttttttattcttatgttgtatctttgaaaaattttgctaatcttttttatgggctgtttcgcta

SEQ ID NO: 43865 - DNA, 1044 bp, Heterodera glycines
  misc_feature (29)..(29): n is a, c, g, or t
  misc_feature (81)..(81): n is a, c, g, or t
  misc_feature (89)..(90): n is a, c, g, or t
  misc_feature (119)..(119): n is a, c, g, or t
gcctggcagggtcaccccttcagaaatgngacccgaaaaaaaatcagaaaatacactctcctacagaattagaaaattttntctcaaannaagatcatcaaaattctatattttttttnttttaataaaaaatttaggtttaaaatttcccttaatcaaaaatgatcaaaattagacgtattcaatttttttattttgggttttcgggaataaattaagttttcagcattttggtgactattacgataagattttataagataacatttgtcaatatattttcatttaactattgtccattacgcccaaaagtaatcaaattttataatcttgatattattcatagcactaagtgttttgttttatcccgcaaaaatttataaaatacataagggttctcgaatggatattaagaattaaatttttagttgcttttatacaaaggtatagcaaaaaaattttatttatgagcaaaatattcacgcgcgctcttcgccgacaacaataataatttgataattcagtttttcgcaaataattaaaagcaatcgttttttaaagagtggccaaattgaatatgaattcctgttcgaaatttgcataaatcatgtcttcgttgttgaacagcataacgaatgggaagtagtcactgagagatgaagcatttgccaaaatgtacaagccgcccgcatctgaacaaaaaaaacataattcattttccataattataaaatggtaaattctaaaaaataaagttttttaaatttctggtggaccgaagtggcagttttttctatgaaaatttcaggaaaaatttctgaaaatttttcaactcttcaacgatttttgtaattattttttgaaatttaaaaagttgttatttttttcttgaacttgagttttcttcggaagaaatttacgtgaccggaaaatgcgtaagtgatacaaaataataatgttctgtagcattatgtactgtagtataaaagaagaattttatgagataccttctgaattctgagccccgggctcaattcaaacaaa

SEQ ID NO: 43866 - DNA, 1058 bp, Heterodera glycines
acgaaatttaataatattttagcctttttttcttcaaattttaagtcgcattattatttttgaaaaaaagatttttcaagtcactgaaaaaaaatttttttttttttgatttttaggaaatttcttttaaactttgaaggaacaaaattatgaggaaaaaattttcccacaatatgacacattcattcccaaaatacccatagtccccttagattgtctccccccccccgttaaaaaaataaaacgcacaaatcgggccttattgtagtagctgactgcggcataatacggtgccaaaattggccaaagaatggtgtatttgatggcataccaagcagcccgagtggtcagatagcggaaggcgtaataaactgaaattaaaaacggaaatcaatgtaataggtgtactatttttttccgtttatcgtcccattttacaaccatttgtgggttaattaaagttgaatccaaattaataaatgcgttgtgaaacatagtgcaaggagttgatattttttgtataaaattttgttggcaccgtctcaaaaatggttcggcgtgaaaagaaattctcttatatacaaaatttttaaaatcaaagaaaaattcattaaatcgtgaaatcaaaaaaaaaagagtcggacttaattcagaaccaaaaacatacctcgaactaacgcgtattgaacaacggtgtaggcaaaaattgcaaaaaactgcactgcataaaagaacagttgagtccatgtccattgatcaggacgacgccttaaaatgcattttccaacgtaattgatgttacaaaaattagatattataaaattgaatttttggttgaaaaccggagtttaaatcattatttaccaataattttgccatgtgccagttgggtatgtcaagaatggtggcgatgccgagcgtggtatttgggttgctggaaaacgacgacaaagccgaggatgcacgtagtcatgagagccaatgtgcggcttgtaggcggctgagtcggaataggtgtacctcgtctcatagggactaaaaaaactcgaaattaattt

SEQ ID NO: 43867 - DNA, 987 bp, Heterodera glycines
aaaaaaatccccgaaggagagaattaaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcccataaatctgggcgcatcggttcggggggac

SEQ ID NO: 43868 - DNA, 1663 bp, Heterodera glycines
ttcggttccccgaattcgaatttgcaattgggcggataaacttccgcctgaataatcgaattttcactgtcgaaaacgatttctgctgactctacggtcgcaatttccgttttttcatcgatttgtgccaaaaatgccgacaaatttgtgatttgggcgaccactttgccgttttcaacttttcccactgattcttccactttaacatttcctttcacagtttggggagaaatgaccacatcttttccattccactgatcaccaacaccaatttcgatgaggcgggttgagcggggttgaatttttgtagaaaaaataacccgagcagaattgctatcattttgggatatttcctcaaattcaatcatttctttgttcgctgtgtcgtacagaagaaatcctaattttgaaagtgaattggtgccaagaagcaagtcgtagccaaattgtgcggatgttatgtgaaagcagatcggtatttgactgcaaccttttcgtgtgatcggaattgttaccactccaaaacatttcaattgttgcccatttacatcggcaattcgtgctgacgttcgagagaagtccgatttcttgaggtctaagcctcgttctttgatcaattcatacagaaatcctgctccaatcagtgaaatttgggctcccccatctaacattgctaccgtttgggtgccgtatgtctctacgttagtcaccaaaatttttccgacccggtcctttcctttagacatttcagtctgcgttgcttcaccaagttcattttcgatgaaactcgaaatttcggatgtcaatttcactcctcggcaaaatgcatcggggggtttgtcctcttgcatcactatgcaattttgtttgaggaaattttgggattttacagccggatatgttcttatggcatttcgctgattgtatgcattgtttcgcagtgaaatgttatttgctcccgtagcaaattgttgcctactcctatctgctacggtgtttacgtctcgctgtagcgatcactctttgacattcatgcgatatatgacctggttagttgcaaatatagcatacaactccctttcgtgtttgctggggagtgatttggtatcgtcctctttggagtataatcgggttattacaattgtaaaagtctaggtttggattgtggggagttggggggtgggtgacggacgatcgttgcgctggtccaaaaacaatagtttgggatggctttgagtcgaattgacctaaagggtttttcgggcatcgcgtggcactgagttgtaacgtcatctattcatatctctttggtcctatttaaagtgtaatatgcgatattttttaattaacaaccaattaaaaattgggttattgatttattcttttgtgccaaaaatgattgtctttgtgattctttttgtttatttttattttttgtcattttacagtgcatcttttgtaatcctgctattgctagtcattcaatttcttctactgttcttccattggctggtgccctcgtatctaatggaggggaccatctcctacaacaatcgtgtgtgattttgtagaaaactcccaaaacttttgactccaacgtggagatgtgttgtggtatctgaggcgcttttccgtgtgcccttaaaaattccagagaatcttt

SEQ ID NO: 43869 - DNA, 859 bp, Heterodera glycines
ttattttcaattttttggtttgtatactcgtgccgcacctctaaagaaaatacgattcctcatagttttttttttaaatcgatacatattttatcattttttaaatgaaaatcctaccaattgagcttaataatcgcaaaaaccaacctttttcgttgaaaatctcgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaatatttgaatttttttttaaatttttaaaattttttgaatttttaaaatttcccccggcggcgcctatcgggaccgccttacaccttctttcccaaaagttttttgaaaaagcgctccgaaaaaagtgatgtgaaaatcaaatctgaatttctattaatattcgatgatttagtccaaaaatgattaattaagtcctatgccgttcttggcactgtgccacgcggagaggcggagaaaactccaaaatttgaatcaagcacctctcgcgtgccattccgatctcgtgccggaactgctacgactgttacagctgctgatgcaatggaactgcatgggagtgttctcgagatgcaatatgaaacaaatgacaaacaaactagaaatttttaaaaaattagaggaagtgattgacgatgttaa

SEQ ID NO: 43870 - DNA, 763 bp, Heterodera glycines
ccacaattacaacttgattaactaccgatatcattaaaaacatatatattaaaataactggtgcgtgaactgtcggatctgcgaatgtgataaagcgcttcgcgcttcttgagcttcgctacctaggctgtgaagcaattcaaattgatcgaattggttggagagatttttttgaatttttaaaaaaattattaggagtttttagtccacatcgaggctcaagacgggcgcttcgcgcccgttttttaaatttgttaaactcatacgggtgcttcgcgcccgttttttttagcttgttaggccacttcgcggcctcagtcgggcgctttttagaaatattttcctaaaagcatgtcatgccggaaacttcttttctaattttatacattacatttttattgccttctttattcaatactaatcttttaattaagaatggatctgacacctgaacaagaacgcgagttgtataacgcctactatcgtcccaatgtcccggaggacctcaccgaagcagaactgtcgcatgaaactcatttggaggcgtttaatcgagcaatgtaaatgcgtcttgcattgtctacaacatatttgaatgccgcgccacaggacatcaccattactctaccattcacaccggaagtaatcagaaataaaaccatttttatgccttcgagctgcgattttttaagcatttaacaccataaattgaaaaattgagccatataattgagtacttttacgcttacgccaacataaattt

SEQ ID NO: 43871 - DNA, 1001 bp, Heterodera glycines
  misc_feature (920)..(920): n is a, c, g, or t
  misc_feature (926)..(927): n is a, c, g, or t
  misc_feature (958)..(958): n is a, c, g, or t
tctttaaccggtttggccttcattttctgtctttgctccaccgatttttcgtcacttttattttctgtggccaaacaaatctttgggagacctaaaaagaatttttattcataaaatgcataggtatttggtaattccattaaaaaatgcgtttcgcctttttcattttcctgctccaactctttggcactggtgttttgctggtcgccgcagtccaagcggaaatggcattttcgggcgaagatccgccgatttcaaagagaattgagtaaacaaaactgattaatggctttaaatcaggaatcacacggacggcccatgcaattctcataaaacccataaaattttatggcatcgccaattggcacacttttgctgatatttttaagtttctctgttttttttaatgtctatttttaaatgctaaataaaaatgggatttaccagcagagaacggcaaagacgcgggcacaaactgtcgggagcgattgctggcggactgatcggaacgggcgccgccgttggactgaacgcataccaaaagaacaaagcgaagaacggctaatgagagacataagacaaagaaaagaaagagagtactgtatgggtacggtatggacggattaattacaatgatcgatattcaaccaattagccaattactaagcaacgaaacaattgtcataatgacatttcctgaaataaaacaaatggaccaatttaattgctatacaaaataagccctttaattgaatttatctttgaaaaaggtagaaagtctgctttaataatacccaatttcactaattgcccctgaactgacctcttcttcttctgtctgaatcaaagttgtttcacagctttccgatcaggtggcgattggggctaaatttcagcgccaaatgcattgattttattanattgtnncggtatagttttttggatttatcatttttanaataatggaaatgatacaaattattgaaaaataaaattgaacc

SEQ ID NO: 43872 - DNA, 1303 bp, Heterodera glycines
aaattccgaaatgttcaatcaattggtcaccctcaccactcatccattgatgtacgtccggaatgtattcttcgcttgtgtcgttgcagccttcgccgcggcagatccactgacgagggataagagtcattttcagaaacaatttcaataaagaaaagttttattaaattttctgtaagagaaaaatgcgtcaattttcgctacttaaaaatctcatcaaatgggtcagcctgcgaaagaagttgtgtgatttttcgtgcatttttgttgtttttttaaatttttggtgtgtgacttcaaaaacaggaaggattccaattttcaagccaaaattcttgagagaaaagtgctgacagaagaggaaaatgggggaaatagcacaaaacataaatccaagtacgttcagaccagtctaatttatacattaccgtatatactctttttatatgccatggtatattatttttcaacctcttcagaaaggggtatataattggaggccggcagattaatatggagactggcatataaaaagagtatatacggtatatgtcgggatgtgacggggggtcagtggcaaaactcatacaaaagtcaactcaatattttaaatattttacaaaataatgcctacgcttctacctaagcctagtctaaagctaagcaattgtacgacttgtctttttgtacgagtttgtcatgacactgtggcgacataccgatttcagtgattgtaacaattttactaaattttctgtaaaaaaaacctttggagaagagacagacacacaaataaaataaaagcacaataaatccattttcggatggaatagaaaattttcacagagaaaaaaatggtggaataaatgcaagtacttcatgaagcatgaccaagtgtggtttatatgtctacatatgtatttgtggttttgatgtgtctttaggaaattttgtttttgtgggtctttgacaaaatactaaaaaaaaaatgcacttaaatttcgtttcggactcaatgcacttaaccaagaaatcggtatggtttttccaatcaaaagccatcctcagtttcttaagccataactttttttttcttactttgtccaaggctacatttagaacaaaagagtcaggcttaaaagcggccctgaactgaccaaatatgcttttcgactttttgctcgaattcgggttagacataggtcaaaattaatgtcatattcgtattctccgaccacccgtactattaccaaaagtgcaacagagtggacagaaacaatgtttgttattcagtatatttaca

SEQ ID NO: 43873 - DNA, 1457 bp, Heterodera glycines
tttgatgcaatggttccgttttgactccaaaaatgaaaaacttctaaatggtaaaaaagtgctaattagtgcttaattgtccttccatgctaatactttaatttaatttactaattagcatctgctaattgttctgctgttgtggaggtccccgatgttgatccatcagcattcaaagtgatgctgggctttgtttacgcggacgatttgagcgaattgaacggagacaatgcaatggaagtgctttatgccggtgaatttattattttttaaaaatttaattgaaaattgtgttagccaaaaagtataacatcactggcctgatcggcccacctttacaaattcccatctccgaattgcgcaatgttttcttagcctatgcccaggctctcctcttcgaattagatgtgagaaggtcaaaataaatttaattttattatttttagattttctgaagatccaaatatttttttttgtataattttctgtaattaatacatttaaggattttgtcagcgaatgtttgcggtacatttgtcaaaatgcagccaaattgttcaaatcaactgattttttgcaaattgatcaggaaatgttgtgctatttttttgaacgcgatcagttgttgatcagcaatgaatgtgaactttggaaagctgtaattttaattaaattttgcattttattttgtttttcatttttgctttaggcacttcgttgggccgacgaaaaatgccgacaaaatggtgttgaatgctcaccggaaaatcttcgtgccgtcctcggcccggcattgttcaaaatacatttgccaaacttccatgaagcggatttttcaaaatacgttggtaaaaatgtttgaaatcggataattgaaagtttttaagctcggaattaatttccttttaatgtttgaaattaatccaacttttttaaaaaaataaaattattttttctgcatcgactattttgttgtacatcgatgaaaattttcgctgcgattttaaaaaaatctttggaaatacgtagggaccaagaaaaaatgtaatttattaccaagttttaccccaaaaaattaaggatttttggttttcaaatatttttgtggcaaatgaagagacctgactgtcccacgttttcagctaggagttgtagagggtcttggaggggttggtacgaacatggaaaaaccaaaattttcaacaagaattgaaatttaggttagaaatatcagaattgaaatagatgacagattcgtgatcagcgacaaaaactttttttcattttcaagaaattaaatactcccaaaattgaaattagtgaatgtaagctgatgcaaggcgatctgtttcaattggagaattttattttgtcctagaagtcccaaaccaagtggaaacttttttcttgcttctctgcacgtagtgagaattggcacaaaaatcgctattttaata

SEQ ID NO: 43874 - DNA, 1840 bp, Heterodera glycines
  misc_feature (1301)..(1301): n is a, c, g, or t
caatttttcgggccacgaatccgcttttaagctgccacttttcaatcctgaattctgtttggccggctgtgttctttttttaattggacgactggtgacccgcatttggttgacttgtacgtcattggttgctcctccgtaaaatcttccatttcagcactttattgccgagtattattcgcttttacgggggttggtggttctttttagactgtttcaattatcatggctaatatatttttaggcgacgtcgaatcgaacaatccccgtggcattcctgaggtagattgcctgctttataaatgatcagttttgcttgttttagcgtgttacgcacatcatttgttcaaattgggtagaaaatgaggcgctgattttacaggcgctgacgactgtttgttattttttgtcgaatagttttgaaaattatgtaagttcagaatttcgccgaacggatgccacgcaaaatgaaaaggatcgtttccctcaattggcttaacgacgcaattgcaaagagacaagtgactgcgccaagtaaagcttgccatttgccgaggtaatcaattttttgtttatacaatttaccattttttttttttgttaatagcatttggagttcaacacgatacaatccaaaaacatttgcaaaagtaagtggatttcactagcatataactgtaagcaaaacaattggtgtggagaagtttccgaaacgtcgtcggctgaaacgtcatcgtgacaaaacgtcgttgtgccgaaaaattcccaaaaagttcgaatactttggttgaaagctctccatatgatttattagggttcgagccccgcccccgcccccgggggcgggacaggttttttgggctcacccccgcccccgtgactctgacccccgcaacccccgcccccgcgaccttcacccccgcgggggcacgggggtgaaaatacacccctaagaatggcatattcgtgggaaataaggcaaaaaatttagacaattttgaatttttttttagctatcttgagaaattttaagaactaaaataaattttatttgttttttattttatttgtggattggtggatagtgcttcaatactaacagtacttttgtcatgagttcgattccggctaacgttttcctttaatttatttattttttctgattaatacagggtttctttatgttcttgtttctaagaaatgttctgatttgggggtaatgccttattttcatctaaagaagaaaatttctgaaaaatttggctaatttctaacaaaattcatataaattcttaaatttntcccggcggcgcctatcggcaccgccggcccccaaaattcctatattttttcttaaaaattatcccaagctcgcgaattttgctcattttttgtacaaaatttgttaacaaattgcattcaaattttcaaaaaattttcccgtctcccactcccttctcccaagggtattattttgtaaagtctttttttccccaataaacttttcaaaccccatttttcgcatcgtgaatgttatttttatcgaattctgaaccgttttgagtatattagactagaaaaaattgagaaattttgaaatcatgtttcccactcccttctcccaggggtattattttgcaaagtcttttttgtccaataaacttttcaaaccccatttttcgcaccgtgtatgttatttttattgcattctgaaccggattgagtagattagactagaaaaaattgaaaattttgaaatcatgtttcccactcccttctcccaggggtattattttgtaaagtctttttttccccaataaacttgtaaaaccccattttt

SEQ ID NO: 43875 - DNA, 745 bp, Heterodera glycines
  misc_feature (710)..(710): n is a, c, g, or t
gttgatgcgcgaattttcaaaattgctttttatgtaacagagagagagaaaggaatttggtgggggggggcgaagggatcgcatttgggagtgatttgatcctctctctcaccaccttatccaagatgttcgttcataatttttggaattgtgcccttcccattatcgtacatgcgataacacaaccccctaatcttatgggggtcaaacaatgcgacgaatgcaaaagtggggagaaagaagggattagcaaattgggggggggggggggggagggaatgggcgaaggactgacttatgggggacaaaggatttgagttgcattaatttactgaactgcgagggcaaacggagacagcagagtttggcaacacccattcaaagagataaaacagactgatgaatgaaattgaaggcaaaattcgattaataaccttttttattgggggaaagaaaaacgcaatgctcgcaaattgtcatggtaatttctaacaaataagagaagtgatcggaaatttgaaattttgcagatattagctttttataagatattttagtgtaacatttcaagtaattttaataattacgaactgaataagaaatcggctttttcaatttaattataatcaaaatttgttaattaaaaacatttacaattattagcaatagtaattacttattgaatataaaaatggtcgcatattctccanatttcaaacctatttgtttcccccattgacctgca

SEQ ID NO: 43876 - DNA, 911 bp, Heterodera glycines
cttgaccaaaaaatagctatctcttttttctcatttttttaccgcaaacttggtaccaacagttgccttcttttgtctggccttatcaaacaatcttacgatatttgaaacgcaaacaaaaaaaattcttgaccaaaaaatggctatctcttttttctcatttttttaccacaaacttggtaccaacagttgccttctcttgtctggccctatcaaacaatcttacgatatttgaaacgcaaacaaaaaaaattcttgaccaaaaaatgtctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttgctaccaacagttgccttctcttgtctggccctatcaaacatcttttttttgaattttttacggaaaaaattggtaccaaaaatctatctcttttttctcatttttttaccgcaataacagttgccttctcttgtctggccctatcgaacaatcttacgatatttgaaacgcaaacgaaaaaaattcttgaccaaaaatatggctatctcttttttctcgtttttt

SEQ ID NO: 43877 - DNA, 935 bp, Heterodera glycines
  misc_feature (45)..(45): n is a, c, g, or t
  misc_feature (911)..(911): n is a, c, g, or t
aaaaattttttgcctaaattttatattatattgttgaattgttgnaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaacagagtttgatgttattcgaatgagctagacgcgctctacatttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacagtttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatatgaatatttacaagcanaaatttaagaccatttccaaagag

SEQ ID NO: 43878 - DNA, 1595 bp, Heterodera glycines
catatggtcccaatgaaaaccaaaatgatcaagatttgatcaatcattacgtgcacttcaatatggaattgacatgaaaggcttcgaaaaaggaattaataatgaatatcaatcaattcttattctataaaccacataaatttattttaatcagaacgcaaatgtcttttttcgctgtacggcgcaaatgtcgcggcgcaaatgtcgtttttgttaggcggcgcaagtgtcgcggcgcaaataacacggcgcaaatgtccgcgtcgcaagagtcttttttgctgagcggcgcaagtgtcgcggcgcaaatggcgcggcgcaaatgtctgcggcgtaaaagtcggctaaccgaaatttttagaaaaagagcgaaaagcaacgaaattgaatattcgtaaaaaggttagtgttgaaattgccttttaaaacagaagcaaaaccagggattaagctacattttgaaagtgtaattctttaattttgagacgaattttgaacttttgatatttcttgtataatcaatcctgcatggacagatcaaaattattctgggtttagttatcactaaaaatatcattcagaaatgttcacacccaaataaaataaaaatattttagtatttggtcaatttttaatgttcgacaataaattagttgacacccaaaaaaaagaaaaattttttgattttggataaacactttcattatcaatacaaattaaactgtaatagctaaataaaatgtattaatgctgttgccagcaatgcttaattctcgagatttattcaaggttcaaacaccatcagtcaagtgtataaaatgcgggaacttgtgttgtaagaaaattgattgcgctccatcttttacaaaaaatggtcacaccgcacattgctgtaagaattgctggaattcgcctaaaaaatgaattttcaactcctggagtattgcttggaacatttgcgtgttcgtatccaattcactatttttttaggaatttcacattctcgggattatttatgctgtgttaacttttctgtcaacaacatttttgtgtaggatttataaaacattgcttaattgatttattttgtttatcagcatgtgtgtttaaatttggttaaatgccgactatgattaatggggatttttgaagtataattttaatacatattgctgttttgaaatttttttaataatgagatgagggaaaaatcaaaatgcaataaaaattgatgaatttttctaattttttcataaaaacacattgttttttttttagtttttcacaataattttaatatttgtctctatttggtcatattttttttatttttcatgattaaaaatcctcggtctattaatagttaaattggtcaattcaaaaatattacttacgttcaagccaatatttcttttccattcattcacgaaatttctttttacaaaagcgagccccaaagtaagctttttaaaaaaaggttggggaagagaattcaaattaatctaaatttaatttaaattatttcactaagatccgtactgatgtggccgctctcttttgttaaaattgcacttttcgtgatacgcccttttttt

SEQ ID NO: 43879 - DNA, 914 bp, Heterodera glycines
  misc_feature (882)..(883): n is a, c, g, or t
  misc_feature (898)..(899): n is a, c, g, or t
cgtgttggaacacattgagagtcataggttaaaagggaataccgtacatcgggaaatttcgttttaatattcactaattgcctctttttaactctgcctgattctccacccgaaattttctgttttaatatttcactaattgcctctttttacctctgcctgattttccacccgaaattggctgttcggtgccattccaaaaatgtaattggttccatgagtgtccaatgctcccggatagcacatcagcaaactaataccgaaaatataattaataattttttaaaatttttttttaattacccatttaagcattttccgttcaatttgaatttcagcgtgaaggaattgatctgtctttggcgcgactcgcgcctgagacattggtccatcgcattgtattccacttcgatgctgcttaggccaggctcgctcaaataaacgctgaaaaagagttttctaatttaaataaaaaagtaatcgatagtttttacatctttcctaattagcccaggcctggatttttccttgattttggtccaacaaatccaggcctagatcaaatatgaaaaaccccaggtccagcccaggcttttttttcaaaatctcgagctttagttaatatacattaaaacatttgttcaaattccttaatgagacattttatttttgtgaggggcagcagcggtgacactttggcacaaaaagcggcacaaaacagcgaaaatgccaaagaaaaattgagcgtttgccatcatctacgaatgcgaaaaactgcttgttaatttactattaatggacaaagacaggacaaattgttggatttgacaattgataagactttttgtcccccaacttttaattgttttttaatcagagaannatatttgcaggaccnntgcaggcccatgcaa

SEQ ID NO: 43880 - DNA, 1201 bp, Heterodera glycines
  misc_feature (54)..(54): n is a, c, g, or t
caatgaatgtcatttattcgttatttacttaaaattaacaacttgttaaaaatntacaaacaaaaagcgatacacaataattggccaaattcacccaaaggttggcaaatatttcgatcggacgcccaccgggcgggagccatgagcacttttggcaccattcggttgaattggtgaagaccacggggcggaagaaggagggagggaatgggacggaatggcaacggcactttcttttgaagaagcgcacggtgagcaggaaaatgcccagcaggagacgcgcggacttccgtactccgccggagtttttacgtaaatttcggcaacttaaatcggatttccttttctgctgatgaactgatcgatggcttcctcccccttttcaaactcacaatttgcccgatcgcttccttttctcctctcaaataaataactgtccttgcgatattcgttctctgcccaaaattcggtgccttcgatcagataattcttatcaaagtgattggattcgtatgctgaaaaaatcaaaacattactttctgtttcatttgcatttttattttttcgcacttcgatttttgcctttcttccgtgacgtcattccgtaatcaaacggagccgaatttgaagtggagtaattagtgcccattttggaattgaacggctaaattgagggaaaagaaaacgaggccaaatggcaatggcgcgaacaaagaattcgatctgatagtcgatcgactgcatggacacagacaaaaattaacaataatttgcagttttttgattggtttccccgaaatacagagacattattaaacattggatatgaaaaagtcgttgagatgctcaatcttttgccacctgctgcttatttcgactatttctttatgattcgaattttaaatattttgtgttttgggtattacaatttttcggtttttattgagcacgcatggaaagtgaagaaagaagctaacacagccaaagaaatattagtggaaaagggaaaaagaagagggaggagggagcaattgagggggggggggaaagtggggacatttgtcgacgagtgggcggtggccgaattgaatttatccaaggcaaattatttgcaaaaaaatgaattgcttttcgttttgatgagaggccttcattataaattggagaaccccaaatgggttagaaactaataattagagca

SEQ ID NO: 43881 - DNA, 891 bp, Heterodera glycines
  misc_feature (98)..(98): n is a, c, g, or t
tggggaacaaggaaaggtgccacccggtgccggcataaaaaaggcacgtggcttaaattcaatataaatatttttaaatgaaagaattattttatatntattgttcataaatcaaaattttctatttataagaaaatatatctactatttataatttttaaatcaacgataaagaaaaattccatgttcttatgacaataatatgtcaagaatgatggaataaaattaagttaaaaaaacgcgcaacaatcatttttggttttaatagattataatggattgtttttattctttctttgtatttttaatttatttgttttccaataattattatattttgttaatttattcttttattttaataatttagagatttcttccaaataaataacattggtagatttatgctttttagtcacaaaatttaaaaatctttttgttgacgtactttcaccgttttaaattctttcatacttaataattgttttcaatatatatattaactttgtttatttgtatttttttaaattttatcgcaaagtaaagaattccgtattttcatttgccggtatgagtgcatggactgaaagaaaatcaataaaaatagaaaaatattaaaatttgtttataataataataataataatatttaattagttgagcaaatttataatattattcaaggagtttatttattaattgagcatctagtacattttcgaattataaactatgaatgggtgaaaaagtaaataaatatcataacttttatttgattttaactctttttaatatttattttggttgattatttagttcgttttttgatgaattgcaatttttagccagaacaaaaaaatgttgaaactaataatttttaatttaacatat

SEQ ID NO: 43882 - DNA, 1238 bp, Heterodera glycines
ttccatctcgctgttgcgtgctcgtaaattgccaaattgtttgaacatccggccgaaaggaggtccaacggggcaacggacaaaagttcgacgcctcggcgacaccaattgttggcctggggaagcaaaaagggaaatgttggaagattagcagcagaaaggtgatgaaaagaggagaagccctccctaccgtgattacaaacatttaaaaccaaaatcatttaaagtttcttctctccgctcactttggcaatttgcgcgtgcattttgcggcttttctccaacatttggcccctcctctccaccgctccccccaacacttccgccattctgttcagttcgtcgcactttggtccaacactgtcgcttccctttgtgctgttcaacaattcgctaaggtcgtcgcccttttcgctgagttcgatgccgcgttttcggagggtgcggcacggacggatgacgtcatcctgaagtataataaacattaaataaacaaatgcttaacatcattaatggttggcatcggttcgctttgcttcgactgaccaatgcttccgtgccgtactccgcgtgttcgcgtgccaatccgtcggcgatttcttcgctgtcgcccaattggcggtgctcttcgaggcggagcatatgcttggcgaaatggttttggagctgagaagcaaaaaaaaagagaatgatttacgtaacattgggctttcttttgtctacttttctgaattcgtcttcgaattgtcgaagttccaaacagccgagaagcctttgtcggtgtttttgccaaaacttgtcaaagcttctttctgtgtcctgcaactgattgatcatccgttcgatggccgtcacattttgaagtcgacttggcgacaaacgatcgctgaacgataaatatcaatcagcacaacacactgacgggaaagggtgcacttcatttccccccgtcgtttccttcccccccccccccccccgaaaccaaatttagaaaatttttgatttttttgttcaaaaatttcaagtttggaatttaaaaaatagtaatttttcgggggtggaaacgaagtggggaaacgccctgtgttccgtggaagtaagcccatagtgtgcagacatttgcgccccggacaatgcgtccgtcctgtgccttcgtcccacctttgttcggtgtgccgtacttgtcggagcagtgccattcccttgcgaatggaaatgcgaaagtcctccttaatggc

SEQ ID NO: 43883 - DNA, 1138 bp, Heterodera glycines
  misc_feature (18)..(18): n is a, c, g, or t
  misc_feature (31)..(32): n is a, c, g, or t
  misc_feature (135)..(135): n is a, c, g, or t
gcatcagaagcagactcnaattcttcacacnnataatgtaaaaaatattacgcaagaaattatttttacatcctttttagaaatgctgcataaatttttattgtaaatagtcacaaacaagcttttgttcactcncaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaataggagcaaacaaactttttttcactccacaatatctacccggggggagcaaaaaggcaatagttaagcactgagatataaaaa

SEQ ID NO: 43884 - DNA, 1319 bp, Heterodera glycines
  misc_feature (1298)..(1298): n is a, c, g, or t
atttttcttttaatttttttgacagtagattactttttttaaatggtaagaatttcacgcattttaataaatatgggctcaataagaagcaacaaaaaaaaaatgagtaatggtggagattattggtcccataggaaagatgcccgatttgaatgattttgtgcttcattcaggggttatcaagcgtgctaagaaagaatatgccatcagttttgttcatatgttgtcctcttataatatttcattagttctatgatattttcgattatataccataaaaatgaactgcgcttgttcataaactaaccaacttggtcaaaatattttcaaacaccaaaagctttttttctcctttatgtgtacgcgtcatcgcctaaggcaccggcgacaaaaacaatgcttttggcgttcgaaaatatttttgacaaaatttgtagtttaactattgttaatgcttgaattatttgcactccaccattactcgtttcttttcttttttttgcttcaatgagccccatatttattagaatgcgtaaaatgtatatcatttcttaaaaaaacaatatacttcaaaaaagtaaaataaatattaataatgcgtataaaaatgaaaaaaatcaaaagaccaagcattccaacagacgccgaagttttaatcaatgacataattttcccgctttatattatcaatttctcgccaataattaggcaatttttcacattgttttgaacttttaaagctcgtacttggcttttttgtgaaaaagtatgtgtaatgctattcggataagtgggcaaccaacgaaaaataaattttacaaaaatttttaactaatttatttatttatttcggacgggcacaaaccccgtgggttgtcagtcgcggacagtctcgaattatcgggttgttcaacatttcatcaatgtgccaaaattttaagttagaaactgcaggaattgtcctggacaaagcgatttgagacgggtggacgacttgcagaatgtccaaataggcgaacatcttttaatggatggtgtcatttaatttaaaaatttatccgatttatttgaaccgataaaattgggaatttaaaaataactaactcaattggtgctgagccgttataaaaaaaaagccattaaaaggaccttataaaaaacaatcaaatggaaattttcaacaaaaaactgcccttaacttttgtcaaatcaaccaaactaaacattcttggaatcattcggtagccctaagaattctctattagctaacctaaatttcaaaaaatttggttgagcanaagttatgaccaaaattaccc

SEQ ID NO: 43885 - DNA, 968 bp, Heterodera glycines
gacgggcgtttcgcgcccgttatttaaagtttgttgggtcatacgggcgtttcgcgcccgtatttcaaattttgttggccttacagagattagaagaggtacaacagtgattagaagaggtacaacagtgattagaagaggtacaacagtgattagaagaggtacaacagtgattaaaagaggtacaaaagtgattagaagaggtacaacagtgattagaagaggtacaacagtgataaaagaggtccaacagtgattagaagaggtccaacagtgattagatgagtccagcagtgattagaagaggtacaacagtgattagaagaggtccaacagtgattagatgagtccagcagtgattagaagaggtgcaacagtgatgagaagaggtacaactgtgattagaagaggtacaacagtgattagaagaggtgcaacagtgattagatgagtccagcagtgattagaagaggtacaacagtgattagaagaggtacaacagtaattagaagaggtccaacagtgattagatgagtccagcagtgattagaagaggtgcaacagtgatgagaagaggtacaactgtgattagaagaggtacaacagtgattagaagaggtacaacagtgattagaagaggtccaacagtgattagatgagtccagcagtgattagaagaggtgcaacagtgatgagaagaggtacaactgtgattagaagaggtacaacagtgattagaagaggtccaacagtgattagatgagtccagcagtgattagaagaggtacaacagtgattagaagaggtacaacagtaattagaagaggtacaactgtgattagaagaggtacaacagtgattaaaagaggtacaactgtgattagaagaggtacaactgtgattagaagaggtacaacagtgattagaagaggtgtaacagtgattagaagaggtacaacagtaattag

SEQ ID NO: 43886 - DNA, 1307 bp, Heterodera glycines
tacatttatatgtttttttctaacgtaaacagtttatggcttagggtaatactttttcttttgggtttttctagttgtgtaaacttgtgtatggatgagtggggtttacctcaatagttcttcatcattatcatctccatattatcttgagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgacgtgagcaaatttttgatttttactattttttgtaaattttaactttttagcgctatgagccgaaggtatatttccgcgctgaacataccacccgggactatccgaatttggtgccggtccatttgcaggacaaagtcgtcgggtgcctttgtaagacagatttaaggcgtaacttttttattacgcattattagtatttattttattaaaattataattatggcgaaggagatcaaagaaagaaggaaacgaactggaagtcatcaatgcttaaaaaagagcatgtaaaccatttttagactaaaaagtgaaaatcggaaaatttgagcttcagattttgttcgaattcggacccggggttcggaattgttcgaaaaggatgccagatacgtgatcagcaaccccgaaaactccggaaaattttcgtggcttttgaaaacaaaaaaatttttttcgaaaaatgggcgggggaccagccttaaactattaccaaatcttttcatcaattattaaatagagtgaaatacgtaccattattaaaaaagcaatctacttccaaagggttaaaataaaatacaacattaataatttgtaattaaaaaattcaaaaagcactcttttaaagtagcgcccatattttctttattcttgaaaattaaggcgagccggacgcggagtacgtgaactattggcatattaggaaaggccagatgaagcgatgcgagtgcggacattggtgagttggagaagcgcattcgaaattcaaacaacgaaagcccctttcctttcctttaggtttaagggcgtgcaggccgaccctgacagtttcgcctgaatgcgatggatacgaattggctttgaagtgataggagatcatataaaatgatcagttattttaatagtatttctaagttggttggataaatgtaaagcatagtttc

SEQ ID NO: 43887 - DNA, 784 bp, Heterodera glycines
ctccccataaatctgggcgcatcggttcggggggactgccccaaaaacaaaaaaatcgattttttcaagtgtccgtttggggtactcaaacaattatggggagcaaaaatccaccgcagaattaaagtccagcctatagggaagttattccggaagtattcgttctccccataaatctgggcgcatcggttgggggggactcccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaatcgattttttcaagtgtccgtttggggtaccacagtttatggggagcccaaatccaaccagaatgaaagt

SEQ ID NO: 43888 - DNA, 1185 bp, Heterodera glycines
gaaacccaaaaatttaaaaaaaattctttggtaaaaaatcctttaaaaaataaaaaaatttttgaatttggtttgaaatttttaattttaaaaggaaaattcttttttgaaaattttcttaaaataagggggaagtaatttcaacgaaattttttttaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggttacaaagagttcgcacagcatcgaatatttccttcattttaggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttgttggctttggaaaaatagcctataataaaggagagacgagcagacgatgagtgagagaaaaatagtggtaaaaattgtaaactgctgcattggcagagtcagagaggggtcacaaagagttcgcacagcatcgaatatttccttcattttgggcgtcattcttccccactgcacttatttcttcggtttaattacccaagtttgaggtacttggcgtgtcctgcccataatatctgtggcatggaataaattttggaactgcgctgcctaacggcggtgcttaaagtgcgctaaaaatgatcaaatg

SEQ ID NO: 43889 - DNA, 885 bp, Heterodera glycines
  misc_feature (13)..(13): n is a, c, g, or t
  misc_feature (34)..(34): n is a, c, g, or t
  misc_feature (104)..(104): n is a, c, g, or t
  misc_feature (152)..(152): n is a, c, g, or t
  misc_feature (848)..(848): n is a, c, g, or t
aaaggaaaaagancaacgaaaagtcgctcaatgncaatgcaaaggacaaatttacagcgcaagtgccacaaaataaagaacaattacaaaagaaatgccggttntaagaggcataaaatattgaccagaaaatgctgaaaaaattgacaganaattgccaatttcgatcaatgaataaaatgccaacaaaatgttaacggatgcacggaatgtccatggataatgtaaaaaattttctataaataattattaattaattggctaattaaacaatgactttgttcgtatagtgatgaaaatcaacgaaaaatttgacaaaatgccaatagagaaaattgcttagatcaatgtgaattcaagtccattttgataattctttgatgggccacactattttctttcttcacaatcattcaaagataacggccactcaatggccggtaaaaaatgtttaatacataaaataagaaaaataatattgataaattactaattaagagtttttttcaggggctttaccatttaaagcaaaattctctccagaaaaattgcgatcgttaaggcgaagaaaacgatgacagtaaaatgcggcatcattaccaccgcctcaacaccgttgcaaaagttttcgttgctgcaacagtaagttttgcactcaaaaatgcccacattgaagtcgaacatttggcaaaatgccttagcttcgcactttctcaccgtatttgtgcttatcactttgccatcaactggaaataacacagtggttttaataaattaagtccgactgttatctaatcacaactgatctggcagcaaattcaattaatgctaaatctttttttcaattntttctgttcctttttcgctcgatgtgtacttacttac

SEQ ID NO: 43890 - DNA, 1052 bp, Heterodera glycines
  misc_feature (903)..(903): n is a, c, g, or t
ggcgacactccatctcctccccaatttcgcatcatgcgttgtgggcaaccgcatcgcatgttgtggccccacccccaaattcgcatcatacgttgtgggcaaccgcatcgcatgttgtggccccaccccaatttcgcatcatgcgttgtggccaaccgcatcgcatgtcaattcaaaatgtttaatttgacaatgcacttttttaaagtttcaatgccaataggctgtcttgaattttacttttccattccgcttccatgtcccaaacgctagcagaatgcacatggtcctctgctgaccctcgcgcgattggaccttcgcggtcttaccacagagagcagaaagtccacccgagctgtctgacagtttaagcaacggggcctctgatcatgagcttgtaccttaagggggggggggtatcccaataaaattaaattgttcgaacccagttgtcgagacttatttggtcttgacgcggcaaccccgtgtacggatcttcattttcttcaactgcttgctggcactgggctttgaatgcagtgatgtactgctcccaaaagccattctccgtacattcggtgcaaattgccacgcataagcacccgttgccgcgcacagtcacatcacactcagttgcatgccgtcctaggcatagcaaacagcgctccgagaaggtcaaagcaccatgcactgctgccgccacaacatttggtggctgagcttcgtcattttctgcctccattggtgccagctcggcaaattcgggaccccgctgggcatcctgcccaaaatgcgaccggggcgtttcccatgggtgctgaggcggtggcggtagcgaaattgcgtccgcattttcaagccaaatagctacaaaatttttttataaattgtattttttactanaattttatcgaacatctatgataaccgggccatggtgggttgtggctggcccatacgcataaatctttcaatcacttaatttcattttataggaccccatgatcaaaaaaaatcttacttaaatcctgtcttaatccatctgcttcatc

SEQ ID NO: 43891 - DNA, 799 bp, Heterodera glycines
  misc_feature (740)..(740): n is a, c, g, or t
cgccgaaggtaggacgcggttcgatgtcgtcgacgttgacattgagcacggcactgaccgcatcgaccatgacccccagcagcagcaactggccctcctgctgcagttccatgatgatgatgcaggtgcgcttggcctccaccgtgggggcccggccaaaacgggccgacagatcgatcaccggcactaccgagccacgcaggttgatcacgccacgcaggaagcccggcatcaagggtacctcggtcaggccaccgtattcgatgatctcgcggatgctggcgatgggcatggcaaagctctcggacccgaccaggaaggtcaggaactggcggctttcgatgacttcctcctgttgccgcttcttgaaggaatcgccgttcaacgacacactgggcattgccttctctccttgctgatcccgctaatcagaaacgcttgaacgacgattcgtccaccgacgcctcatcctcggcggcgtccagcatggacaggcggcgcatgcgctcctgcttgccggtgccgccggaaccgggtcctgccttgacgctgcgtggcgcggacttgtgcatctcgcccacccggaagaagcgcatcaggtcctgcagatgcatggcctgggcgctcatctcctcggaggtggccgacagctcttccgaagccgaggccgtcatctgggtggtctgcgccatctggtgtacggcattgttgatctgctccagcccggtcgactgttcggncgaggcggcggcgatctcctgtaccaggtcggcggtcttgcggatcgacggcaccatct

SEQ ID NO: 43892 - DNA, 615 bp, Heterodera glycines
  misc_feature (10)..(10): n is a, c, g, or t
cgcccccccncccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcattcggcctcttcgcg

SEQ ID NO: 43893 - DNA, 841 bp, Heterodera glycines
cggtcgctcgtcgccgcgcggggcgccgccattccgtgaaaacaatttttggtcgccgttccccggccgccccaaatttgttgtgctgctcattcaaattgggcgagtgtgcccttttctcgtcgatcttcatcttccccatccattcatccctccttaaatgtccccttcaaaatgtgccaaagtcagcgaattcttcgatttgcattgtgccatcattgttgaccaattaatgccgcacattgactccgtccgttatcacttggcacaatttgtaatgccaaataaaaccccaaaatccactgcttcttctccatcatttcaccaaatgtccaatcacaaaaattctgttgtccaaaataaatcgcaaattgtcgcacgaagaaattccattgaattggtaaatgccctccggggaatgcccgcggatgataaggtacagtcaaaacaaaagcaacaacaaattaacaaactgacaaatcgtttttaattatatggaatgagactcattagagtgggaactcaaatttaaaaaataccctttaaaattgactaaatttggccccaaatcaggcatttctcacattgaaacaattaaaattgcacggcttcaaattaaattattcatatttaaaaagctttattttttaatttgccccatttccctgactaattttactattgctccgccttcccttttgatcagttgctaatggcattttgctgctcattggtgaaaagtggctgctgcttgaatttgatttgcacaatgctagcgacgaaacttgtgaatccaaagaagtaaaaaaataaaaataaaaaatttatttattttaatttt

SEQ ID NO: 43894 - DNA, 1424 bp, Heterodera glycines
  misc_feature (67)..(67): n is a, c, g, or t
  misc_feature (104)..(104): n is a, c, g, or t
  misc_feature (1411)..(1411): n is a, c, g, or t
ttctccaaatgtttttttcattttgaaatgctcgattgatcaattttcataatttttgcattttcgntgtcactcatttcgggattttcttttttaattcgcanataaattttcattttttctatttttcttccttcgttattattttcttgctaatgccaaattgttttttccatttgttaattatgaaatggctaactccacttttcttacaaatttcagcataatttcgttgccattcgatgtgcgaatattttcttttttgcttatattcgtttgtcagttcaataaattttttgacaatttcaattttttcttcatcagtttttgatttgtaagatttgcgtttttgaagaccaaattcctttgattccatttataaatttcgtttgatttgtgcccaatttcttcgctatttttgagttaattttatcccattcttttgttgagtattttcttcctttttgctttatcttctcttttattttgttgaattttgcaattatttctctttttttgagttcatttcgtttttcttcttctttttcttgccatttttctccaaatatttcgccaaatgacttttgttgcaattttttcttttctgatccaattttgtcaattaaaaataatataattaataatagtagcggaaataatttcatttttgtcgtctcgaaatgattttgttttatttttcttcaattaaatggcaattcattttttaaggcatttaaatgattttttttctgattaaaaaactgaataaatcattattttacttaataaaataaggaaatcctgtttaatttcaaagaaataataataataattttatcttaatgacaaaataattgccaattggtaaattaatgattaactaaaattttattactttctactggagctcattcgaaaataataaacatattttcaataaaaataaaataaattcacaatgtaaagagattttagaaaaattaaagagattttatgaaatttcattatttcagaaaattggtgtaaaatggcaaaaattgcgggaaaaaaattcttctactgttcttagaacaattcttctccaaattgtttcttccatttcttaattactgaaaggctaactccaattttcttgcaaatttcggcataaattttttgccattctttttgatttatagcttttatgtattcgttgatttaatcccaattctttaatccatttataaatatataaacgatttgtccccaattttttcgctattttcgaattaattttattccatcttttgctgaatattttcttcctttttgctttattttctcttttattttataatattttccaattattcctctttttttctgttaatttcttttttcatcgtctttttcttgccatttttctccaaantatatcatcaaat

SEQ ID NO: 43895 - DNA, 943 bp, Heterodera glycines
attttacatttaaatttttcaattttaaatattagttagtttaaaagtaatcatttctggacattgttagcaggaactcgccggtggttaaatagtggggaccaaggatgtgtcggcatgccgtttttcgattgccgattcccaacatttttctgcttgaattccgattttggattgccgaaaatttttgaggtcttggtacatggcccggatgggttcgagattagataagtttccaataaacacatgaaaaatcccggaccacagcgtcccattctcgaaaaaaaattagaaaaaatattggtagacataaaatatgtcctaaagaagttcggatctccaaatttaacaaattttaagagaacttagggagcggcaagtgaaatgtgccgccaatattatgaataaatattgtaagaaaataccataaattgttaaatttgtaaaattaaaagtgatcaaatcggatgaatgaataatgatcgattcggcgttgattgaaaaaactgattgattgagagagagagagaggattggaaagggtgaaagaaaagttcatttcaaaatgatagtgtaattatttgtcaagaaaaagggggaggaaatggcgaaaaaaagcgaaaaaaagaaataattaaaggctaatttaaatgcttcaagactctcgaccttaatttttcttttcaaaatgatattttcgatcccatttttatgttcagttttttgagtaaaaaatggggaaaaagacggtttatgatgtataaaaaaatttccgtaaaaaaattatacgcaaaattatttacaattttttttggaaattaaataaattagcactattttaaaatacaaatctgacatttttatctaattctatctttaagcaactcgaacaaaataggaaattcaatttcccgatttatgcgtttttgtccaatttggtttt

SEQ ID NO: 43896 - DNA, 913 bp, Heterodera glycines
gcagtttctgtaaaaatacttatgaattaattatgcaaaagacaaataaataatgaactctcttccttaataaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggacaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgatttttttcagtgtcccgtttggggtactcaaacaattaatggggagcaaaaatccaacgcagaattaaagtacagggctatagggaaagctactcccgaaaagatttcgtctccccataaatctggggcgcatcgggttccggggggactgcccccaaaa

SEQ ID NO: 43897 - DNA, 905 bp, Heterodera glycines
  misc_feature (733)..(733): n is a, c, g, or t
attcacaatttccgcagctcttgcggtaatggaaaaattttgaagaggctctgcggaacgtattagcatcggggttacgagatagaaaattgtcctaaaaagagatggccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaatattgtcctanaaagagatagccatttttctgagaattattcacaatttccgcaactcttgcggtaatggaaaaaattttgaagaggctctgcggaaacgattagcatcggggttacgagatagaatattgtcctaaaagagatagccatttttctgagaattattcaacattcccgcagctc

SEQ ID NO: 43898 - DNA, 1593 bp, Heterodera glycines
agtggacgaaattacggaccaaatcttcgtgaaatgggtcgaccaattggtgctgcgggtgcgttgccaatcattacgacattaaccccctcaaaatcggtgcactttttcaggatgagccgttgcctctttttgtgccgctcagagaccgtaaaatgaacgtggtcaaccgccagttgatgatcactgcggagaatcgacagtacaaaaagggacggttggcggagaaaaggaaggatcgcaacgcggcgttcaaatgcacttttggcgaggacattgcgaaggtggcgcaaaaagtggaagggttaaaacggagttatcgacatttgcaccccggacattgtgcctatgtccaaaaacgagtttaaacttaagttttatcagtccctacagcctaattagcatttttgagtgatgaaagtgattgtgtctgataatttgatagttaataagtattggaaaagtcaccgattattcaaaaagcagaattaattcttatacgcgctatcggggattgaaaaattttgtttgaatccgatttttgatataagcgtgatggcaaaatatacaaatagaatctaagagctcccctaatgaaggaaggcaaacaataatttcaaaaataatttgtgtattttaggttttgatcaatccgcgtcaattgctccaactgcttcagcttggcccagccgaatttgaacgggtcgtcgtcggattgtacgttgttcataaggtgcgtttggaacaacacgttgggagcatttgattaatttatggcccattttgcttcaagaggccgtggtcactcgaacggatcgaacgcgtcacgtgggatgccgtgccgacgtacaaagttaacggccactgcgggcctctgaacgttgtgctgtgcttcaaagagttcagctgcatactgctcaaaattgatcagtcaaggccgagctctaaccacctgatcgggcagaataaaacggcggtcggtcagcaaatcgccattatttttattgcatcttttgattcaatgaaaaaatcattcggaaatttattttatttttttactttccgtcggcgctgtccccacagaagacgtacaataacagtacagctttattatcattgcaatttcactttcaaaggttgccaaatttatcgctccatccgccgagcacattaagcgaaaggctcaagaattggaggaagcgctgcgcgagacccaacagatgaagcgcacggctgaagacttagcgggaccgatgcacaacaccaaacgaatcaaagacaacgagcaatatgatgaagaagaggaagacgacgacgaataaggagccaaagcgtgaaatttgatcatttgtttttcccattgaaatccgacaacgaggcggtttagcatttgcagaaggccccatttttgatgatttattgtaattggatagattatctaatttattccctttttgtaattgaaagatgtgtatgcagtatttaaaagcaattctgtacgttacctttttagtttaagatcctaaaagttgatattattaaaatttatcactgttagggtgcataaaaatagttaggtcgattcttaagtgt

SEQ ID NO: 43899 - DNA, 700 bp, Heterodera glycines
  misc_feature (669)..(669): n is a, c, g, or t
gcaaaagggtgcccaattcgagcgtaccaactcgccttaaaacactaaccttctattactctaggtttgcaacatttgaactttgaaaatgaatttaaatccgactgaaattttgggttgtcctgtcataattttttggtttgattcaccgcaagaatatttcaattaaaggtcagtcataaattttgacaggacaaacacttaggtattcaaatagtccaaagtgttttgtgtcgccatgttaaaattcaaataaccttcggaaaaactatgcccagcggttcaaaattctcgatttccaactttttaaagcccggcgatttttttgaaaattttccgcttaagatacaatattttgtgctatcaaaaaataccaagtttcagtttatcctttggaaatttagtcatttacatcacattttcagacttacctgggccacttccgtgcaaaaatatgtcatccaatttttgacggactccattttggccccgttccatgagcatcgccaaactgttactgaccggcgacaatacccgctgttcgaattggaattgctgtgtctgctcgagttgttcgtcctccgttatgcgccggctgttgccggcggttgtgagcagcgggtcaacgaagacgtggcaagatttggatttttattgcacaaccttttncgcattttattgcaattttcacaaatttctt

SEQ ID NO: 43900 - DNA, 1342 bp, Heterodera glycines
catgttcccatacacgcatcgattaaggcagccgcgcttgcactagcaacgaagtcctttgtgcgaagcgctcatgtcagcgcccgcccatatataccaaaagtatactgtctacaccgagcaattactgtgcaaaacatactgtctacaccgagcaattgctgcgccacacgctggtttatatataactaaagaaacaaggcaactcattccaaaaacaaaatctccttacggtttgccgggaggggttcgaaatttcgaccttgggggcaacttttgacggcgcattcaggaaaactatagattttccgatccgagggccaactgagcgccaggcgccgaaaagtcacttttttaaaaatttttttgccgtttttggaattcaaaaattttttaaaggcctaattgaaaaatcggcctcgtaaaggcactcggttggactttttgggatattttttgtttcttgaccgaacccctagggcctaccagtttttctgaaaaactggctaaaaatggtatacttttttgggccatttcagcgccggccgaataactcgccggggtttgaccggaggaggtcggtgtaagcggcttttttgtagagctcgacgagctctatccaaccatgtttttggatttctgaaattttcagaaattttcgagctaggccccctcgaaaattttccgtttttgaattttatgattttttacagatttttccggggaaaacggagaccactttcaagcaaccgtttttcatgctctatcaattggtgtcattttcagaaaaatttttcaaaaattttttggaaatagaaaatttttggttgctaggcctcaatttcagttctggcgcaataactcgtcaggagttgattttatcaaaaaatcgtctaagagcttttttatagagaattttaagcccaatctaaagtgctttatctcatgtttttaccataagtataaaaaaagttataaaattaattgtgattttgaaactgaaaaccataggggggaccccatggttttgcattttatgaaaaatttttttactcctaaattagctaaaatgcatttttatggcataatttgaggtgctgaatacgtatatacgatttattttgcgtttcagattttttggaaggtgtttaaaattttttgaaaaatcgtcaaaatttgagccccggaaaatccagtgaaatttcgaaaattcataactctcttcgtttttggtcaaatttagtggaataaagtttgaaaaatagcaaaaaataaggagaattttatgagatttgtttggaatttctatcttccaaaataaaaaagttattccataatttct

SEQ ID NO: 43901 - DNA, 1231 bp, Heterodera glycines
tgcgttcggtttgatcaaatatcaccaaaaatgatgactataagaaaatgcgcaactgagaactggtaaagcaccaacagacatttgtgaagcagggacggtccctggatttcgacttgggggggggcgtacctccccccgggcgatgaattttttttttttttgcttttcacacccgatttttttgtgttagggaatagtgagtggctccgaatttttaatgcgatttattaacgaattttgtccaaaaattattgtgattttgagccatttttagcagatttacataaaaaagcgggaattaattataataaaagaaggatcaatcagccaacaagtaattgtcatttcttacttaatgacactgtgcagcttccggtgatcagctgctttctgaaaatgaaactgagtctaattttgttctaaacttttaataatttattttgaatctatttattttggaattaatgatcatattagagagaataatgagattctattaatatggtaatgtgaaagaaatcttttaattaattcagtaattaaagaataattattttggaatatatattttaccttattttttaaaataaattattttaattgatcaccttacctctttgccctcctcggagacgaccagccatgtctgcttgattcccttctcaacaaggtgccgtgaacgttcctgcccgttgcccacttccacacggtacgtaccgttcaacgcgttcaatgtcgcgtcagtaatgtgaattcgacttaaaaatttgattatgatttattactgggctatttaatcgtattccaaagctattttgaaaatgttcatttattttgcaccaattaatcgataattaatcgcctgctcaaaacacgcaatcgattagatcttacatggataatcaccaattcaccacttgcgggtttcttagagatgaaacgattttcgagcatttaatcattcttgaattttccaaaactccaaacatttaaatgccatctctcagagaagccctaatcaattgcgatcagcatttcatttgttgtttcttaccccggcacccctgagctttccatgtggttggccagcgtgacgtcattgctcattatgtcgaattgccacttcttcagccccaacaccccgcagtgcgctttgccactgtgaatgccgacgcgcatgttcacgttgacgccgtacagctcgcggaccaacctaaaagcacgggtg

SEQ ID NO: 43902 - DNA, 1241 bp, Heterodera glycines
  misc_feature (37)..(37): n is a, c, g, or t
  misc_feature (75)..(75): n is a, c, g, or t
  misc_feature (126)..(126): n is a, c, g, or t
  misc_feature (141)..(141): n is a, c, g, or t
  misc_feature (200)..(200): n is a, c, g, or t
  misc_feature (221)..(221): n is a, c, g, or t
  misc_feature (326)..(327): n is a, c, g, or t
  misc_feature (1153)..(1153): n is a, c, g, or t
ctctccattttcaaatttatcaacaaaattcctcccnccactccctcccaaaatatcccctatcaaaacaaaacnatcccaataaatttaattttttcttaatcttccccatttccctttatttcnaccctactctacttntccatcttttcccaatatcccactccttccaaattattaaactctttcacaactcattnttaaaataatttttttttccnattcctttatctccaatcataacccttataactaattattcatatccttctcttaaaaaaaattctcactaaaaaaaacactttttctaaatattaacaacacannaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctcncagcatgagccttataagtgattgttcatatccttctcttgaaaaaaattgtcagtaaaaaaaacacgttttctgaatattaacaaca

SEQ ID NO: 43903 - DNA, 1773 bp, Heterodera glycines
attttttcaagtgtcgttttggggtactcaacaaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgagaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgccggttcagaaccctttctgaaaaaatatttaagaattatttttgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtggggccttcccccccccctaaattttaactatttaaaataccggtaaaatgaataaaaaatttgaagatatcacatttgttcgaggatgctgcctataacatatatttaatgaaactgctcctaaacaaggtgacttaataagtaaaatatttgattaaaactttttcatcctatttattcaacgctctagatataacaatagattatttgttaaccaataactaggaata

SEQ ID NO: 43904 - DNA, 1356 bp, Heterodera glycines
  misc_feature (33)..(33): n is a, c, g, or t
ccattgcttttgcttctgctttatcccaatgcnccgggggcacacgccaaagcaaaaaaaaataattagtattcattttggagcatccgccgggggcaaaagcgcagcaaattaaggaaaagtgcgcacgaaaaaatgaacaacaacaagcagttttgccaaaaatgtaaaaggaaaaatttgaggaaaaataaatggagaaaaatggatgaaattgggaaaaaaaaaaaacaaaaaaagaaacaaaataccaattagcagtttgtaaatttaaaaggacgaaattccctccgaggataatatatttaaaaaagccgatgatgacaaagagacgggcaaaagccaaaaaaataaataaaatactaaatgtaaaatgaaagaaaaataaatgtaaaaaaggaaaatttgaaaagcgtaattagctaattaggacaaataataaaatggatgaaccaccgatagataattaataagaacaataaaaaaatatattttgacggggttcagcgaattggtggaacggagcgatccccggagaagaacccaaacaaaaacaatagaacgaaagacgctttatgagaataaaaagcgaaattttttttgtttaattaaaagaaaattaattatttataacaattaattaattagttttcacctttttaatattataaaacatttgaaataaaatggaattgagaaaggataattaatttaaaagctcaatttgattatcatttaaataatatttatccaattttttgctaattgatttgctaattgccaatgattccgtgccgtgccaaatctcatttttcatccaaatttgcccatgttttcacatctctttttgcatatgcgcacgtgtgcagtgccgtcgcaatttttgcgccgtcacttttgcggtaaatgtcggcgccggtgaagcaaagggaagagccgagccgagagacgaagccatccaccaaaatggagtcacccgaaaggcaaatcgaatttaattgctattattgtattattattattattattattaattttccaaccaattttggcgggtgccaaaaagctgacactcaggtcaatgcttatgccatccgtttgtcgttttgtcaagcaaattgcggtcgatgtcacaatgtccacctaaaatttaattgaaattcgtttattaatttattttatatattaaatttattataatttctatttttattattgttcgccttttaatcatttgtttatacatattttattattgttttttttctatatttattcattaatatttttctcttttttattgttgttctcttttaaagtatttgctatctttttaaattatttattttctttatt

SEQ ID NO: 43905 - DNA, 752 bp, Heterodera glycines
ttttgtcacttcgccacattcagacttttgtcacttcgcccacattcagacttttgtcacttcgcccacattcagacttttgtcacttcgccacattcagacttttgtcacttcgcccacattcagacttttgtcacttcgcccacattcagacttttgtcacttcgcccacattcagacttttgtcacttcgccacattcagacttttgtcacttcgcccacattcagacttttgttacttcgcccacattcagacttttgtcacttcgccacattcagacttttgtcacttcgccacattcagacttttgtcacttcgccacattcagacttttgtcacttcgcccacattcagacttttgtcacttcgccacattcagacttttgtcacttcgccacattcagacttttgtcacttcgcccacattcagacttttgtcacttcgccacattcagacttttgtcacttcgccacattcagacttttgtcacttcgccacattcagacttttgtcacttcgcccacattcagacttttgtcacttcgcccacattcagacttttgtcacttcgccacattcagacttttgtcacttcgccacattcagacttttgtcacttcgccacattcagacttttgtcacttcgccacattcagacttttgtcacttcgccacattcagactattgtcacttcggctcaccacgaataaattgcactgaaatttagtctctttaccaaaacgaacta

SEQ ID NO: 43906 - DNA, 763 bp, Heterodera glycines
ggtccggcggtgccgataggcgccgccgggggaaattttgaaaatttgagtgtaatttattaacagattttcaataaaaaatgctgatttttgggattactatgctcaatttgttcgaatttttttcaaaaaatgataaaaatgtgttaattaaaaaaaactatgacgaatcatattttatcgataggaaacccatgattatacaaaaagaaaaccaaaatattttaattactgtagaggaactgaaccatgggaaagaagaaaggaaagtcaaggagactagccagtaggccatttgcacaattgtcagtgttacttttaaagaaaattaattttttttttaattttttcctttgactccaattttcatcactaattttaacttattatgtcctaatacgcacggaaaacgagtatttaacttggtttgaagcttctagctttaaatagtttgtgcctttttttgcatttttcgatttttgtgcaaaatcgctaaaaattccttcatttttttctcctgctgaaattttgatataacattggaaaaaaatttttgcccgaagagaaaaaaaaaacaaacggttttcggattatcccatctgaaattttttctggctacggccatccccgcaaatcgtcctgaatttttgtacctatttttgatgcctattttaaaaattttcgtgcctaaaagttcggtctctgttttaattacctataattaattcattaaaattgctttttaaattatatttaaaaaaat

SEQ ID NO: 43907 - DNA, 1157 bp, Heterodera glycines
atttttttattattaaaaaaattttttgcatgttttatatgaagtagtgcgaataaatataattttatttattaaaccaaatatttctatttaaatttaaatttgtatgattatatgattttttggcgaaacagtggaaaatgaatatggatgaactgttggaagtggatttatggagtaaaactgctgggttttatagtcgaattttttgtgcgggaaaaggctaaattggacaattcttttgtgtgggtaaacaaaacatctgatctgataattatgggattataaaagaattatttcttacaatggatggcgggttgaatccagtaaacgatattaataaaaattcattaaggaaataaaaataatttgaagtactaggaatacttcattctttaaaacataagattgaataaataaaataataattcgtccagtaatttaatgcgttagacatgctttaacattcattctcaatttattaaaataaattttagcaatttttttatgaagtcgatttaacacgtatggacacaaattgcccaaatttaaaaacttttgaataataaaaacaaaattaataaataagatttttaaaataaaattattaatacatatttatattgtgaatttgttttcttagtgaaattaaaattaaatgaaattaactttattgcgcgttaaagtattatattcagttaaaacaaggtaaatatattttttttataattataagttttatcttccttcaaaatagaacctcgctagcgaatcttatacaagaatcataaatcaacattttaaatacaaagacctttacagcataaggtagaaatgcagcatatcactaatttcactttgaaaagtttgaagcgagcagataccgaattaatcaatcgtataaaaaaaagaaaaaaaatgaataatttataattttttatttttcattcaaccacttttcaattgctttgtgtaattgatttgcaaggggtaagcgtccccccccccccccaagcgttcttccctccctccgttcgccacacattttttggccaaagagtcagtcttaaaaaaatttggcccaaaatcgaaaaaatctatcattttttggacaaaatctgttaacaggctcatccaaattttcaaattttttcacg

SEQ ID NO: 43908 - DNA, 997 bp, Heterodera glycines
aggtctatcttaaaggcctgacgagttatgtttcgacaaacatcctgtacaccataaatcgattgcaaatttagtcgaactatataaatttccaaaaaatgattcatcttttttatggttagcgcatatgtctctagctttatagaaacggtcaccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggcttagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggtcaccgaatctgcgaggaactactttttagagaatttctatcgattattattttgcatgaatccttcgcttaaattcccatttatcttataaagtcagattaaattaattaccccgatttgttttagaattggtcctaacacgcttgctaatagcttttcttttcgaaaagagaggcgaggaaaaataaaggttgcatccaaatgtatttttttttttacattgaagcatttggatggcttgctgtttacagttggcttagtcttctttgcaagaagcagcacaacttttgtttgggcccaacgacccccaaaccattcgaat

SEQ ID NO: 43909 - DNA, 912 bp, Heterodera glycines
aggaacaaaaataattttgggctttcacaaataaaatatttacgaaaattaatggcacattttacacattttctgtcccatagtcatgccatccaatggccgtgccataccatgatttccccgattcccccccccccccaatttgtcgcacattcatcattcgttcgatgcgctccactttctcctgcgttttctgatcagccaatttcgcctgtctaaacgcgtcgactgttagcgccgtctgattaccctcggccaacaaaacccaattggccaagggcagagaatcgcgcgaatttgccaagtcggaaagagcgactgaaagaagaaaaatgggaaatgatggacaaaaaggaggggaaggacctgaatatggtggaaaatggaagaaagaaaagacgaaaagcaaaggaaagggaagaaaatcggaaaaaggaagagaaatttgggggaaagagaggcgaagagagaaaaagcgcattttgggggcaattggaaaatgggaaaaaggaaaagggaaaagagaggaaaagccaaaggaaaatgggaagaagcgattgttgggcttatgcttgttcacttttattgtttaatcagcttaaaccattgaattgaagaaaatatttgagggaaaacaaaacaaataaaaggaaagggaaaaggagaaaaaatgggatatttctggccaaatgtccaacagaaagcaatttgagcccaaaggagaaaaagtagcgttttgtttctcattgttggcgccgctcgccgccgatattacccctcccccctccgacgaaaaaattcccactcaaagaaatgcttttaccccccccccccttttccagtcaatttccaatgactctatacgataccatttgtatttgtaaacgaaacgcctcaacaaaactgaaatgg

SEQ ID NO: 43910 - DNA, 1101 bp, Heterodera glycines
  misc_feature (1073)..(1073): n is a, c, g, or t
tgtccaatccttccaagtctttcacctgcattcaatttgaaaaagatatattcttaaataagcaattaaaaaacaattacccttccctccgtaatttaatgactaaatgcccactcattaattattaatgaattattattacctctttcattttgccacttttcttcccaatttgcactttgcatgcctgttttgtggcccaacttgcccagctgagtgtggcactttccgatttcttcgtcaaatcggtgtttctcaatttgcgctttaccattcgctcgtcgaccgctaaatcgcctgaaaatggaaaaattaattaattgcttggaataagcagaaaaaagacaaatacataatgagaacagatataataataataattattaattaattaattgatttacaaatgcttatgaaatctttggcatccgtcgccttcgtaattcgtttcactttcaccgcgtcgtaaaacacttccttcaaatgctctttcgttgtcacttttccttccgccttctccaaaacctccttaaaataaatatttaattgttttttttctttgcttttccttttttcttttacttccaaatgcgtcgaccatttggccaaattgcgctttttctctctaagaccacgctcaaagtcctcaatttcggccacatttggccatttgttgaaccatttggtcacaaatccgctccgcttctcaatttgttcgcgcatttcgtcgctggtcagctgcagctgatcacaaagatagtcgcccaaagtgagcagagagtaaaggacggacagatcggaactgaacgaagacaaattgggagatgagaaaggcaaaatgaacgggttttgatcaatcagtgatttgggagagtgatcagcaaagaaaacaatggcagagttgaataaagggacacttctttacttatttgtcattttcaaatttatcaatcattttctgatcatgacttttcctctctttctctctctctctccctcccctctctctcgcctctctctcgtcctttcctcacccacactctctctttcattctctctttatccgctgattngctctttccatggcattccgtattctct

SEQ ID NO: 43911 - DNA, 912 bp, Heterodera glycines
ataaaaataacattcatggtgcgaaaaatggtgtatgaaaagtatattgggggaaaaaagactgtacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttcaattttttgtagtctaatctactcaaaccggttcagaattcaataaaaataacattcacggtgcgaaaatggggtatgaaaagtttattggggaaaaaaagactttacaaaataatacccctgggagaagggagtgggaaacatgatttcaaaattttcaattttttgtactctaagctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttaaattttttgtagtctaatctactcaaaccggttcagaattcaataaaaataacattcacggtgcgaaaaatggggtatgaaaagtttattggggaaaaaaatactttacaaaataatacccctgtgagaagggagtgggaaacatgatttcgaaattttaaattttttgtagtctaatctactcaaaccggttcagaattcaataaaaataacattcatggtgcgaaaaatgaggtatgaaaagttttattgggggaaaaagactttacaaaataatacccctgagagaagggagtgagaaacatgatttc

SEQ ID NO: 43912 - DNA, 1593 bp, Heterodera glycines
tgggtaagtgataagtgaaaaaatagtttaaaatcagaattatcaatacaaaaaaattaattattgtggaaaataaattaaataatttacaattttaattaaaaaaacaaaaataataagagccaacaaattataagcagagagaaagaaagatgagttgtcgtgttcaatttgatgagttgtcgggtttgtcgggttcaatttccgaggacaaatcgttggagcaatgcgacggattgccccccccccctttacaatatttatgcacagtttgtacgattttcccagtaaataatgatgaaagaaaggtctccccgccacgccatccattcgaaacagacaaaaagcgtaaaaggtgacgaaaagtcagaattggaaaaagggaattatgtacataaaaatatgaaaggaattaaaaatgaaagtgacggagggaagaggaagtggaaaagggggaggaaaacccaccattttataggggggggggggcaatgtttggattggactcgaacacttttttaatccatttacaaaacacacacaaagagaatttaagtgccaaagtcacttggaagggaattatttgccattttcaatgggacaaattgagggaaataaatttaaaaaattgtatgttttttgatttgaggagaaaagaaatggaaacaatttgccaaggaacaaaaaatgaatgagagaggcggcgcaaagaaagcaaaaaaaaaacatttttgagtcataatttaacagaaaagggccaaaaagggcaattagaaaaagaaaattggaaaacattcattcgacgggggaaaattgaaaatggggaaattccaattgcctaattaaataaagaaaattggaaatttcgaaaatgaaaaggacgaaaaaaacgacggagggaaaagaatggatggacgaagagaaagaaagaaagagaccaatttcataatgaaagagtaacaaacacgagagagaagggagagggggggggggaaaggaatttcaaaatgtgtggcaatttcgcgcaaatgattagttggcaatcttaagagaaaatggaaaaaatactttggaaattgaccaaatatatgcctaagggcatttttcagagagagagcaacaacaaatggaaattcatattacataatatatatatcatattgtggtgtcacttttaaagaaattgagcgaaagtgacagatgggggaaaagggaaagaaaattaatgggagagaaaaagggaaaaaagaaattggattaaaaagagcaaaagaaaaaaaagagagagagagagagagagacattggggacgaacatttggaagaagtaaaagtgcagcagcagaaggagatggatggaataaacgaagaaacgggcgaaatgaacggatgggaaatgaattggacagttattttgaaagagggggaaaaagggaaggaaagaggaagaaagtgaaaggtggagaaagaggaagaggaaggacagagaaagaaaggacaagcgaaagagcggacggaagagggaaaaggaggcaagggagagagagagagagagcaaaacgaaagataaggggacagacgaacggacggaaat

SEQ ID NO: 43913 - DNA, 1312 bp, Heterodera glycines
  misc_feature (33)..(33): n is a, c, g, or t
  misc_feature (63)..(63): n is a, c, g, or t
  misc_feature (69)..(69): n is a, c, g, or t
  misc_feature (86)..(86): n is a, c, g, or t
  misc_feature (146)..(146): n is a, c, g, or t
gataaaagaaatgaaagggagagacaataaaanttgtctcgcattccttccttatttatatcncatctnttattatttaaaatatntaataaaagaaagaggaaaggaatgcccattgaatccgctttggccataacaaaagaganatctctaaattttaaatttaatatatggatgagttgggtgtatagatgagttgggtatggatgagttgggtgtatggatgagttgggtatggatgagttgggtttgactcccgagcggttcccgtgcgggggatcgattaagcgggtggtgcaaatatacccaaaaagaccagggaaatatccagaaaagcccataaattataacacgattgtctccattgagaaaaagagtactttaactagctaataaatgaaacactttagggtaagggatgtcttcggctcgacttccgaaggggtcgaacgaaggaacgccaagcagtgacgaaggggagttcaaaaaggtgggtttggaacgaaatcgatcgaaagctgcattgggttatcgtaacttttcgcttttcagattgtgatcggaatatgcgcaatgcaacggaaggccaacagcaagccgatgcgttcgatcatgcttaaaatgaacgagttctacaaggtatttaccggcttacaatgaatgcccttcatctctatttaaatattttccaatattttataaaatgttttacccttttaggacttcctcgattttgtaatttttcccgaggaaaccattctcaatgaatcggtggagaattggcccctctgcgactgtctcatctcttttcattccaccgatttccctctcaaaaaggcaattgaatatgaaaaagcgagaagaccttacgtgttgaatgacttacaccgccaatttgatttggtaagttattattattttaatttagtaaaagtgaaaaatactgacgggattgaaaatgtatatctctaatgaaagaatctgaaagaatttttttggcggcagccactccctgaagagttacagacccgggactgaagtggcaaaatagctttgggactgaaccgtccaatgtctaaaaacacatgaatcttcaacaaaacatacagaaatagatttatttttgtctctaatgtaagaatatgtgaaaattttgacaaaatgtaaacaaggaatccctttttgggcaatctttcggttcattggtcccgatttttttttttttaataaaattctggaaacccattctaagtctaatttgagccgctgagtacgaatctgaccaccttttcgaccaatttcgaatcccgaa

SEQ ID NO: 43914 - DNA, 953 bp, Heterodera glycines
  misc_feature (6)..(6): n is a, c, g, or t
cctccncgtttctccgtcacctgcgtcgaactgaggcccgttttccgttcaatttcaagcttttgttcagtcttcgggtatttgtccttttcgaaatactcgcgaagtatcttcaaactcaatttgagaaattttccgattgtttttccttacccttcggtcgccctttttgaatgagtacactgtttcctcttcacagacactcattggcggcggatatttcttccgaattcggtatttatccaccggcaccaattctttgtgcttccgctgccgttcctcttcataatgtgcagaaaaccttttttgaaaaactatctgatacaaattaatcggtgcttttgaaaaaaggtcaattttgaaatttaataaaaactaaaagggggccttttcgtttacaaaaacatcttataaattatgtctcacaattaaaacttgtttctgtggttttggcggtccttgatcatgaaactgatatcgatttcggtttcctaacctaactgtgaacaaaaaaatcacaaaacgaattttgaattttcgactttttgttcttggttaggttttagaattggtcaaaataggtgttagattcgtgatcaggactaaaaaatccacgaaatgcaagttttcacgaatttcacaaaaaaaatttgcaaaccaaaaggccctcccctccttttttataaaattcaaaattatttttaaaaaatgccaattaatctagaaattattttgtgatttcctacagcagtcaaaactgactggcctcaactggaaatcccgagtttttagatcttgactatgaaaaaatgcatttttgaataaaaataattaattagttgaataaaaaaaattattttcaggaaattataagtattaagccaatgatttggggcttcttaaaaagcatataatacaatataattaaaaatttaatttttcataaataaaaa

SEQ ID NO: 43915 - DNA, 1390 bp, Heterodera glycines
cgtcggtgggctggcgagtttactttgaacaaatcagagtgcttcaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttcccgaaaaggggttggtaaaccggtgaaatttgccgtgattgggatcggacattgcaattattgtccgtgaacgaggaattccttgtaggggcgagtcatcaactcgctctgaatacgtccctgccctttgtacacaccgcccgtcgctgccccgggactgagccatttcgagaaattcggggacggttagtgtttcggtttcggtcggtatgcagactggatccgatttaattgcagtggcttgagccgggcaaaagtcgtaacaaggtagctgtaggtgaacctgttgctggatcattccccaagtgattctctaatagaatccctcttgttctcgatttggttgaatggtgattatagttttctcgtgggttcgtttctggttggcagcacctgtagtggtgtccgttgaattaagaacttacatttttagcaaaatatacagtaatcagcgcctcgttctgattcgaaatatttactaatgaaagttttgttttttatatatttgctcatatatatatatatcatcaatttgactaaaagtgcgcaccattgtaaaaaaaatgaagtttcgaaacaaaagttaaaaaaacaataagtgtgaagaaacagtagacactg

SEQ ID NO: 43916 - DNA, 1456 bp, Heterodera glycines
  misc_feature (1441)..(1441): n is a, c, g, or t
tcataaaatgggaggcatttagtttcaaaatacgtataaatgaaaattgtttgaaaattaaataattggcgaaaacccaaaataaaactaataactaaaaaacttatgaatgatacaacagggcgcgggatggaaaattttgaaaaatcagaacatcgaacacgaaaaatcagattatatggtctaaattttatttttaatattttggattttttttaatctaatcagtataattggaatttatcaatgtaaatgcatttatcatttgttacttattgcgaatattttagtcagtagaacataaattgtacacaaaaaagagactttacgaaatggctgaagagaatatgctttatataaatgcttaattatgtcggcttattatttgtcgtgaataaaactttttggttacaatcatttttggtcttttatctgacttttattcatccgtctttgcggtagttaaaggaaataaattttaccaaaatttatgcaagaaaactaattaattcaaaataataaaagataatataagacagttactaagtaattgatttcattttcaattggcaaaaatattaattagttcatacaagtgaaaattaaaaaattctagctttaaaattatcatagaaatgaagaaacttgcgaaaaatgtgatcgtaaggagctgtattttttccagattttatgaaaaaattttcggaaaggaaacgggaattcaaaataaaaactttttcgttattaagatttttgaaaattggaaactaaaatacagttaaaaatcagaaaccaagtttaaaaaagattccgattttaggctgtttaaaacttttaattccttcaataataacaaacatttaattgcaaggaatttctcaaaatcataaacaatttaaatatagcattcatttattttttaaattctattttaatgagttatttatttattttttatgataattttttgtttttataaattatttatgctaatgataattttatttgatattttaaagatttatgtaaattcaaaataaggtcattttcatgcctaaaaagattttgaaatttggataattagtagataacccttagtgctatcgaatgatctaaagaattaaaatattcttactcttaggaaaatttataagcaaaaattttttttgagaagtagagttaagtaataattccatttttatttgcttataattagggatgggaaattaagtcatagcaagcaatttaaaaatgaataaacttaactaaaaaagccccggtccggacactccgccaccgacaaaccccgaaatgcaccaaattttataggaataatccctcgtataggttgactaacttaacctgaaaatatttcaactcttaatggtttttttttcgaaattctgagttttcaaatagtttattttattttttgcaaaanttaactcataaatat

SEQ ID NO: 43917 - DNA, 1259 bp, Heterodera glycines
atgcccaatattcatcctctctgattgtgagtgttcttctccctccatttttccatgccgttcgttcgttccgccaaattcgctatcattcgccacaacttttcgctgctgttccgggaataaatgtcgttgcagcaaggtcttttcgatcacatagctccgatttccgatcagcagtcggccgtcctttggcaaagtgtccaccgtggccaaataaacaaagccgggcggaagttgcggggaatgatccgccggtgccacttcaatttggccttttggtctgccattttgttgttgttttgttgcattttgttcgactttttcgtttccatttgaaaatgaaacattcaatgcttcgcttttaaacttttgctccgattggttttccgccggcagcggatcaccgattattatcgtcggaagtgagtccaacgatcggtcttcttcttgcattttttccgatgacttttctgtttgcttttgctgcggttctgaattgtttttcgatgccattttcccatcctttttcattggagccgttcgtcccgaatttgtcggctcgggcgaatcgcgatccaaaattcgcggcatttgttgtgctggtcgattttgcttttttggcccaactcgtcctctgttcgttgccttaaggtgatcggaaggtggtaaatgtgtgagtgatcagtccttccattttccgttcccacctttcccaatgtttccatgattttctgtctctgtgttttgtttcgacttttctgtccattttcgaccgctttttccaccaaagaagagactacttcgacccccgagggtaaatcccgaaacacttcttcctttttcttctcctttctactctctccgttcgtttgaagttcgtcgtcgtttcctcctgagatgcgtttctttccttcttcctttggcactgtctgtggccgttttgtcgttggcacgggcggccaaagaattggactcggttcgcttttgcttgtgaccggcactaatttgggccatattttaacttcgtctcgttcaatcgccgcttcgcccgaccattccgcaattccccgaagcgtttgccccgccgattgcgttttggcggcgtctctgcggactcggcccgattctctctaaattaatttgtttgacaattatttctgtaaattgggtaatttgttcaaatttccggtttttaatcaccgcctcattccaattgttaagctaattaattccttttttgccccatttcacattttgac

SEQ ID NO: 43918 - DNA, 1097 bp, Heterodera glycines
aacaaataaataacttgttcaactgtgtgttgctaggccagtgcctacgcttctgaggacggtgtgctgaccgagcaaatgattgacacgaacacggcggaagtgttgcgacagcatcgacgcaaaatggaatggttggcggcggagcgagcgtcgtcgtcggcaatggcattggcatccgtcacggatgacggcgagtcggcaaaacagaagcggtcaaagggggcggctgctaccaagaaaatggggacagatggcggcaacggacagtgaatcattcattcattcattttggtgatcacttacacccatttttggactgattgattggctcattgattctcgactcttggccaaaaaccaaatgtgccgtttgtttgtttgtttgtttcttttttattgttttattgttgttgtttgctgaatttatcattattttttccatttttgaagaaaatttatagtgtggccacgtttaaaacatatgttggattttctcttaatgatagacatgtcaattcaatttaaattaaaaaaaaagatgaatcgaaaataataggtaataaaattgaaattccgtcacccctgtaaacacattaacccataaaacttaggcgaccgtcgctgtggcttgtctccaaataaaaattcaaattaagacacctgcattttaaattgggcattatttatatactagagaatggaattttgttagttccgggcccgggcctagacaattggccggtacggtctgtccggtccaaaaaagcccgtgttttactgggcggcccgataaagcccgccggacacgtctggtctctaatttatacactgcaaaacgcaaccgtttcgctaccgtaacccagttcaccgtaatcacacattgttattctaggctaatgtaatgcgcgacggctgttaattgtaaagccagcatacaagaggagaggagaccaccacatttcgggccggtttcaatttcggtgacctttcccctccccctcttcccgcccaatttcccttccggggatgtccgtccccaccaccgtcgacgagacgactgaccaccccccccccctcatttgtttgcacttgca

SEQ ID NO: 43919 - DNA, 1039 bp, Heterodera glycines
  misc_feature (25)..(26): n is a, c, g, or t
accacattttactggtggaaagtcnncaagtaccttattcggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggccttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctagccatccctcccttttgtgcactatttcgtttcaaaattgaatcatttttttttgtcttttgaaataaattgtgaaaaatatacgaaaattattttcggttttaattatgctgtacaatacttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttttgtcttttgaaataaattgtgaaaaatatacgaaaattattttcggttttaattatgctgtacaatgcttttaagccccgccgtgcggcggctccccttttgtgcactattttagtttttataattgattccggactttttggctgtttgaaataaattgtgaaaaatatacgaaaattattttagcttttaattatgcagtacaatgcttttaagccccgcc

SEQ ID NO: 43920 - DNA, 1428 bp, Heterodera glycines
  misc_feature (56)..(56): n is a, c, g, or t
  misc_feature (1403)..(1403): n is a, c, g, or t
gcattatttccgtttatttttggtctgcaaattctgcccaagcatgaattcgacanaagtcgaaataaattttaaaagagaaattagagtccaaataggtcataattagggcgttaatcacaaaataagtcattttttataaaaatttttagccagggctcccactgatttatcagcattttgctgatttcatgggatcaaaactggtttttttatgagatgctgatttttgctgctttttgaaaaactcctcaaaaatggccattttatgtaaaactgttactaaaaactccgatattttcaaataggaattttttagaaaattttcagatttttagtgtattttggggtgttcaggtcaccatgatttcatggggcaatgcttttgaccgtgactgtagataattttgtgctttttggatgagcctaatcatttttcataaaagaattttcagcctgctcgagttttttcaaggactttccggatttcaagccattttcgtgttttcagagcacccttaaggaatgaatgatctgacgaacatgtgtattacaaaaaatccatcgttttttttctcttcgtcatttcgacttctcaattagtgcctattttctagggtacaaaaagtttttgaccagttggcattttgtctaaaatttcttaacaaaatgcaataaaaacaaaaatacccccctaagaattgaccccataaaattccgaaaaatacacccctaaaatcttggattgaatatacacaaactttgaataatttatttgtttcccctatattaaacaattcaatgatttctttttatcaaattttcatgcaacaatataattttactaaaagaaataaatatttagtggaaaatgattaaaataaattgataaatatgcccaaagaataaattactaaaagttatcagaaaaagaaggaaaagcatgaataaacgaagaaagcatattcttttttcctcagaagttaacttttttgttctgtgtgggattaggcccggatggaacttcatgctgttgaaaaacaaaattaatgataagaatagttttcttgtttaacttcttcccgttaattgaccaatcttttaaagaataactaatgcatcttgctaatcttaccaaatctcggcccggcatttgaggtggtggtgcacattgttgttttttaactgcttgaacttctccacccttttgggaagcgtttgccgcgcccggtgccacggatgacagtgccaatacgccagtgaaaatccgtccaatctttgacatcattccgttcgaattattcagattatcatcatcggcattttcttcaatgataaataaatttatttttttaacaaaacaaaaacaaactctttgattcagtggatgctaataataaganaagccaaaaacactacaagaagcga

SEQ ID NO: 43921 - DNA, 1159 bp, Heterodera glycines
taattttttaagcatttttaaatatttgatacggtaaataatttggaattaattttcattttttagcatttttcagttttcaactatttttattacattctaaaatgtcatagccaacatgtttttttaggtttatgtataatgggtaaattagtgaattttcttatatcgtaaaatcaaataaaatatccgttaaaaattgaataattttgggccaaatcttttttcaaatcgtcacgacttggcatgattccagtttttcaattttttcaaaaatccatccactaatttatcccaatccttttttccccagaaattgtcgaagtggctgaagaaatcggtctctgccacaatttggcctatttggacataagcacaaacattgtgaccgggtaggcctccgttttttccaaaattttcgccgttttttaaagtgaattttctttgttcagttttcccaaatcgtttgtcaacctcactcagttgtccagcctgaacttgtccaacaattccatcacccatctgcctcaggacattgacgggctcgtcaatttgcaggcacagtttttattttttaagaaatcccattaattattcactaattaattaactatcaacgcccttgaaacccgaaaaatgggcaaatttttgaatgtcaaataattcttttaccgttacaataggtattaaaattataaaaaatagttgccagcatcaaaaaaatgctcaaattttgcatttttggtgttgttgcacaaaattgttgggcaacaccccgaatttgagggaatttcccggcaagtttttggcattgattaactctctgtttttttaacaaaaaattcttgtcgaaggtctttcacccctttactcttcccctcttaaaaggggaaaattcgaaatttttgcttaaaattttcaaaaaattttcccgaaattcccaatctttttttactctgacccctcttctaggaggcttttattttcctaaaattcaattttttcaaaaagccatccactaatttatcccaatttttcgccgttttatcaacgcccttgaaacaagaaaaatgggcaaatttttgaatgtcaaataactcttttacccgttaaataggtattaaaattataaaaaatatttgccagcatcaactgggac

SEQ ID NO: 43922 - DNA, 728 bp, Heterodera glycines
aaaacgagagatgaaccaataaatagagagtgcagagaaagaaacatctctctttttggcgtactatttctttatctctgttaatagagaaaacccgaatttacttcatcctgtttaacgttttttttctgcttgttagacctacaccaaattttgcataccgattgagaaaaattttgcgcatagaataatacgtttttattttttgtttatacgttagttcaaatgttataagaaaaacaaattttcgaagactcatatcttttttctaactcaccaattgtttagcatttgcttagaaaaagattctcctcatcagcagctttcgaatgataccaagattgtccagtttggttggcaaaaactctcaaaaatgattcttgaatacgctgacccacaaaatgtccaagtctcgaaattgagtttttttattattcggatgggcctaaggttagacaaggcgtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcccttgaatatcgtcattttttaaatttttttctttctctgtaaagaaatagtacgccaaaatgagagaaatgtatttttctctgcactctctatttattggcacatgtct

SEQ ID NO: 43923 - DNA, 1278 bp, Heterodera glycines
  misc_feature (86)..(86): n is a, c, g, or t
aaataacttttttagttgtataaatgcgtattttttaattccaaaaaaatctttacgttttcattgtcatggtttattgttttttntagttggaagaattcagtttttatttcttatttttacgaaagcaagtttttaactgaaaattatcaaaacatttaatttatctgacaaggttgcttcagatggtcgtgtaaaatttgtcattattttctatgctcatccgaaaacattttttaggaaaagctaaagtaatgacatgacaactacgaaattaacaggttaaactttgtgaaattatatccgtttttgatttttttttttcatgtgtaaatgcatgaaattcaaaaaatattaaaatcaaacattgccaacagaaaaatttaatcaattaaatgccgcattggacatcagcaattttctcaatccaacaaccgtcgagaggagaataaatgttcaaaatgcctttcaaaaaacattttttatttaaatgaaatttttgataatttttttgtttttacttgtgccaaataaactgttacataatccgccacttgcaacgccaatttggacaaaatttgtgccatttgtggccaacaaaggcccaccgctatcgcccttaattattattttgaaattaattatttaacataaattaagcaaatatttaagcattttaattaaaatttgccaacttgctcaatggtattcttctcaatgcaaattcgttcctgtccatcattaaagaatgatttcttgcatttcactaattgagcactgcgacccattagcgttaatggacttttttgggacttttgagtacaactatctaaataacttactcatttattaattttattttaaatttaatttattcaaatattaataaatatgattcaattttggatttttttttaataatatttaagcttgctaattaattaattgactaagcttactctttaaatatccccatccagcaatatatgcttttccttcttcaaatttttcacgggccccgcaatgaatgcaaattggaaaaattgttgatgaaagttcgacttctttatccatctaaaatgtatccgatttaattttagaaattattttttaaattgccttaattaatgccaaatcgtttatgccagccttcctcttatacattgggtggattatcacattcaaatcggtgtgacggagcaattcaactaaaaatccatcatactgtttgctcgtaagattgcgcgagttcgacccgaaacctaaaaatggcaaaaa

SEQ ID NO: 43924 - DNA, 842 bp, Heterodera glycines
  misc_feature (47)..(47): n is a, c, g, or t
aaaatgcattaatttatttcaaaagaatcattaaaatcactaacacntggtccataacacaatttgaaaccagaaattccgaacaccgaactcaaaattctgataaaaagttgaaaattcaagttcttttaaatttcatattttgttcaacctttgtttacacacacggaaacgaactgaaagtcatccctgatacacatcaatgcttcaataaaatcgtttaaaccattttagattaaaaatcaaaatcgaaaaattccaatttcgactttattcgaattcaggctggtgttgtaaataggttgaaatggagtgctcagtagagaccggaaatttcaaatttgcggatcccgctgcgggattggaactcaaaattctttgcgggacgggatcccgcgggattaatcccgcattttaaaaaaaatgtgggattgcggactgggatcccgcaaaaccccgcgcgggatcccgtcccgcgccggtctctagtgctcagcgcctcaaaatacccaaagaaacttgttaaagaattcccagaaaaaaaaaatttcgggaccaatgatcgacatgattgctctttaaatttgtggaaaatatagaggaatatatcgttctgcaatttttccttcctgcgttaactttcaatttgaagcatattaaattggagagaaactttgctgaaatataacgcattgaatgcaattaactgttaaagaatttttgcgtttaatgcattttgttgcacattcagttgacacttttcggttgcgcatcgagtagcggaaagcgttttttgaaatttttgcgtaaaaaagtttcttcagaaaatttttgaaaatttt

SEQ ID NO: 43925 - DNA, 962 bp, Heterodera glycines
attcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacttattgccaatctaatttcttgcagatttaaagctatccattgcctgccggttctcggcacagcaaagcactaatagggtgtttgctcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccttacacaagttttttacaaccacttattgccaatctaatttcttgcagatttaaagctatccattgcctgccggtctcgacacagcaaagcactaatagggtgtttgactcacttcaaaaaataattccatacccaaaagttttttacaaccacatattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttagctacttcaaaaataattccatacccaaaagtttttttactaccacatattgccaatct

SEQ ID NO: 43926 - DNA, 1047 bp, Heterodera glycines
  misc_feature (20)..(20): n is a, c, g, or t
ttcaaaaaaccaaatattcncaacttttcttggccataaatttgttcaaaattgacgaattttttttaaaattttgcaggctaatagagcatgttaagagcattcgaatgataccaagaatgttgaatttggttgacaaagaaaaaagttatagtgcaaaaacatgctggggccgaaccgtgccggggccaaactgaggttgaccggtttagggggtgcaccaatacaaaaaaatttaaaatttcaataaaattattattatatattagccttttacatatttgcgcattttccattttttttttaaagaaatttttgccaaagaatttgccaagcttcaattgaatggccacgaagctgatgggtgtgcgttggttaacacaattgccaaatgctttcaaataaccaaaaagtcggagcttgcacgcaatttttatcaaattgctgccaaaatgcagtaaacattaatttgaatacaaattaattaccccactaattaatcactaattaggccctcaaatgtcactgttaaaaatttggaccaaacacaattggccttggtcaaaacggaagcaaattacgacgacaattttccagaagaattaaaagcaattgaacacaaattggaaattgccgaattaaagggttattttccataaaaaatttttttataaatttattttttaggcgatgaaatggctcaaatgtccgcccatggacaaatggccaaacttttgtctaacaattttttaaaatttgatttggccatttgccactgtgccgaacagcttcgacttgccaacaaagtagggtagcgagcactaaaccattccgaagcctatctctaaatttaaaattttttttgaaattttttcagttttccgtcaacccaaaaaatgtcaatcccatccgcttggagttggccaatctgcatttgaaaatcagaaacactgaccaggcaacacagaattttaagctaatattggaggaacagccttcggatccgggcgctctgtttggtcttggccaggccttttatttgacggt

SEQ ID NO: 43927 - DNA, 1531 bp, Heterodera glycines
  misc_feature (338)..(338): n is a, c, g, or t
acggcagggggaagagacggagcagcacacggggccaaactgagtcgaaattaagcggaaaatggggcggaagaggaggaaatgcttaaatgggacagataatttggggtggggaaatttgtttaaataaaattttaaaaggaataatgaggaaggaataaaaattaaaatatatatagggtctatagtttatattggggcaattaccgtcgtcattccaaaattcgttcacagaattcgctggtcgcttcgactgaaaggctggaggagagacacagtgccgcgaggacccaatcgttggctctttacgagttttgatgcagcaaaatatcagtgtncaaaaagggggggggggtaccatcttaaaggtataccaaaattttcatacaaggcaaactacagggaaaaacctaaaaaaaattcgctcccaattttcagtgaatacaagcggcgagctgaacaagggcggtgtacgtcatgacgaactgcttccattggccaaacatgtcaaggaacagtgccactctttgacactgattggtgggtagaggcccaaaattggaaaaaaaattatttgaaccccgctacgacttgcccttttccgccttttctcgaaattttcttataaaaattttgtgagattacggaatcgggaatcccgcattgcggttgtccacagagttggagctgtccatgggaatgagtgccgactgactatcaattgggtgagtgtgccaattcatctggcttttccgatcacttctcagcactgatcaaacagttgttcaatcaacttttaagcgatcaaatatggcagtacaaatgtgcgcatcggttcgaccatttttggtgcacgaagtctaattatattttcagccggaatttctataaaaatgttcgtgtgtaacctatctttgtctattctgataagtaagaaattgaaatattcgtattactttgcctcccttaaagctttataatgaaagcgtcgatgtctatttaggatgtgccatctcaattctgtagttccactttgcgaatccaaagaaatttgagtcgattttacaaaagacaaagtgtcgaaatgcgcagcattcctaggccctaaatgttactgacagtatcattcagagggcatgctatttttttgtatgcataaatcgaaatgtcgagaagggtatttgtagaataagtgtgatctgacattgtgtgacatgtcattctgatttcatttgattgctcgacacactcctaagcagttgcgcatttacagcaaagtaaatttaaaatttatttgatgtaattgactaatcaattaattcttatataaaaaagcaggggacggataaatatttgctaaaatacgccaaatattgaaatttttattttcctaaaaaagccttaaataatcgcatttttaaaattaaattgttcttatattattaataagattctattgcaaatatgtgtggatgacatttgaataataatgatgacacttctccttatgaccggaaaaatttatattaaa

SEQ ID NO: 43928 - DNA, 1210 bp, Heterodera glycines
agcatggtgcacccccagcatttaagatgagtgaacctttaaagaaagttgtttttttcctttgaatatgaaatcggctcccggaacaaatagcaattgggccaaaatgtgaaaccagcttcatgtctatcagtattactcccaatcagaccgggttgggttttcatgaagcgaataagatatgccacccaaaaacgaagtggtgcatcccaacaaaaaccataccctcgcagcgtctttggtgtgtgtgaagtagacaaagccaaagccccgcgagcgtcccgagagacggtcgtacacaatttgcaccgaatcaacctcgccataacggccaaacaaatgcttcaggtcgcgctccgtggtatgctgaaagcaaataaattttaaggggcctatcgctcgcccactccaacaaacaattcgcatttacttcaaaaagtaaacttcgggttcgctgtaaaaatgcatgccaccaacccacaaaaaatgtttttgcaacttttaatgaatttctaagaaaattttgcgcccctccctcaatatgtttccccatccccgagactcacaatcagtcacaattaactgacacaaatattgaacacacacaactgaccaaactcatgccaaacacgcccaagcatgggttcggatttgggttgtcgcgtccgtcatggaaacgacgcgagccgtagtaaccgccgccgccaccaccaccgcgtgaggagggcaaatcacgcgagcgagaacgactgaaaaatggagacggattcaaattagaaatggccaaaattctgtaccaccgtcgacccggcaatcccataattttacacaaaaaattacgttttttctgtttcacccaaacaaccggctgagagaaaaccacctcctccttttcctttctttccctctttttcatcattgtttgggagccttttttgcttttttggcgatttcctcgtgccaccacacagtttgctttgattgaattgaacagttttgattgatcggcagatttgtgaggatttgatcgaccgattgattgattattgtgattgatcagttggttggccaaatgattgatcgtttgattcgattgctttgtcatcaattgggaggcccgaccgcacacattttgagaaattgaggtttgacaatttgaaattttgagagtttctttctttctattgctatgtgtgtttgattgtgagag

SEQ ID NO: 43929 - DNA, 932 bp, Heterodera glycines
atatgaccaattaaacgcttacttgatgcgacggtccttcttgcgcagcgcgttctgcgtctccttgtggcggcgcgtctcctcgtcaagtgcggtctccaggtcgcgaatgcgcgtctccagcttggcaatcacgcgcttgccgcccaacagtgcagcggcctccgcctcttggatttgcacctgcagctgcttcacctgctcctcaagcgacttgcgcagagcgtcaatcttcatcgagtgttcctgctcctcgtgcagttgctccacagcacgcgctgcgtccgccaacgcacggttggcactgtacaaagatataacgcgtaactcgaataacgaccacacttaccgttcgtccgctgcgtgcagttccttggttgcctcgtccaagtccgcttgtgcagtagacagctcggtctccagcttgttcttgattgcagtcaggttgttgttgatggattgcaggtcgttgatgctgcaattgttgtagcgcaatgatcaacttgcactcaatgcacgaggcgtgtacaaattttacttaccgtccgtgcgcctcttccaggtccaactcggcctgcttgcgtgcgcgcaccgcattgtccagcgcagtcttgcactcctccagctctgccgccagtgcggacactttgcgttgggcaagcgcgtactgcaggtgacaaaaacaaatacaatgagtcacacgctcgcactcaagctgacctggtccagcgtttgctgcaactggcgctgcgtgtcctccaggctggcctgcaacaccttgagctgctcgctctgcttcttgatggtcttctgtgcctcgatgttggcacggttcaaattgtctgtgtagcataattaggcaggcataattacataagatataattagttaattatttcctaccgtatcattaatgaaaaggtactgtagcg

SEQ ID NO: 43930 - DNA, 1347 bp, Heterodera glycines
attgaaaatttaaataaatttaaaagtgaaaatagtaaaaaagcttacaacaccttcgattcccaggacgtctccgttccaagtactaagaaggcccaacgttgcttaacttgccagatcggacgggatggagtgctttcaacgtggtatggtcgtaagcgaaaggactgcaattaaaggcatttaaataggcatatttaaaagagcctatttttttgccttttcacaagagaatttattaaaaaaggcaaaattcgccttaaattaataaggtgaaagtttgaaaatgtttattaaaaaatttcaggatgaaatataattaaaataaatcaaaaagaaaaaaaataaatttatttttctaaataaataaaaaacattgtcagaggcagtgtctgccgaaaaaatagacaaaattttttcaaaaaagccaaaaaaaaaattgaaaatttaaataaatttaaaagtgaaaaaaattaaagtaatttaaataggcatattttaaaaaagcctatttttttgccttttcacaagagaatttattaaaaaaaggcaaaattcgccttaaattaataaggtgaatgtttgaaaatgtttattaaaaaatttcaggatgaaatacaattaaaataatcaaaaagaaaaaaataaatttatttttctaaataaataaaaaacattgtcagaggcagtgcctgcctaaaaaatagcaaaattttttcaaaaaagccaaaaaaaattgaaaatttaaataaatttaaaagtgaaaatagtaaaaaagcttacaacaccttcgattcccaggacgtctccgttccaagtactaagaaggcccaacgttgcttaacttgccagatcggacgggatggcgtgctttcaacgttgtatggtcgtaagcgaaaggacagcaattaaagtcatttaaataggcatatttaaaagagcctatttttttgccttttcacaagagaatttattaaaaaaggcaaaattcgccttaaattaataaggtgaaagtttgaaaatgtttattaaaaaatttcaggatgaaatataattaaaataaatcaaaaagaaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggagtgctaacgacgtggtatggtcgtaagcgaaaggactgcaatta

SEQ ID NO: 43931 - DNA, 806 bp, Heterodera glycines
ttctcgaaatgtgaatatttttttaatactttttttaggaccttcggaggcggatcgcatccatctgactacactaaaattcattcacccaacaatcaattcactttctgtttacaaattttggattgctaataactgcttttgccgatattaaaatggttttatcatatttgaaaagaaatgagttcttttttttactaatttatggcgcagtaaattaaaatttctcgtgttgaaattgcgcgttagccaaaaaccaacaaatgaaaattttttgcagaaaatatttataacttcgccaaaaatgaaacaattttgtcataacttttttgaaatttaacgaaatttttgtaatcttgcaggctaatacatacttagtgctatcgaaagatataaagaattaaaaaatggttgtttttgagcaagattggttatatcaaaaaaattttcatttgatggtttcttgactaacgtcaaggcaccgaattaccactccaaattactgaaaaacattagaattgcacattttattcggcttatttttgcttcgaattacaacactcttttgtaatgtgtctagctggggtataaattaaaaaatgttttgcgaagcttttgttgattgatcatgttcatctttcgtcgccaaattcattgaaatccggtgccgcggcctccaaaatttcgccatttttccgtccgtttatcggcgcccccatccccaacctttgaaaaaaaatgaaattattaagatgcaaatctagtatttttctgcaaattgttcattctttttaaattggtctaat

SEQ ID NO: 43932 - DNA, 1274 bp, Heterodera glycines
ataatataattgcacgaaaattgatccacccttcgatcttttatgaattttcaaatattagggccaaaatcccgagggccaaaaaattgccaaaaaataaagaatttttaaaaaattccaaaaattatgaaacttaaaatagacatcatattcgtactcagcaccttattttaccccagaaaaatatttttcacccccattttcgtccgaaaaaaaatttccgaaaatttctagggggcctagctcgaaaaattttgaaaatttccggccatatggcacaccattcgatagagcttaaaaagctctacaattttgccctaaggcgtttttttgataaaaccaacccctgacgagttatgggcccgggactcaaaagtcccgctcaggccaaaaattttttctatttccgggaaaaaatcgaaatttttccgaaaaaaataccagtcgatagagctcgaaaaactatgttttggaagtggtctccgtttctctgggaaaattcgttaaaaattcctaaaattcaaaaacccgaaaaccgttttttaggcctagctcgaaaaattttgaaaattttcgaaattttaaaaactggaaaaatccagctcattgaactctacaataagtctgctggtaactccccgcccagatcaaaccctaatgagttattcaaccgggactgaactggacaaagttggtactgaaaaagtccacgaacctacagcctttcctattgcagatagaggcttggaattttttttgttttttagaaaacacttcaacttagccccctcacagcagacattttttgatttgggttttagaaaaaaagttacgggcccccaaatgcacgaaaaaatgagaaatccgtccctgggactcagtcgtccgcgctaaatttttttctatagttttcccggattctcctcaaaaagtgtaagacccttccactactttcagggcgctccgccgcccgctcggggggggggatttgtttttgtatatgaaaaaaccccttttaaaaaaatataaaaaaaaaaaaaaggggggggggcgccgcttttttttttataaaaaaaaaaaaccctcctttttttgttttttcccctcctcccaagaaaaagagaaaaaagaaaaaaacaaaacaaaagagtttttttttttttttatttttattaaaattttttttttttttttttttttttttttttttttttttttttttcccccccccccgcccccccccacacatctttttttttttttttttttttttt

SEQ ID NO: 43933 - DNA, 1316 bp, Heterodera glycines
  misc_feature (115)..(115): n is a, c, g, or t
  misc_feature (129)..(129): n is a, c, g, or t
aaaaccattatttattcaggctcttgatggacaattagaattaaaatctaattaaaatatgagaattataatctgaaattttgaaaaattaattccgtatcatgagaattagacncaggacagaattcntaggattaaaaattaaaaatattttctgttcatggaatttatataagtagaatgataaaaagtttatgtgcttaatattttgtaactcaaaactattttcaatatttatttttgcatttttatgcaattttattatttgtatttaatttgactgtttttcaggttaattgcaccagtcgagaagaaggagcaaattttaaggaaagggcacaaagaaaagggcaaaaagagacaaatgtaaacagaattttagaactttaattgccaaattcagcaggtggaaaacgaaataaatgcagcataaagaaatcaatgtgaagaaacattttgttttttggaaaaataaatttaaatttacgaatcatttcattcgcccaaaatgttcaggaaaagaattaccttctttagatggaaaacaataaattttgttataaatgaatgactaaaattccaattggagggatgctttttttcctttttaacaaaaaaatggcctcataataaaatttaaaaccaagacagtaaaactaacggaaacaacggaattctgtccatcactgctctgaatgtttggcaattatgaaaatgaattttagcaagtcaaatgaaattttggaaattttacgaaaaacttcagcgaacatttgagtgccaagctcaaatttatcaattgtaaagccgactttgaaatttggttctattattacagagatgccaagtgcacttatttctagttatacagattttgaaggcctaaatcttaaaaattaaaatgcacaggtttgtaagaatgaagtgattacgcctgtaattctaacactttctattttgtatatttctctaaagtcagaacgattttttctcagctgggacccaaaagtaacaattttggtgaaaacaattaataaaatcaaaaattttcagaattttcccggcgtcgcctattgcaatcgcttgtaattcttttttgcagaaaaatttgcctcataacgaaaatttaaaattagatactgttaaattaacgaaaaaaccgaattctgcccatcattgtcccagccacgaaaagtccaaagtagcaaaaacacaaccaaatgtcccaaattctaaaaaagatagaatgatacaacaatttttaattctgaataactttcataattttaagtttaaaaaagaccaaaaattaataa

SEQ ID NO: 43934 - DNA, 948 bp, Heterodera glycines
  misc_feature (157)..(157): n is a, c, g, or t
  misc_feature (175)..(175): n is a, c, g, or t
  misc_feature (905)..(905): n is a, c, g, or t
ttcattatttatttatttttgcaaaattaattcataaatattttttagaacgtgctccgaaacgcaccaaatgttaattaaaagttaaataaggctctctgatgcttttctatcaaaagggagatgaataaaatttttaaaaattttaattgctttntaaataagccaaaaagtntaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataaaatttttaaaaattttaattgctttttaaataagccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaacgtgctctgaaacgcaccaaatgttaattaaaagttaaataaggctctctgatgctttttctatcaaaagggagatgaataaaaattttaaaaatttttaattcctttttaaacaggccaaaaagtttaggcgtatattttaaaagttttatcgaacctagcgcactaaaatcgatataatctctccanaattttgcaggccttctccattgtaaaggactaacttaacctg

SEQ ID NO: 43935 - DNA, 684 bp, Heterodera glycines
aattactaatcaatactctcaatattataacgaacaattttagaaagggcggaagagatctttagcaataattaatgcttcgtgggttggacccaaaaaagtattcctcgtccatcacatcaaaattttcaatcattgcatcaatggaatcactcattctcgaaccaatcagtcccaaggacaattcggaggttcgtttactaccatcgtggatggattacacattttgcactcactcacctttccaatacaatagccatcgcagtaatgacgctcttgaaatctaacgccctccccccccatgaattacggattgtccgatgaattatcaaatgatggcacaacaaacacaccttgagatggcattccatgggaatttggtgtagaagcgaatcttaaaggcaattgtatagaaaaaaacagaagaggagagagaacggcaagagagttgggaaggaatgactaaaatttacggaattcggaccattaaaaatctaggaccaaaaaagaggaagaaacaatccatttgccagcaaaccttccagtcggtgtagtaatggaccgggtcgtccatttccctgatactcggcacaaaaatgtcccaaaggcagaagccgacaaaagcggacaaagtgccgaacaaaaaccatttgagcaagcgccgccgtctgccgcgccggaggg

SEQ ID NO: 43936 - DNA, 1686 bp, Heterodera glycines
  misc_feature (8)..(8): n is a, c, g, or t
  misc_feature (1214)..(1214): n is a, c, g, or t
  misc_feature (1491)..(1491): n is a, c, g, or t
  misc_feature (1550)..(1550): n is a, c, g, or t
  misc_feature (1559)..(1559): n is a, c, g, or t
aaattttntgttaataaatagaaatgttgcttatatgctttaaaacatggtaaatttattctaaaactttatttaaatattttaacttttcgattttgagatctaatcataacaataaggaaatgttaaataaagcaactttttaaaattttatttaaataatttttataaaaaactaaacctttaaaattggcattatttttacacttttaatgattcttatttttgctggcatttttaattttattattgttgaattaaattactaaaaatcattgaaacttttaatattttataattattttacaataatttttgtaaatttaaaaaaataattttatatagtaaatttttaaaaaaattgaaaaatttattatttttgttatcttgtttcatttttcgttcttcataattgaatttataataaattgttaaattaataattttcataattatactaaaatagataaaatttgtgttgttatctttttgtttttaatattttatttctacactaaaatgtttttttcagtagaaaaaacccaaaacataattttatgaattaccataatataaatggcataaaataaatggataaatggataaattttattattttcttttatttcatttaatgttttattgaatgtgtaaacttattcgaagatataatttacaaaaattttcatgagaaaaggttataattttattttattttttatctttatcatttaatttagatttttaattttcaaatgtacgatctgtttattcgtaaatacatatatggcgctgccggtgatatattttgattaaaaaattactataaattattttaaaaattatttattgttgttattgattatttaaaaataaacatttaattctggtttaaatatgaaaattttatttttttataaataataattcaagaaaaagttgcatttttaagtttttgatatataattaataacagcattcagttaaaaaataaattaaattctattttatattttatagatcattatttttttatttcttttatttgtattcttgaaatcaaacattaacaaacttatttttgctgttaatcgtttttgtttttccttttcacaaaatttatttagaaaaaaatatattaaaaaattaatttttggaaatataaaaaatattctcgatattttggcaaattaaagcttgattattttctcatnaaataattaaaaatattttacatatcattgccaaaattcagattaatcattatttatatttttggacttttttagtgagttaaatcaaattattcttttattcacttttttgttatttgtatttgaatttttaaataaattttcaattttattcattaatatttgatttattttaaaaaatttccaattttatttcaattttaaaagtatattcttgaatttcaaagtctaataatgatttgtttctaattgttgattaatttgtgctgtttgctgnttaaagaaattttggaaaaaagcattttattttacattatcatatattttaatattaantaatatttngaaagttcttttgatttttaatatttctctttgacattgagacttctgcacacgcattggaattgggtaattttataatgcttagtgtaaatatgataaattgaagattgccgtctgttttcatgaa

SEQ ID NO: 43937 - DNA, 485 bp, Heterodera glycines
agtacatacttggatttcggcttttgtgcttggaaaattttaactgtacttttttccaagattgtacttggaaatcgggatttttgggcaatggtaaagttttgtggtttcttcgaaaaataaaatttaaataattccgaagtgcattttctaggctaaaaaaatacgctgatcacgaatctgagctcgcattttgcaaaatcattgattttatctatgattattcatcaaatgcttgactttttcagaaattttatttttattttttctgatgaattaggagttaaaaaaatgcgttgaaaatgaatccgagctctgatcatgcgaaatcaatgtttttgtctatgatttttcatcaaatatcattaaaaaaataagccgcacccaacggggttcgaacccgggaccacgcgtctcctatgaatcacaaaggattaataactaaatttccaaaaaaaaacgtaaaaaacctaaaagcttgactt

SEQ ID NO: 43938 - DNA, 1180 bp, Heterodera glycines
atgtgataagtagggatttcgtagacaatcgcatagtattttgcgtaatagttaagattgtaagccgcctattaagaaactattgttgttgtgccaaaaggtttatgggtcgctggcaatgaatcatgtatccatttcgaatcctcggacccaaattctatcaatttttgttcgaatttgggtccgggtttgtaatttgtcgaaatggatgtcggattcgtgataagcgacccaaaaccccttgaaatcatgctttcatgacttttaaaataaaaacaaaaaaaatttctttgaaaatacacccttcagaattgaaaataaaattctcaaaaattttattgcctattcgaaaatttttgtgtctatttaaacctattttgcgatttttgtgcctaaagaaagggaatttgaaagtgggtcttggcgcccagtcggcggcgcccagttggcatcgcccagtcggcgtcgcccagttggcgtcgcccagtcggcggcgcccagtcgacccggtccggggcgggatgccaacgtattcagagcgaattgatggaataaaggcccaaggagcaagtgcacaggaatattccactttaatattcagctcaaacttgggtaattaaacccccccaaggggaaaaaagggggaacaattgggggaaaaaggggaacggcacaaattggaaaaaattgggggaaatttggacggtacaaatatgggaaaaaattgggatcgcaaatgtgggggaaacttcggagggaaccggaacgggtggcacaatcacaacaaaatcaagtattggaaaaaagcttgggccggcacgtcacgggcaacgcgattcgggcggcacagcgaaatggcacgtcagtggcagcacgatgggcaacacgggcaagcacgacggggcggcacaacgggaggggaaacggggagagaaaaaggggcagagcgaaggagataaaactcctcaaaggtacatagttgttgaactaatttgataggagtttttaccctccttttatacgtcccagggcacaaagtgcccgatcagtttctgttgtttgccaggttggcaattagaaatttgacctattttccctttttcaatttcttaacatttttccattttccttaacatttaattgactcttataatttctaatttaatgttttaccgttccg

SEQ ID NO: 43939 - DNA, 942 bp, Heterodera glycines
  misc_feature (894)..(894): n is a, c, g, or t
tttactaacttaaatgtacctcattttccattttcagtaacattggattgaatctacaagctcttaaagtaataaaaaatatgactgattgaaaaatttaaaaaataaaatatttatataagagaaaaaattactaaaaacaagctttattttaagaatataatttttctatgttattattcttaatggcaattttttgtttgagagttgcaagttttattattcttttttcatgattcaacctcagataaaatgttcattagggaggcgttatttttttaattaaataaacaataacaattaggtaaaattattctttgtatatagatcgccaactcaacaagaatatttttcgctaactatttttaaatgaaaaattcggcatataagaaaagtaatcgcttaaaaattttaagttttcaaaataattatttatagaaattataagttacgttcaatattcttagtattaaattaataaaatttttccttcattctttatctaattatttaatattaaaacgcttcaacattttaacaattcttaatttttactaaacataatcaaccaataagctattttatgtgtttattttaactaaagatagggctaaactacatattgttttcagaaaaaataatgttttaatttttgaaggagtttttctttactttttaaaaattgaaattacaaaaaacaataaaaatttgaccaaaatagcgcaatttgtccactttttgaacaaatcttttaataaatcacaacaaattttcaataactttgtgctgcgaaacatttgaatcgagcttcttaatccaaaatatgtgcataatatctggtaaaaatttgaaaatccaagtgtatttatgaataaaaattccaaaagtgcctcnatttttgatttgtgattttaggtttttataaggttgctttaaatcgag

SEQ ID NO: 43940 - DNA, 1022 bp, Heterodera glycines
  misc_feature (50)..(50): n is a, c, g, or t
  misc_feature (106)..(106): n is a, c, g, or t
attttccaaaattttccccaaacaaacgcgcagagaaacaaattccagancaattagtatcggcgtaattattctgagaatgcagttggatttcctattactgtgnagcagaaaaagagatagccaatttccaaaatttttcacaaacaaacgcgcagagaaacaaattccagaacaattagtatcggcgtaattattctgagaatgcggttggaattcctattactgttgagcagaaaatgagatagccaattttccaaaattttcccaaacaaacgcgcagagaaacaaattccagaacaattagtatcggtgtaattattctgagaatgcggttggaattcctatcactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactggtgagcagaaaatgagatagccaattttccaaaattttcccaaacaaacgcgcagagaaacaaattccagaacaattagtatcggtgtaattattctgagaatgcggttggaattcctattactgttgagcagaaaaagagatagccaattttcccaatttttcccaaa

SEQ ID NO: 43941 - DNA, 1312 bp, Heterodera glycines
agcaatttctgatcactgatcagtagtgatcaaacattgcgccgattgcccataaaaatgggggatccaggcctggatttttcctggatccaggtccaggccatttttcggcaacctggatttttcctggatttttgtccaggaaatcaaggtccaggtccaacatggaatccaggtccaggtccaggctttttttcaaaatgtcgatctctagtgttttccctttcctcgctgctcttcactctccattcattcgtcattttttaaaatttatactgcatttaaattaatcctcctctgactcatttattttctttccatttatttaattgtaaaatgcttaattgccccccccccctttaattgttttggtagggcccaacaattatttttccaatttgacatttttccataattgactgaattttatcaattgtcgtcacgcaaagtcatcggattcaatctaagtgccagcagatcctcaaaatccataaagtgactacatatttagggaaaattttcgaaaaattggctcacaaaattgaatggaaccttttttgcatttcaatttacgacgaggatgacatcggggatgggccagtaatgaatgaatgcttatccgaaaattcttaattttattgcgtttctgtttttaggcttctcgacgccgcaactccaggcccaagtgatcagcagaactgattgaattggtgggaagtgatcgatccatctgaatcattgaattgaaaaaataatttgaggcgattttgacgtgatcataaaaatgtcttcttgttgcaatgatcaacttggagccatatttaaaaaactaacaaatttaaatgcctaaaaaaattttaaatttgtttaattattaaaatttaaatttcttagaaattgcaaaatttcaatttatggaaattaaaaaaaattccaattttgtgaactctttccatttgcttaatcctttccaaatttgtctcttttcctctgatcaattaagcctccctcatccaaaaaaattatttgctcgaatttccgtgttccgaaaaagtgctgctgcgcgacttagcgaacccccccccccccccaaaaatatccacttaatcctggcactaatggattccatttgggtgcttgctgcaaatggacatgccgccaagcacttccagtgctcacaattttcaagcatatagagtttggcacagtttttttctcggatttgggggcaccacatcatttggcccacaaatcccgtggccacacaaaattccatattcaccccccgtcgcgcacactaaacgatgtgccc

SEQ ID NO: 43942 - DNA, 1142 bp, Heterodera glycines
  misc_feature (45)..(46): n is a, c, g, or t
gcgacggagggcacggcgcatgcgaccattgcccaccgccgaganncggcacccaggctattagagaaagaaagagatggaagagaatggcaagggaagaaaaagcgaagaaagtgcaaaaacagaaaatggcaaatacaaagcgaatgaacagaatggcacagaaatgcacattcaaaccaacccttcttaagtaagaagcatacccaattcttctcaatttggcccattgtccactctgacatttcatttcccaatttccacgcctttttcccaattttcccactttcgctgtgtcccagtcgaactcgcgacattcagtgcttttgccaaagcagaagcacggctggcacccctcggggttctctctgtccaaataaattgtgccggatttgcatcggtcgcatcgctcgccctccacgttgcgcttgcacacgcattggtcctcctcgcacgtgtcgaagttgagtgagccggcgctgtcgcaagggcacggctcgcaaatcggatgattacgaaagccaagcgcgcaatgctcgcagcggcggccgccaaagccgagcttacagcgacagtcgccgggtcgctgaaaagggagggaaagtacgaaaagcattcgcaagcatcggcagagccaatctttgctcaccatctgctcagtcacttctgtctcatctcttatgcattggttgctttcagctcccaccaaatcgcagtcgcacggacggcacgcgtcggtacggtagtgggacacgttggtgggacggtagaagccggggaggcatttttcacagttgactcccactgtgttgtgctaatggcggggaacgggggggggggggggttaatggtgcgcgtgctgttgactcggcttcacttggcattccacgcatcggccacccccctcgtaaatgccctcgggcggggggggaataaaatataaaataattatacctgtttcttcacctatataattgtataaaattttgttttgtgtgatttaatattaagttatggtttatattatttctccttcttttgtgaaataattgcctttttatgcaattatttgctcaggatttattaaaatataatatgcatagatttgaattattttccatattttgtttttatttttttat

SEQ ID NO: 43943 - DNA, 1577 bp, Heterodera glycines
tgaaaaggagaatctttttctaagtgaatgctaagcaatttgacatctcagaaaaaagttgtgggaattccaaatttttattacgttataactcaagtcctaggcagctctttctaaccaaaatgctaaatttcttcttttttctattgattctaaatgttcaaagtgattttgtacccttataaccaaaattattagaattttcgaatttggtgttttttgtgtgttagagatgtgaaaatagtacgccaaaaggagaggaaaagaaatgcaaaaattttaatcactccataactttttagttaaccctttttttgctcttaaaaacccttacattttgttccaaatttttttctctatcgatatgcaaaatttggtgcaacttgtatgcatagaaaaaaagttatatggagagaagtaaatgttgttttttacattattaagaatgaagagatagtacataaaattgagataagtaaagataaaaattaattgtgacagaacgccaatttttttctgtaattatccataaaaagatttattgtcgcttttttttcttttttaccgtccatgggagggcaaactgacaataccgtagtctcttctcgttggatgataagagaaaacacagacagagaaaaaaagggcctacacataaacaaatgaaaatgcaaaaaaaaatttatatgtcattttctctaacaccacaaaaccaacaaacacggactgggcgaaggtcggcaaaaaatttgcgacattgcaccgcgggcggaagcgcgacggatgccaccaaatcaaacgggggcaaaacgtcgttgtcactgttggaggtggagaaaaagtcggcagtggcatccaaatggggcggtggcaatgtcgcggaatacgactgcggcaactcgttctaaatttgttttgctcagttaacaaacaaaggcaaaatttgcattttgcagtgatttctgcgaaatcccaacaattttccgtgcccatttccctcaaatttctgccgacctccgtcactgccgctgcttttgcgttgggttccgtgccgagcacatgcgactgaccgacgatagcgaacagtcgcaagtcgcaattatttccgtctttttcggccaatgtaaaacaaataggttgtggtttataaattttaatatacatatactgtatataattaaatttctaattaataaagtacattcatgggtaattatacagtttgacccacataaaattttttgcttttaatgataaaaagtgtttccaggggttttcggggccgctgatcatgaatatgaactctatttgacgaatttccggacccctaacccggaattcaaacattcttgaaaaaaaaaaatttcagaccaagcattaatgccaattttatttgtttttttgatgaattacgtggcatcagtgcttggtctgaatcaatatattatgagcatcacaccggagaatcatggagcacatattttggtacatttaaaaccatttttggaaaaaaaaatttcaaaaaactttcgtatttcaggttagggtttcggaaattcgtcaaatagagtttatat

SEQ ID NO: 43944 - DNA, 1000 bp, Heterodera glycines
tctccggaacggattagcatcggggttactagatagaaaattgtcctaaaaagagatagccatttctctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctaagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttaggggaatggaaaaaa

SEQ ID NO: 43945 - DNA, 1242 bp, Heterodera glycines
cgctttttgtaaggctaatagaccattttgagagctttcgaatgataccaagattattggatttgtattacaaataaaaaagcttaagtggaaaaacgagctggcgccgaaacgccagcgccgaaacgccagcgccgaaacgccagcgccgaaacgcgtgggtcccaaaaattttatatcaaaaattaattatttgaattaattggaatcaccggcgttttgagcctttttgtctgctcccaaacttggcaaattaatggtcatattttatggtatttatgttttcataatttttaattttgtatatttactagcatttaaaaattaatgtgaaatttgtccggtaaattgcaaaagtacatcaacccaatttttgatgttttccggatggaaagatatcgatttgggtgaaaaaatactagaaacaatgataatggcggacggttatcgcatttctgagtctaaatgcttacagtgtatgtaataattgtgcgaataagcgaacaatctacctaatccttcacacattctctgccataaaaccaaatatttcattggcatatccaaattttggtgcatattttatgaaagtggtcctaccatcggcaattaccatttcttttttttcgcagaaaccaaaacactgcactattgctaaaataaatccccgataggtgcctaattgtaattgtgtctcatttctttcctcttgaatttgtggaaattggaatttgttttgaaatgattgacgaggaaaagccattttagaaaatggaaagtgattcgaatccgcaacaacagtctgtgcctgtgcagcaattgccgtccgacgcttcgccccaaccgcagcaaaacggcggcggagattcggcggacaaaattgggccggaccaaatgcgtttgttgagcgcacagatcgccgcatacaaaatgttggcccgtaatgagccggtccctcgtgcactgctcagagaggttcgtacaagtccaaatcattcatcgtcggattggaacagtgccaattttgcgggtgtcgaaaccgcaatttctccgattttgaaatccatttgtttttaatgggtttgtttaattaaccacgtaaagttcggcacttaactttccggattgaattacatctgggtcttggttttgccggtgatttctctcgaattccgaatttggctctaatttgccggtctacgattcggagtaaagaaagtcgtatggttggagatccaaaaa

SEQ ID NO: 43946 - DNA, 978 bp, Heterodera glycines
  misc_feature (959)..(959): n is a, c, g, or t
tggcctcagtttctccagcgattggcagctgtcgaccctaataaacatgcagctcgtctgtgtgttaaagaaatttgccgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctctgtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggngcctgagaaatggccacta

SEQ ID NO: 43947 - DNA, 918 bp, Heterodera glycines
acaaactcaatgtgacgtcggcggcctttaaaaggcggcgattgttgcggagaaaggcaatgacattgctctcgaattccctgtgatttgaaattgcccattgctgatacgataatccaggatttaaccaatatttaaataattaaaattaaattaaattaatcacataataattgtatttaaattttcccattagggttgccgtctgaatcccgatgttcttcccgtcccgaatccctcggccggcaattttctcgaccgagcccggaaaccctgaccctcattagtcgacaaaaaattctgagttcgctaagaacagggcaattcgtgtcccaattttccggcttcaacttactctatgcaaatcgttctaaagccgcggataaagtgcggcattgtcacctcgggcaattccagtttttcgatgatgtttttgggtaggaatttgtaaatcaccgctttctgattgacgggttcgccgagtggcttgagaactgtcaaacatctgagaggaaaggaactgagaagattgtcgaaaagggtcaaagacggacgaagaacggttcatgccaggaatggcacggaattccgatttccgacatttttgggtctcggaatgccatccctggttcatgccaggaatggcaaggaattccgatttccgacatttttgggcctcggaatgccatccctggttcatgccagggatggcactgaatttcgatttccgacatttttgggcctcgtaatgccatccctggttcatgccaggaatggcacggaattccgatttccgacatttttgggtctcggaatgccatccctggttcatgccagggatggcacggaattccgatttccgacatttttgggtctcggaatgccatccctggttcatgccaggggtggcactgaatt

SEQ ID NO: 43948 - DNA, 917 bp, Heterodera glycines
cgtaaaaaatcgaactgaaaaccgttttttaatgggctatgaaaggtgggaaagcggaaataccgacaaatccggaaagaggcgttgattaaacagggaaaaggaataatcggaattgggtacttccattgtgatgaacgggggcatagccaatttcacccttaacttttgaatttttttagtcgcatttcccattttatccatcgcttattttcaaaaatttcgtttactttttaatctgttgagcttgaaaaagaaatatgtatttcttctcgcttaaaaagacttaaaacgttattattaacaaaaatgataattatatgaaaaaatttaaaaatattagaattgaggaaaagtaaaaatgcgagatcacttttcgctttttctaattgcacgccgggcacacctgcagcgactcgtgcagcagcaaatcgcagtcaatgcaaaattgggcggaacaattcggacaaacgtacgccttgcgcagcagcgactcgtcgcaggagaaacagcacttttcactgcaaaaagggaagaaacgctacaaaaagcagccaaaataacaaaaatttcagtgccagagaataattcttttgcgcggtgccaatttttttcgcaatttttcagtcaaaatttggcatttatgataggagccgctttgaatgtttagagattcgttggaggttttgagacattcattcgacccacccccacctcttttacacccccccccccaagcccgtagccaggaaaaaatttcggggggggggggggggaaagggaggggtccggtccgaagacctttttttttttttttcaaatttatccaataatttttttttttcctgctgggtaacaactggtctttttcactataaatgaccaaattttgaccgttttacggcaaaaaacttgta

SEQ ID NO: 43949 - DNA, 1369 bp, Heterodera glycines
  misc_feature (33)..(33): n is a, c, g, or t
  misc_feature (54)..(54): n is a, c, g, or t
  misc_feature (66)..(66): n is a, c, g, or t
  misc_feature (75)..(75): n is a, c, g, or t
  misc_feature (91)..(91): n is a, c, g, or t
  misc_feature (163)..(163): n is a, c, g, or t
  misc_feature (1354)..(1354): n is a, c, g, or t
taaataaatttccagtctcatctggaaaaattntgctacataatctaaattctncctcagaattgnggtgcatgnttatcatgagatactnaaattggttattggtcgcatcatgatatgcatccatgaaataattcagtctttttgggaacagttgtgaccncaatgttctcacttgtaattggccggaagggttgcgcattaaaaccagataatgtgcgttggctcttgccgttttaatgtcccgaccatagagactctgggttacaaaaattacgcttacgttccaattatgggagcccctggtaaagagtagatcgaggaaagtattctgcatattaagcattaaatcgtcaagtatcagtaagaggggtttttcctgttctttaatcttattcatgtccggaatcccgttaaaagtctcaacgccctccccgattaaccctaaaatactatcattcatctcaccataacaataaagaattttcttaggcgatggttcaattagattcttatgatgttttaaaaaccgtaatagccaacgggtcttaccactcccggtagcccccgagagaattagactgaacggaccgcgaaacatttttaatgcctcttatttatttgacctatttatattttcatagggaacatgtttcgcgcatttggggcatagccagaaattatcaaaaaatgatgtaccgaaatgcaaaagactgtgctttttacacctgctacaaatctcgtaatgacaggggcagtaatgacaacacttaattttatgtggacagttcattttttcaatttaattttatttttttggttgctatttatagaaggggtatataaaggagtgaaaggaccatttgattggtaccttgtatcaaaaaatgcaaaaaccgataatcgtaaatataattgctctcgctaatctcggtaccggtattaaactaaactctctgatgatcaccgaatgcgaatttaattataaccctagaaaattcaatgccgcggttatcaaatgtacaactcccatcaaagccaccgcattattatgggaatccgggaaaatgatatgtttggggacgaaaagcctgatagactgtgaaaatgcgataaaaattttcatagaaataattaagggctcggggtgtctgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggagtaaaagcatgacagcgttaattttctggaccggtaaagtcgtaattacgggaactanaaacaattctgaaat

SEQ ID NO: 43950 - DNA, 1208 bp, Heterodera glycines
tgcaggtcgcaaacaaatttcactatttacctattttttatattttttgcaatgtcaatatttttggatagaaagtatataaattatttttacaagtcaatattttgaataaattttatgtaatattttattttatcatggctgcatatggagagttcaccacaaataaacccgaagtatttccatttttattttaattctcacgaccaattttaaaaatttatttaaattatcttttaataaaatcaactatatttgactattcgtttattattttaatattttttaaaatcaccaatcaaattcagcagttaacatttgttcgtttatttttttagaaataaataatgttatagaaaattcttctatcgttttaaataatatatttaaatattttttttaatataatcaaatatatttgaattcatgtatttataattcaaaaaatctagagagaaaaaataacgaatattttaaaaaataatttatgacacaatttatttactgttatatggtactaaataaaatttcttagacaccaggaacgatttccatgtcataacggtcagcgcaacattttgccatgaatattggtaatttatagggataaactttaaaataaattttttcatttcgttttattatgtaattattcttatttactttcattaattttaatttttaaaaatattttcaattttgattatatattttctagcttttttaatatttaattaagagttttattaattattggatttttcaatttcattgcagaatttcaacgtaatttttatggttcaaattgtattcatttgactcggcatcacaaattatggctcattcaattatttttagtttcagtaaagaatatttttattttatttttctagcaagttattaaatctgtttctgtttttatttatttttaatttcggttgcatctgaaaatttcaaaaatgaaatttttcggaaccaaacttagtgacaattttaatattattagatggcaaaaaatctaaaaagcgagttttgttgctgtttaaattgagactgaaggaatatattcaaaatatgttttcgaaaaccaaacacaaaagaaaaaaataaattgagcatagttgtgaaaaaatttctattttttttaatttgcccatttataggtaggtgcgtttggtattttattacttttttgttaaaaaaatttc

SEQ ID NO: 43951 - DNA, 1092 bp, Heterodera glycines
  misc_feature (10)..(10): n is a, c, g, or t
  misc_feature (52)..(52): n is a, c, g, or t
  misc_feature (96)..(96): n is a, c, g, or t
  misc_feature (1016)..(1016): n is a, c, g, or t
gctcaaattnaaattaaacttaaaacgttatcaaatgtacaacaaatatatntgaattaaaaaaaatcatgaaaatatttaattaccaacccaaanatttccgtcttaaattaatgataaattattttttcaattttcggtccattcatttggtcactttgcgcttttgttgcgagaaattatacagagaaattatacaatttcaaaacttgtttcgtgaaaatttggtttttctttttcgttaaattctgttaggaggattgatttgaattagagttgagaggtactggtaccgtaccggtgacggccggtaattaccgctttgttggtaccgtacaggttttttcaaaaataaatgtaccggtatcgatttgtctagaaccggtaccgccggtaaaaatacactggtaagaatggtggactgggtgagaaaagagtaggaaattagtgaataagaaatttttgagaaaaattaaattatttatttcatttaattacgtattcatatccatgcatatgtatctgatttttattattttttgcttgggttcaattccccactgggatttttttttcatattttctttaccattaattgaaaattaattaataaaaaaatattccaacttttttttcattttaaacagcataaatcccaaaaattatataaataatacaaaaaaaagtgttaatagacaaaattaccgaaataatgataatgtaaaaaataacgaaaaattaactcttcatgaatgttcatatacatagagacttcggattcaagagtaattttatctcaatactgaagtgtttaattaaacaagttattttttaaattctaactgaaaaaatcacataaatcaaaaaaatcattttatttttaaaaaaatttcgaagctattcattaaatttatcatttgaaaaattatttaattaaaaaaaatagaaaataaaaatacccaaatccaacatagttttattctgaaaattaattttaaaaaatatttgaaagcaanataattcacaaaaaatatataatgaaacacattttaattgattttcattatatgtataattaaagtacagcagaag

SEQ ID NO: 43952 - DNA, 941 bp, Heterodera glycines
ccctaattagactgactaatgaatgccctccccctgcaatgagtaccgcgagttgatgtatgaagactcggccgcgcccataaagaaatactgcgaattgtgccaatcgttgcccacttacggcgtcactttcttcttggtaaaggagaaattgccaggcaaaaaccgactgataccgcgactgctcggcgtcaacaaagattcggtgatgcgagtggacgaacggaccaaagcggtgctgaaggaatggccgctagaacaggtcgcccccctttttaaattggtaattattggacatttcttttttaggtccgtcgatgggccgcctctttcaaaacgttcactctcgactttggcgactataaagacggatattattcggtgcaaacgctcgagggcgaacgcattggacaggtaaagaggggtaattaaacagaaacaaaggcactgttatttagctaattggcggatatatcgacatcattctgaagaaaaagcgcattgtggatagtggcggaattgagggagacgaaggggcgacgatggtggaggtgaaaaagagggggggggggggacgaatgacctaccaacaaacgggtgggggacaaatgatcaactaacgaagagtatggcgtttgacttttccgttatgggccgctcttcaaattttaaaaaagcaaaaggaaagcggcaaataacaaaaacaacatttgtgccaacaatgggtcaaaaataatctttggcatccattgctaatttatttatttttgtggtaaagaaataattttgtcatttttcgtggcccaaaaaaatactgacaaataatcaaacaaaaaaaaagcaagaggacaaatgaccaccaataaatgtgaagaatgaaaaaagacacacaaacccattcgctccctttgaaggacattgtcgcgccggccaaagcgact

SEQ ID NO: 43953 - DNA, 1424 bp, Heterodera glycines
  misc_feature (22)..(22): n is a, c, g, or t
attgattctggtgctctattcnccgatggaattgctgatgatgggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctagccatattttctataaattgtttagttttttccaattttttatttagacatttcgccgtgccaccacttctgtcagttacacaattcaactttatattattgtggaaccaatgccaattgaaccatttgaattggtgaacgaagtgacaaatgagaagctgacactgaaacatagcgaagaattagactataattgcctgtataattggctgttgaaacggtgcccaattggggagacggcgccagttaagtggaaaaaccgcgaaaattcgggtgctaatttgaactatatcagatttgagctgcgatatgccaattattcgggtgccaatttgaacaatatccgatttgaggtgtggggtggaaatagttgcattgggtgagcagcaaaagcaatttttgattgttgaaaaaataaaaataattttaggccattgtcgctgccagcggaagaagaagaagcggatgaaagcaatgaaaattaattatatctgagaaatgatcgatctcaatttgttgtgcttattttctctcagaaatgcttttttaattgtttcgttccaattatataaaaatatgcttttttgttgagcaatttattaataattagggtttgtaattatatggatataaaaacgcgaaatatggccataaaatatggaccaaaaatcgcaaaatatggacagaaaatggcaagaatatggacataaattttccgaatttatgggtaaattttcaaaaaaaaattttttcaaatttattaaattctagtaaaatacatctaaaatggctaaatacggtataagaactcgtttttagaagaaaacaagcaatttctagagaaaaactaccaaaaaagcgaaattttagcttttttggttatttggttattttttacataaatttattaatttttaagaaaatttaaatttattcaatattctcgagaaaattttggaaaaattgtttttttttgcaaaacttttcaatttttggggtcaaaaaggccaatttatctgttggggccgtcctaatagaggtttttttgaaaaatgccaaaatatggataaaaatgccaaaatatggaaatatggacataaatcgcgaaatatggaaaatatggatatagaactccttcctagaggcttcaaaccaagctaaaaacatgtttttcatgcgtttcaggcctccaacagtccaagaaaaaaatatggatttccatataattacaaacccta

SEQ ID NO: 43954 - DNA, 1248 bp, Heterodera glycines
aaaaaaaacccaaacctttaaaaaattttttaaaaaaataaaatagagaagttttcaaaattaataaaaattttaaaataagagtcaccggcgttagcaccatagcggttctttccctgtcattttggtgaccttgccaaatctggtgcgctttggatcagtttaaataaaaaaagataaacttaaactttttgacatatttaagaagagccaggttcgatgaagttttggtaagccaaaaaaaaatccaaacatttaaaaatctataaaaaatttaaaaatgagaattcattcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaaaataaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgattagaaagagaatagaaagaaccaggttcgatgaagttttggtaagccaaaaaaaatccaaacatttaaaaatctataaaaaaattaaaaatgagaattcatgcgcgcttttctggaaataaacttaatagggcataggtgcagctgtaaaaaaaagagcgggcgattcgaaagtatgaatagcaagatcctggttcgatgaagttgtggtaagccaacaaaaatccaaatatttaacaaataccataacaaaatataacaatgagaattcctgcgagactctccggaaataaggattattggccttagttaagtccgtaaaaaaacctctggggcagacttgaaagagaatagaaagaaccaggtttgacgacgttttggtaatccaacaaaaatgc

SEQ ID NO: 43955 - DNA, 981 bp, Heterodera glycines
ttcgaactgctcacgggtgccacgcatgcccattcgccaagccctcgggttccaactgctcacgggtgccacgcatgcccattccaactgctcacgggtgccacgcatgcccattcgccaagcctcgggttccaactgttcacgggtgccacgcatgcccattccaactgctcacgggtgccacgcatgcccataagccaagccctcgggttccaactgctcacgggtgccacgcatgcccattccaactgctcacgggtgccacgcatgcccattcgccaagccctcgggttccaactgttcacgggtgcacgcatgcccattccaactgctcacgggtgccacgcatgcccattccaactgagcacgggtgccacgcatgcccattccaactgctcacgggtgccacgcatgcccataaaccaagccctcgggttccaactgctcacaggtgccacgcatgcccattccaactgctcacgggtgccacgcatgcccattcgccaagccctcgggttccaactgttcacgggtgccacgcatgcccattcgccaagccctcgggttccaactgttcacgggtgccacgcatgcccattcgccaagcctcgggttccaactgagcacgggtgccacgcatgcccattccaactgagcacgggtgccacgcatgcccattccaactgctcacgggtgccacgcatgcccataaaccaagccctcgggttccaactggtcacgggtgccacgcatgccatttcccaagcctccggttccaactggtcacgggtgccacccatgccattctccaaaccctcgcggtccaactgttcacgggtgcacccatggccatttcaactggtcacgggtggcacccatggccattccaactgaggacggggggcacgcatgcctattcgtccagacctcgggatccaactgagcacgggggttacccatgcccattccaactgagaacgg

SEQ ID NO: 43956 - DNA, 1077 bp, Heterodera glycines
ttcattaagttgcgacaaatggacggtctttaaaggccatttattgttaaaaccgttggcaattgacggcacaaagggacaaaataagggcgccattttcacacaattgcgagcaatttcgttgttgctgaaaatgaatatattttgtgaatgtgcaaattttgttaaaagtttaatttgatatattagaaagcaattgtgaattaccgaggaacatttgcatcgaattccatgaaacctttgcaagaattttggaatttagtgaacaaattctgaacaattcgacaattctaaaaaataataattattttttgataattttaaaaatgcattctaccgaaaggagaaagtcccgaccatcgcttctttcttccatggaatgatgagctttccttctccgtttacgagtatttgtcgtcttttctgcatcacttgataacttttttaattgcgaatccatgtaaaacggtgtccaaatttgatagaattcattacgcggtttttgctggctaaattttatcaataatgttatttctgatatgcaaattgcaaattacagtaaagacatacttttgcgtttccgatgattgactctgactttgataaacaaattgatttaataattccaattcatcgattaatgcaaattccttttcaacgaataacatttttatctgcaagtttcgttcatttcatacaaaaactttgttcataattaggtaataattaacagttcagttaaaatttaactctaatgactgatcggttgaaagaattatcagaaactcgcctgcatttaaaagcaactaagacaaggcattaataatttagaaattttaaaacatattgtttacttttttaaattttaattcgatttagggttacacgcgaagatggctcagtgatcgaagaagagaaaactgaaaatggcgagtttgttgtaatttttgagcgagccaatggaaatggaaatccgagtggatttaaacaatccaagcgaatgcaaaagggtcgtggctatgtcattgacctctcgcccgacttgcaagtggccaatgttagcaaaagccatttatt

SEQ ID NO: 43957 - DNA, 843 bp, Heterodera glycines
ccgtacgaggccgcaaagcggccgagtgagtacctttggcgcaaaaatttggtgagtggggccgaaggcccccgtacggttgagtcccagtgattgaaatgctggtgggttgagtcccagtgattgaaatgttggtgggttgagtcccagtgattggaatgctggtgggttgagtcccagtgattgaaatgcaggagaattgagtcccagttattggaatgctggtgggttgagtcccagtgattgaaatgctggtgggttcagtcctggtgattggaatgcagtcccagtgattggaatgttggtggattgagtcccagtgattgaaatgctggtagttcagtcctggtcattcgaatgctggtgggttgagtgccagtgattgaaatgcaggagaattgtcccagtgattggaatgctgttgggtttctgttgggttgagtcccagtgattggaatgctggtgggttgagtaccagtgattgaaatgttggtggattgagttccagtgattgaaatgctggtgggttgagtcccagtgattgaaatgctggtgggttgagtaccagtgattgaaatgctggtgggttgagtaccagtgattgaaatgctggtgggttgagtaccagtgattgaaatgctggtgggttgagttccagtgattgaaatgctggtgggttgagtcccagtgattgaaatgctggtgggttgagtcccagtgattgaaatgctggtgggttgagtcccagtgattgaaatgctggtggttgagtaccagtgattgaaatgttggtggattgagttccagtgattgaaatgctggtgggttgagtcccagtgattg

SEQ ID NO: 43958 - DNA, 1453 bp, Heterodera glycines
  misc_feature (1422)..(1422): n is a, c, g, or t
aaaagattttgaaatcgatttttaatgaagattcactgtttttagggtcggttctcagcaaatttacccttcaaaatgccaacagaatttgccacgctggcaattttgccacaaatgcccttctgcgcttcgcccaattcgtccaccgttttcgtcaatttgtcaatgcgttgctgctgcgtgcgctgctcagtgttttctcggactttgtcctttacaaaaaataataattttgttttgtcaaatattatttttgattttcatgaaaaacatttcatttccggggagaaaaatttaaaaaattccgctaaattttctaatttttcccatttcccacctctctgaggtcggccattgactgcgaacattgctgcaccatgtgctgcaggtagtgagggtactcttccgcgtccctttgctggcgaatcaacacgttgtttacctgcaaattaaaatgcaaataaatttctgtaaaaacacattaaaaatggaattttttcgaaaattaaaaattcagttttctttaagcaaaaaataaaaaattctatcattttatagtgccaacattttaaccttttcgaattcgtatttcgaggtgtttctgtacagttcgagtctctgctcgagctgccaaattcggtccgattgctccccgtttttctctctcaattcggccacttccttttgcttttgtcgtttcatttccgccaatttcgtctccaatttgtccaactgttcaccgcgctgacgaaaatgctaaggaaagaaaaaaaagatgtaacaaaacaactgaagaagcatcagaatttcaaaaaagaaaaaaaattccaaaattcaaaaaaactgtttttgtttttgggttagaaatttccgagttttgtattttttctccccacctccccaattctctcttccaactgcgctttgtccattctctgttgctccgattccgtcgtgtgcttttccaccaatgccttcatttcgtttcgaagctaaattttcacgaaaaaatctgacgcgggaggggaacgtaatgctaatttttccgaaaaagcccaaagaataataataaatttggaaaattggcatatttgtgagtgggtgcacatcctaatttcgtcgccgaaattttctcaaaatttgtcctgtttcgctatttgtttttttggttggaaaattgccaagtttttgtgtatattttcctccccacctccccaattctctcttccaactgcgctttgtccattctctgttgctccgattccgtcgtctgcttttcctccgatgccttcacttcgttacgaagctgaccaatgacggaaactgagggggaaaaggcaaattgacaattggaatttttctcagagaaaattttttaacgactttttttgaaaatattttaaaattatttttaatattttntgtagattgaggagagaggaggaatgagcat

SEQ ID NO: 43959 - DNA, 1561 bp, Heterodera glycines
actagagatcgcattttgaaaaaagcctggacctggattccatgtggacctggaccttgatttcctggacaaaaatcgaggaaaatccaggtccaggaaaaatccaggctcctcgagacctggatccagggcctggacctggatttttttgaaatttattttaaaaatcaaaaaaatgtttgaaaaaattaattatttgcttagaagcataaaatccaggcctggatccaggtctaggtcgatctctaatattcactaatgtttcaaaacagtcaagaatcttgaaacaaattcatttttttgcctatttttcaaattttgcattaattgcaatggaaaaaacagaaagaagcaaaattgttttgttttctgtgttctctttggcaaaaatgatttagccaaaaactcacaaaatcaacgccatttccaagtcgttaagaaattcgtaatttgaaaatctttaaatgcttccaaatttagcattttggcaattacaaattttttgtgttttgttgaaaaatttattatatttagtgcaaatttataaggaatttttttaaaaataatattggttgattgatttttattataatctttaaacatttaggcatcgtctcggcaactgtttgagcttggccatatccctccctcattattgggaatctgcttgttgtgccgggaaaatgcacaaatggcaaattttgtaaaaaaaactattacttaggtaatttagcgtattttattttttagcaatgcccaacattgaatgtctcttgtcacaacatgtttggccgttgcagaagcgaaatggcaaaaacaaattcatgggatgacataagggttcgtaaagtatcaaatcttatttttcaaattttactaatagactaattgtaagatggaaatattttttaatgatggctattttcctgtaaaaaatttgaatttatgagcaataagtcaaaaatttccgattcattttcgaattcttttgtgaaagatcaattgaaattataaatgcataaataattttgtgtcgcattttccattttggaattttatgcaaaaaataaaaatctaattaaatttggaaaaaaatatacgtgcagttcataggtttgaactttcaaccgatagagacactgggaaaggcgcttaaccgactgcgccatttgcacgcacatactatcgctttcatttttcacttttagctttattttttcatgggatggcataagggttcgtaaagtatcaaatcttatttttcaagaaaggtcagaataaaaccagataataaatatataaaagcaaaattttttttcaggaattaatattcgccctctcttttttcaagtgccatgccatgcaaaacagtcaatgcggatgtaaactaagcatattgatatattttattttattaaaattcatattgaatcttttttgtcatactcattgtcttaatagcttaattaattaattaataagttaataatgtttaatttggttgttgttttggttgtaatggatggctcttttctcatctcttttttaatatcgctttttt

SEQ ID NO: 43960 - DNA, 996 bp, Heterodera glycines
  misc_feature (40)..(40): n is a, c, g, or t
  misc_feature (56)..(56): n is a, c, g, or t
  misc_feature (59)..(59): n is a, c, g, or t
  misc_feature (965)..(965): n is a, c, g, or t
ttagagcaacgaaaattggttgaatcgtgaagtttctacntcacttctcaaaatgnttngataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatcgcggttaattagagcaccgaaaactggtttgaatcgtgaagtttatcatttctaactcacttctcaaaattgttgataaattgcaaatatatttttccaaaagtctgttgacactttctgaaaataaattctatactcaggtattttccacttattagattttgcaggcttattgctgcatgttctttgacacttcttcaaaataacctatgccctttattcgttcaaaacaccatctttgttgtttcgctttagattgacaagcccgatgatgaatagctcgagcgcaaaacgcgtgcatgtttggaaagtatcgttcataccaataattgagggtttatttttaaatgaaattttatgataaaccttattatctcagaagttatttaattgattcgaatgtttttatcgcggttaattagagcaacgaaaattggtttgaatcgtggagattatcatttctaactcagttagcaaaattttggataaattgtcacgtacatttattcaaagagtcagaaaggactatctgaaaataaatcatatacacagttgccctagtaagataggntccgccccttatcgtgcaaaacagctaattt

SEQ ID NO: 43961 - DNA, 937 bp, Heterodera glycines
aaacggaggaaatcgtaaaattttgtagagtctatttttttttttggaaatttcgtctccaattgactaaaatttagcatttcaaaaaaccaagggagaaatttttggaaaattttgaagaagaaatggtaaaaaatttgaaaatttattgaaaattatttttgtttttgaaggtaaataattggaaaatttacggaaaattaaaattatggcaattttttgccgcatttgagcaaatttattaacaaaatcccagcaaatttaaattaatttcccgcaaactttcaaaattgatgataatgatagaataagattttatttttaaattagaaaatttaatggacacaaatttgagtccaaatgtaattcttgacataattttttcaccattttctcccctgacccttcgcttccggcgataaacttgcggcacccacagaatctcgactctcgagcaccgaaaaaaacatttattatttatgcaaattaattattgccattttactttatttgccatccaaaattgttgtgtgggaaaacggaatctgaacaatcattacatattcattcatttttgttggctttcgcctcctctaaaaaatgggaatattttattagcgttgggcctttgattcctaaaattatttttccattttaggaataattatcgaacaaatcttagcgagatttccaagccttttttatgggtcaatctcaacgaattgcaaaattctttcaattttatttttgaatgaaaaattttgggtttcaagggatttgtttaatgccatcggtttttaaaaatattgcctgagtctcttgtactgattaagcctttaaattttttatgttttaactgatttcggtaaattttttaaaattaatttttcagttttcaaaaaacacaaattaaatttctagtcacaacttgcttaaa

SEQ ID NO: 43962 - DNA, 1423 bp, Heterodera glycines
aaaaacaaatttattttaaatatctatcctttattataaaaagattggtattagttaatttcaataaaaaatattaataataattaaagggtttttaatttttatttcatttgaaaggaaaacataatgtcaccaattgcacttaaaatgtgaattacaaaaaggattaataatattccatcagtgagttaattgattcaccaattttgtattttatgagaaagaattggcactgtgacaaaataccagatgaatttgaagaatatgaacggacagaatgccaaaaatatcgcaaatatttggacattttgtacgaatatttgtacagagaatacgtcggaattccaacagtgaagccaaaatttgtgtttaaaaaggaaattgaaattgaagggccaataatttatgcgtagatttggataatcctacttatggtcaatccaattttttaaatattttatttaatataataatcaaattacgcagccctctgattaaaccaattaaatttaaaaaatcgactcctattttaaattatcatttgatgccaaagatttttaattttaaattaagggcatttcagatttaaatcttaatatctccaattaaggataattcttgggaaaataagaccttatctattattcgttttgctaagaaaattcatttcaataatattgttttgattttgagttgttttatatgtgctgtgttatagataatataacagattggctcgaaccaggtcatattttaaaaatttgaccacaaaacaaatcatttaaatgctacgactgctaattgcaaattaaaaataggaaaatgtcggattttattcctattaaaaaaatatttattaagacatgaaggaaaaatttgaaaacaaaattaatgaactgaaaaagaatcaaagtattttcatcacctttttgtaccttttcgttgatccaattttgtttaattgaaaaattgaattcctcctcatttaatccaacaatcttgataccaatcgaaggcctaaagttggcggcgacgaaatggtcgcgccgaaatggcccgagcccttgtaaagggcttttaaatagagtgcgccgggaccgggaccgggacgggaattcccggtcctcagaggtcccggtcccggattttgaaaagctcaggtcccggtcccggtagggcaaccgggaaccgggaaaaacaagcactggtaagaatgggggtctgagtgaaaaattaggaacgaaacttggagttaaaggaaacaatttaaaaaaaaaattaatatattctttaaaagtgtcatcgacaattgtgcaaatggcctagtggctagtatccttgactttcccttcttctttcccttggttcaatctctttgcaaaaagtaaattgttttaaattttctttttgtacactccattgg

SEQ ID NO: 43963 - DNA, 1232 bp, Heterodera glycines
  misc_feature (11)..(11): n is a, c, g, or t
caacaaaattntgctttaagaaccttcagattcagtcagtcttaacttttgtgtacgctaaagcatttttatctttcttcagctacattgaccattccgtgatcaaatttttccgctccaagaagcgattctttgacaaaagtggcaccaaattggaagtgtttgtgcattcaattgatacgtatgtccaaccgatttgggatgtttttacccgcgaaatttggcctatttttgcgaaaagcattcgtcatttgggtcttcataatgccaatgctttggacaatttgcgcagtcgcatttcaccgacacttctcactgatcttgatcaattttcaatcgattccggttatctgtgccccgatggaattgctgacgatgggccaaatggaaatgctggtcaagcgttgaccaaatggcttcacactccgacaaaaaatggacaaccaaagcaattacgtttccgtgcttatgtgagtccaccaaatttcgaatgggtcaacaacttcaaagaggtcgtctcgccagaattttcgtcaaattgtttttattttaccaattttgtttagacatttcgccgtgccaccacttctgtcagttacaaaattcaactttatttttgggtggaaccaatgccaattgaaccatttgaattgatgaacgaagtgacgaaagaaaagctgacactgaaacaggagatcgacgaattcgacttaaatgtgtataatttgggaaaaccgcgaaaatccgagtgccaatttgaacaatgtcagatttgatctgtggagtttcgataaatccattgggtgagcagcaacagcatttgaattttatcgaaaaataaaatatttaattaattttaggccattggcgccaccagcggaagaaaaagaaggagaagaagaagcggatcaaagcaacaaaaatgtcgtctgattaagtgtacgaaaatgaataattaattgtatttgagaaatgatcgatctcaatttgttgtgcttaatctctcagaaaaatcgattcagaaggcaagataaagtatttcgtgcatttgaaccggttttgctgcatatttagaatttttcgaaaattgaattttcgaatttttgttcgagtccgggtcaggggttcgaaatgggccgaaatagatataagagtcgaattcttcgacccagaaaacccataaaacatcagaagtcgaaaaaattttttgaaaattttctttatatcattga

SEQ ID NO: 43964 - DNA, 1380 bp, Heterodera glycines
atcaaaagaatataaaattaaaatatgaataaaattgtatatatttttatcatttgagcaaatatattacagtcgagatttctctagttgtttgtcaagaaaattaatcgatgaatgttatgcatatattttattatgtgagaaaaatttgcttaataatattttaaaaaaattaattataaaattttgcggttttcgcgcaacgcccttttttgcggttttcgcaaaatagctatttttgcgggtttcgcgcaacgacgcggcaccgaaagcgcaataaaatcagaaataaattaaatatgcaataaaataaaaccattaaaaaaaaatttatgtccttatttggtgtttttagataaactctaataatgagaaaagttattaccaacttcgccgaactgaatggttctcatcgatagacacttttaaattcttatttatttattccatttaaccggatatttaagaagataatttatgtaaaatttcgaaagataatatttttgaaaaatcaaaataactattaatttttgcaagtttaagggcctaatgcccaaataatcaaatttacaaaagagaatatgacgtcatgaaaaaattcctcttttaaaactcaaattaaattcaattactccaattaaatgtaataatatttaaccaacaggcacaaaccatagaaatctgatcattttttgcatagaatccggtcattttttgataaaacttctgcatccaaatgttcgttctcattcaatttgctccgctccgtctctgtcttcagttcactcaccagttactatggcagcatttactatggcagcatttagtataaaaaacataaaaaatttgtaaagttgattattttgaagaaccatgggggtaatgaaccttttaagcgcccaaaaataaaatcaaagggagacggtaattaaatcagataaaaacgtaaaaatattcaactaaaatgtcaaaataatacagcgaccaattattaattctggcaaaaatccactttatattcccttagaaaatgatttaatttggaaatttattccattttaggaaaatgggtaacgaaatggccatttttgtggcaatataattgtcccttgaaggcattttcggaaattcaaagcaaggacgatcaattgccgtgcccaaacaagggacgatcaattgcagtgtgccaaataagctaaaatgaataaaaaataaattaacgattaatgcggactgagggaatttgtaacttaaatctggaaaataattcatatttgatttgaattcgatcaatgaaaaatgcaaaaaaagacggcaaatggaaaaggaaaaattagaaagacattttcaaacgaaaatggaaatttcagacgaagaaaa

SEQ ID NO: 43965 - DNA, 1381 bp, Heterodera glycines
  misc_feature (22)..(22): n is a, c, g, or t
  misc_feature (63)..(63): n is a, c, g, or t
  misc_feature (84)..(84): n is a, c, g, or t
gatcagcggcagaattgaaaangttcaattcgaaatgtgaaaagcggaggttgaaatcgcctntaaataggctggctcaaatgnaagagaggagatccaaaaaactcgagaacacgctcttcaaaattaccaattctcgagttaattcttcacatgacaaatggacaattgtgccaagggaatgaaggcaaaggagggcaaaggagggcaaaggctaagcaaacacaaaaaaaaaagcatttaaaaaaaatagcactcgagaattagttgttcaatgcgagatcaagtggacaaagaaagcacaactgttgaatgtttgtgaacatttttataaaattcaaaaaatgatgtcattaagttgcaattcatcactaccagggatggcacggaattccgatttccgacatttttgataaaaggtcggaaattttcggaatttttttgattttttttcaaaaattagcaatttttaaaaagtttgaaaaaagcgcgccgaaaaaatgtgtaaataatcaatccctttcccaaaaatgttttaaaataatgtaaaatgacataaaaaagattttgatgaaaatcaatgaaataatttttcatgctattaagaattttattagcctattaaaatatttataaaattttagtatattttaaaattttcgacttccgatttccgacttccgaaaaagttttggggcctcggaatgccatcccttatcagtgatcactaccattttgaggaaaattaaaaaagtgtcatcattttttcattagaatttattagagttgagcggtaatcggtaattgcaaaaaaaccggtaccggcaccggtaccaactttttcaaccggtaccggtaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattcaggttgaccaagtttttttttcaaattcaggacatagaacactaaaattcagatgtagacctcaaaattcagattattgcaaaacaaggggtcagcagccaattttccaattttgcgaaggggtctccggccatgtaaattaatgtaaatcaatgacctttttttgctttcaacaccgctttttacgcggcacgttttttccaagacttttgggggacaaggagggccggcggtgccgatcaggggtgggcgaagctcggcttagtactcgaagccgaagccgaaggcgaagcccaatttttattcgaagccgaagtccgaagctcgaagcccaaaaaacccgaagttttcgaagttttcgaagccgaagccgaagtttt

SEQ ID NO: 43966 - DNA, 1023 bp, Heterodera glycines
ggaagaggggaaaatgccaaaggatggcatttggaggggggggagagaatgcggaaggcagccgactgaccgtcctctttgattccgtaagtgaccaccaacggactaaacagagaatcattagaaaattaattgctccaaaaatatgaacaaaccgtgtgttatattcccacactgaaaatgattaatcaattgaactgatcgtccaaatgtgataagtcaaatcaccgaccgatcagtgcgcatccgacgagcgcagcaaaagtggccaaaatgacaatggccagccaaaggaggcgcaaatgacccgacgtctgaacagtgtcgcggatgccgtggaaagttgtgttttgctatggagggacagttaaaaactgtacagcattcattttggcatgacgataaacaccgtaagcatcgtacagtaggaagacactgtcggctcggcatttgcacccgcggcgcccaaaggtagtggggaataactgctgcttcttcggatgatggtgctgctgctactgttcgaattggacggtgagcgatcgcgcgggtgccgcagggatttcccctcgggcgctgccgcagacattttagtcgctaattgcgttaattggtcgccaattacgctgcttttcgaatgacgccgaaggttcaaagtgtcgcaattgacacaaaagggaaatgaaaatgggtatttagactccgattttccctcactttttcatttgtcttcgcttggcattcggccgtccgcaacattcgcagcaaaaatgccgaaaaatattttcacattttccatcgttctcttttccactgcttttctcattttcattttcgttgtttttttgctgtttaaaactgccatttctgtgcacttttcgtccgtctttcatttgctgaatattcaaaaaattttaaaaatttcagatgaattttccgttcaatgaatgccatttcaaatgtttttttttaccttttgctgttccctccacttttattgaataaataaattccactaaatta

SEQ ID NO: 43967 - DNA, 973 bp, Heterodera glycines
ttctttattttcaaaataattaatttaaaattaaaactcttattgaatcattttgttgtgaatattttatatttttttgggtgctttggattggtcttagctgttaggccgagcataggccttttaaatttttatgaattttgaaatatttaatgatgataattatttaattatttgcccacaaaaataataaaataaaaggtggaaaaaatgttttgttgggaaaatatttatatacattctaaaaattctcaaaaaaacttgtactgaaatttctcggccttttttttgggggggggggggttgatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatgtggagaccgaatccttcgggaatagcttccctatagcctgtactttaattctgcgttggatttttgctccccataattgtttgagtaccccaaacggacacttgaataaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaatcgatttttttatttcataaatattttttcagaaagtgctctaaagcgcaccaaattgtatttacatgttagtttaggcactctgatgctttttctatcaaaaagggagatggagaaaaatttttttaaaa

SEQ ID NO: 43968 - DNA, 1471 bp, Heterodera glycines
caattaaaaaaataattaatttaaacttataaaatttatttatcaaaaaaaaattaaattaaatataattttttatttattaactcaacaaaatattttaaattaattaaattcattgaaaataacgtaaaaatgcacaaaaaaataatgttacaccgtccggattcgaacctgccccccccccctcaaaatgatgccttagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaaccatgtgctcccccctttggtcccgaatcccaaaatcacttttatttttgtatctttttttaaaaatgtgatagaaatgccaaataaaatttatataatagagcaaaaaattgcggatttttgtagtattttacttttttcaaatagcttttcagaaggcagttacgaatttttttctgaaaaatctaaaatttccagaatttctggaataacttttttcatattgatgttagaaaacctaaataaatcccataaaattctcctgatttttctctatttttaaagctttgctgtatgaaaattgacttaccctgaggttagttatgaattttcaaatattaggccaaaatcccgagggccaaaaaattgccaaaaaataaagaatttttaaaaaattcccaaaattctgaaacttaaaatagacatcatattcgtactcagcaccttattttaccccagaaaaatatttttcacaccctttttcgacccaaaaaaaattttcgaaaatttctagggggcctagctcgaaaatttttgaaaatttccggccatataatacactattcgatagcattttaaaagctctacaattttgccctaaggcgttttttcgataaaatcaacccctaacgagttatggacccgggactcaaatgtcccgctcaggccaaattttttttctatttccgggaaaaaatcgaaatttttccgaaaaaaataccagtcgatagagctcgaaaaactgttgcttgaaagtggtctccgttttcccaggaaaattcgttaaaaaatcctaaaattcaaaaaccccaaaacctacttttaggcctaactcgaaaaattttgaaaattttcgaaattttaaaattttgaaaaatcgagctcattaaactctacaataagttcgctggcaccccctcccttagaccaaaccctgacgtggcattcacctggtactgaagtgggaaaaaaaaattaactgagtctccgtgtctgtccaggtccgggatttggtctgatcaaaaaataaaaaatactggattatagaggacacttctgcggagtgccctcacagcgggaattttttgatccgagtttcagaaaaaaagttatggccgtcaaacgca

SEQ ID NO: 43969 - DNA, 1675 bp, Heterodera glycines
  misc_feature (1603)..(1603): n is a, c, g, or t
cgacttagtttcagcgactaaaataaaaaaagggaaatgcgttctttttggcgaaaaacggctacaaatccgttgctctctggcgctacctgcccttcgtattgcgtccacaatttgtgtccacagctgttccggctccatctccattcggttgtcgctgtccgacgagcacaacaatttgatgctctcctcgtggccatggatcagtgcacagcccgcggagggggaggcgtcgaaaacgcacagctaagaaaacagtaaacagcactttactacgcaaaaaaaggaggcgattttgcaacgtaataatccatcggtcaattaattttccctttccggtcacaaattggcaaaattatgactcattttaaaatggcctccgctggacaaaatttacaatcgccgcatttttgcaaaaattcgaacccatggttaaacggaaatagtggataaattaaattccacccaccttcaaattcgtcgtgccaacatcaagtgccaaaattaatggacagttcgacgccatttgaattcttaccaaaaggagcgcatttaatggaaaattacaacaaaaataaagggttaagaatcataggaagtggaattcttctcatttctgcgaataaaagtaaaaagaataatttgtaaatatttaaaataacaaaaatgacataatttaggcatcggaatacagtaaacaatgaaaaatgccaaaaggagtgaaaaatgggaaagtattggacggaataaaaataccagcaaaattctttttccatggcggaaggcaaaatgaggtcataatttaattttgtttttattcccgtaaattcattcactcgccgattgtcctcatctttttcttcgataaatcgtacccttttggcgcttcaagtctgaaaaaaaaacaaaatgggaaatggaacttttttaccctttttttgagggagggtagggctacagaatccgttgtgaaatcaaaaaaaaatacaagtaaaactattggaaaatcgggcaggaaggggacagtgacgcaaaaacttttgaaaaattgtggcgtaaaagttacaaatattcgttgcttttatgtcggcttcccccgcctaccggccccaactatgggagagagtaagtaaaaatgtagacagaaaaacatagatttgttaaatacagcacaactcacttgtacccgtacatctcacaccagccaatcgggaacagttcacgagacctaaaaaatttccgaattttttcgtgtccccatcatccgttccccggccacctgtagtcgaacagctggtccatttcgctctcccatccgtcaaaatgcacttgcagcagacgaccgcggatcgcacaaatggtggccggacagaccaagttgggctcgcattggtcggtggcctccaatttggcaccgacctgaaaatttagtatagcaaaaaatgttaaaatacagacaaatttggcaaaataccccatttattttactatgaaaaagcgtaccttaaaatactgaagttttgccgccgaaggaagtgggtcctggcaatgaaaaagatgaaagaaattcaaagcgtaagtgtaaatttaaaaaataggcttncaaaaagtgcattgggcgccggaatcgctcctcagggcgcaaataatcgggccacgaaaaatcgccttcagt

SEQ ID NO: 43970 - DNA, 1420 bp, Heterodera glycines
tatcaaaaattttttgtttgctgccttgattcatgtgatcgagtcaggctcatgcacacggattaacaaaaatgtggccaagtagccgagaatgtacttgcgcatccaccagggcaccttaaaattgagccaaaaaataagtgagggcgcggttttatttatttatttttaaagaatttagaataaaaattatttagttattttttaaaacggagcagggcattacgcgtctgccctggttggtggtgccacgtctgtgaatgttcagcgtgtacacattcatcgcagttgccaggcaaactgaaatttttaaaattagcaaaaaataaaatcgccaaaaaaacggggataaagcacccacacccaccaattgcaagtgaagcgacgtagtacatgccgattagtggcaccgcctcggaagtgggcggaattgattcggtgattgattgcaggtagacgcccatcgacagaatcacctgcagggattgttgaaatgggattagaccctttcgcatggaattccttccgaccctgacacaaagttgttaaaattttgataaaatcgccgaaatttctatgtttataaatttaaaaaaaaaaattcggatggggaaacgacagggaggggggagagggaaatggagtgcaactctggtccggcatggcgtcagaatttttgacaaaaatcgggtccggaacatagtcacgcatctgaccgtgttcagcatgttgatcttttcgccggtctctggcggcatgcaaaatcccagcaatgccatggacgagatcagcacacagggcagaatgtggttgaacacgtagaacaacggccggcgtcgcatgcgaatggtcgcaacaatcattggccagctggcacgcgcgtctgtcggaaaacggatcagtgtccgctcggcggtgaagaacagcaggtcaaactcggtggaattcgtgcggaacacacacacatattgtcctagttcagttatagttggcataacttgtgaattctcataattttcttaattaataggaaattcaaaaaaaaatcaaaaaaactttcgagcaattttttaaaaattttacgatgcattaatatgtaagtgttttgaaaaatttttcaaaaaatcgctgaaatttttcaaatttttttcttgaaattttaatataaaaattttctaatatttctttgaattgtttgattaccatgtaattggacaagtcgccctggtccgtggtgaggccaatgttaatttcacgtgcgtcgtgggtgccccagctggcgaatttgagagcaccttttaaagcatggaaaataatttctatttgaaagataatttttattattaaaaaaaattaaatatatttaaaaaaatattattttaattttttttgacgatttctttaagaaatttggagcaca

SEQ ID NO: 43971 - DNA, 775 bp, Heterodera glycines
aataagttcatggcctccacgataaaatccaaactgcgataccatctcctcactcaagtggtggagaaggaaatgcgttcaggtggaacatttgattgttccgacctacgcaaggcaatcacttccattgttgaagtgaaggaagaagtacaaagatgtacacaagtcttccgtggagaagaaaaacccagaaattttcctcctcaaattcagaggaacaatttccaagggagaggaacaaatttccctcccaaccaatttcgtcagggtcattggcgacccaacaacagaaatgagtctgaggggatgatgtcttcccaaatacacagatcatttaacactgtcaatcagagggaacaaacacactattctcctcgagaacgaggaacgaacccactttgttctctttgtagtgacatgggacacgcacgaagcaagtgtccaaaatatccaacacctggagcacgcagaaggcggcttgcagatcaacaacgatgttttaattgccttatgcaagggcacaattctcaacaatgcagcccatcaaagaggtgcccaaaatgtggtgaaaatcaccagttcatgatttgctattatgagggagacgctccgagaggaagcactcctcaacatacaaccaaaggagggactgttcaaaagaaacagtcctccaacagacgagaaccacctcgtccaacacaaaatcatttttcggcaataaacgaacccttaggaataagggaaaaaccgtcggaaatagcaattttcgacggaa

SEQ ID NO: 43972 - DNA, 951 bp, Heterodera glycines
tccggcacttccacctctttgcacttctttttcccgtcctacggttcgtccaaactgaagtccaaattcagcaggtcgtactccgtcagaaagtcgtcgttcagtgtgtcgtattcgctgacagtctcagcttttctcggccttcgcttcatcggcttattggcgcctgctgacagtgagtgagtgatcaagaaggtaattgctcttaatctctgatcagaaaaacgacctttcggttgcaattcgccggtgtttccaatgtccaaccgatcattcattggaatggttgtggtccgtctgatcggatttttcaggccctctcggctccaaactgactgggccaactccggctccaaaatgctgaatgcgtgtctcaaatggcccactttggccccgtccgacctctccggcatgtcgaatccgccatcgtccggcaatcccgagatgggttgtccacttctgaccacaccggtgagcaacagcagcggcagcagaacggggaacagtacatgaaggacagcctcatcggaccaggaaatttggtgtcgcatttttggggaattaggtcagtgtgtgagcccacagcccgggggctttttgctgttgccgcgggcgggcgatctccgccgatcatttggacttccccagcccacccgacggtgcctttacacatcgatcggaggacaaaagccggttgttcgcctcgtcggggcctggatattggacggatcagcgaccgaccgatccgatgcacataccgccacactcattagccacgtaattcacaccaattgctgctgttgtggcgatgggaacggtcccacgccccttctccccctcccctccccccggccatccatcattcgaaaaagcaaagcgaaaaacggcggatggattgtcgtcgatgcacaactcgttctttttctgccgttcattgtcctccccttccct

SEQ ID NO: 43973 - DNA, 1060 bp, Heterodera glycines
  misc_feature (96)..(96): n is a, c, g, or t
  misc_feature (949)..(949): n is a, c, g, or t
  misc_feature (975)..(975): n is a, c, g, or t
aaatcacaaaaaaaagaactttcgcacccgctaaaggcacctacagaggaattttacggtcgcagaattttcgcacagtttcatcacagtttggcnccgtagaattcccaaagattgcgctggtggcaccggtgttgtcctccaacgcacccattggcaaaaacaattcacaacaagacacagaaacaaacccaccaaaacaagcaaataaacaataaaaagcaaaactaacgcacttcgagtggactttaaattcagtattttttgtgttaatttaatcaaattaattgtaagaaaagaaaggcaaaagatttaatgtgtaaaatatccgaataaaaagcatcatttgtgggtgctgcaactcttggccattttggcaatgcgcacattggacaaaccgacgaacgacgacatcccgcaaattggcacgatcatttgatgccgcgaaatgcggtccatctgggtaagcaaaatttaaaaaaatgaggaggggagagttgcaaatcacctttttcagacggtgaaaacgctcgctaaggttttgaggaatttgtgacggagaaaacaaaattctgtcgataacttaaaaaggtaacagtctaaaaatcacataaaatgacatcgaaccgtcctcctccgccacctttccgccttcgtttcccactttttttcgtttccacgagtggtcgtcaacaggaggaaaggaacagttccgtttcatcgaccccaacttcgttttgatttgtctaacatttctccattgttcaaaacgaatccgcgcgaaacgcttcaatacttcctggaccatctgacaaaaaggggaaacaaaggttgtggattcattaattaaaataaataaataattgcattttgaaaccagttgaaattcataaatattggtcgtgcaactcacaattcgcgtggtccctttgtgtatattatttccagngtaaatgttggtcagaaggtacttanattttgatgacgaaaagggatgaaatttggtgcatttgttcaaataccgaatcagtggcacgccgtgggcagttcgaatgtgctg

SEQ ID NO: 43974 - DNA, 576 bp, Heterodera glycines
  misc_feature (564)..(565): n is a, c, g, or t
ttagaagctcactattttttgctaggcttagatcacatgcgattttcggcactctgataattttagcgctcataatgggatgtataaaggcgattgtagaaggaattggaagctctaaaattgtttgaggagctttttgagcgtaattacgattttacttacaccattttttgctaggcttagatcacatgcgattttcggcactctgataattttagcgctcataatgggatgtataaaggcgattgtagaaggaattggaagcgctaaaattgtttgagaagctttttgagcgtattacgattttacttacaccatttttttctaggcttagatcacatgcgattttcggcactctgataattttagcgctcataatgggatgtataaaggcgattgtataaggaattggaagcgctaaaattgtttgaggagctttttgactgtaattactatttttacttacaccattttttgctaggcttagatcacatgcgattttcagcactctgataattttagcgctcataatgggatgtataaactctattctataaccaattnnaacccctaaaa

SEQ ID NO: 43975 - DNA, 398 bp, Heterodera glycines
aaaagcttatataaaaatacaattgtgaataaaaataaaagtacaatccacttaatgggcaaaaaatatattgatggattttattgcctcgaaccaatatggaaaatatttaaaaaatacatttaaaataattaaattaatttattaatataattttctgtactgaaatgactccatccctctgaaagtctctcactgatttttgtttttaataaaaaatcagaaaactataaatgttagttttattgagatttaaaaatattataaaataagcgcattaattaagtagattattattttttaaaataattattttgcttttaatttattaataattattttgctttaatttgatcactttgcactttttcgtgcttcgacatagcacccatattagg

SEQ ID NO: 43976 - DNA, 1107 bp, Heterodera glycines
  misc_feature (15)..(15): n is a, c, g, or t
  misc_feature (1014)..(1014): n is a, c, g, or t
tctcaggtgataacnttttttgaaacttaatgaatttttttgaaatttcgcaggataatagaaaacacttagggctagctaaaaataccaagataataaaatttgattcattttgggtgaagttatgaataattttctgtcaaaaaatttccatttgatggttttttgactaacgcccattttgatgggttttgactaacgtcccagcaccgttttactgatacattttaaacacataatttattttactcttcttccgtttaaaaaataaataaatgtttatttctaaatttgtttgctgaattgacctttgcttcctttgcttttttttgtaaaattgcgaagttatctttccacagataattttgtagcaattaaattgaaacaaaagatcggaaaatgatattttgtcaattagatgatggaatggcgatttaatcgaattagtggcggatgacgatgaccataatcagatttatcaaccaatcactacgctataagaaaaccaaattcttgcaaaagatgagcataaattacatcaaggtttaaaaaagtgataatcggaataataaattaataatttaattgaacaatttcacagaatatgcccacatttgcgatttaataaattcattaataataattagcgaattgagaaaaaagtggcaatttctgcgataatatggtccaaattggcatgttagttctttgaaacgaaaatgttcagaaatgttatataacttggaaaattatgtcattttcggcggatttcttccaattttggcactttcgctatttttggctttccgtttgtcccacagtgattttgtgcacccgccgagtccacttttttctgctgctgctgctgatcaacgcaggcgaaaagatgacgcgtccgatcaatttgtgctggcctccgtccacgtgttctcccccctccccgccgacgatgcaccgttatcaccgacaaaacaccgacaatttaatttgggagttgttgcgaatttgctcgcncaacttcttcccgtcccccccccccttccactatttatgggtaacgtcgaaccagccaatgcaattgccgacgaccgcggttattaaccggtc

SEQ ID NO: 43977 - DNA, 1426 bp, Heterodera glycines
aaggtggatgagggaaagaagagggaagggagtggaaatatggtggaagaagaaatgagagaggaagaggaggcgagggggagaaagaggcgagggagagggaggggagaaggtggatgagggaaagagagggaagggagtggaatatggtggaagaagaaatgagagaggaagaggaagcgagggggagaaagaggcgagggagaggggagaaggtggatgagggaaagagagggggaggtgagaaaagattgagagatggaataaaaaaaacagaacatggaccaaagcagaaagtggaaccaaaacaacagcctctcatcatgcagcagctcggacagtctgtagagattcaattgaatcggcttcaaaaagaagagtccgtccggagagtttggggccaaaacggatgaacggaggagggacaaacggcggtggagagagcggaagagaaaatgccgaaaaaaagatacaaatggcacaaaacaaacaaaacaagtgataaatagtgttgataagaaagaatgggaagaaacactttaggagaagcacttcagtgccccgaaacaatggaaaaacggaggcgaaaggcggcggaatgtaagcgaaatgccaaaggaggggctaattaggctaattgggaagacaaaggcaatgcgcgaaaaggaataggattcaacaagtagtagttgctttaaatgccattcgaatttcaaatttccttctggtcaccgcccgtcccttcctttttaatgggttttaattttaaaattaaaattcgtagagcgtatgaatatgaaaaataactctctttgcttaagagtaaaatcaaacttctccactacgaaaagtgccggaaatacgacgagaaaaactgccgagaaaagaaacggagcgaaagtgccgccgaaacaaaggccgggctaaacaaaggacggaagggaagggcgaaaggaggacaaactcagaatcattattatcattatcgagagttaagctaagaacattaattggcataaagggaatgcttttctttgttgttggaattgcgaccgatcattaagtgaatcaatcagcggaagagacgcggagcaatggcaccgaaaatgcccttccgttcgaacaatgccaccaccgatggcacttgtcaaaccgaatatctctccttttttgggtttgggcttgctactgaattccatgagtttttcgcgcatttcttcagctgataattctttccccaattcaatttaaatgataaatgtcagttttatgtgaaaaaattaagtaatgaatgaatgagtataaatgcaaaactaaggaaattgactgaaaagactaaggaaaaacgaacgaacgaacggacggagggcattgatcacaatggaagaaagtgcgcatggaaacggagcacaaaaaagggcaaaac

SEQ ID NO: 43978 - DNA, 1033 bp, Heterodera glycines
aaacaaaaattcattatcactaacttcttaattaatcaattaaggaacctccggaaaaagaattgtaattaaaggcccgctgattgataaataaaggctagaattgccgctaattaattcccccctttgatgattaattgatttcctcctttgatcaagccccgctaacgatgtcataattgattaaggcccgatgattggtgtctctattaattgcttaattaatgccagttaattggttcccttacttcgatcaaaaccctctaattgattaattaatgccctactaattaattctcctcttttttatcaagggcttctaattaactaattgattccttcctttgaccaatgcccgctaattgattaattggttcacccctttgatctatgcccgttaattgaagtcctctaattgattaattaatgccgactaattgctcccctcctttgatctaggcccgtttgccgcccactttttcggtctgtacactgccggtgtttcgtttttatgttcctttgctgttgcgttcgtttgcatcgccatcagctccatttggcctcgtacggcttggtgtccatgtcactgattatcaccggatttgtgttcactgtgttcgccgtttttcaccgcgacggaggcggcgaggaagagaatggaccagaaagtgatcaggtaaaaatgccgtagaaaaaaaacagggtccgaattcggcataggggaaaaacttttgtcgaaatttcactctcgaaaatttatcattcgggattaaattgttgggggtgatgttgaaaatgtaccggactgaattgggatttatcaggactgaatttggcattcgataccgaaacgtaccgggttgaattcatcgagaccggcggatttaacattcgattcttaatcattttggattggattgatccgaaatgggttgagcattcgagactgattcgggccgtgtttaattgatccgggattaaagcatcgaaattcgaactcttttttttcccaatattcttttgaattatgaga

SEQ ID NO: 43979 - DNA, 700 bp, Heterodera glycines
  misc_feature (573)..(573): n is a, c, g, or t
aacatattttgaagcgggcgcgaagcaccgaggccacgaagtgttcttacgagccccacaaatttagaaatgggcgcgaagcgcccatcttagggcgtaaagctgcctacaaccccttaataacttttcaaaaattcatttgttacatgttacatgctaagagaggaaattcatgaactccctccgttttcatgtaacatgtaacatattttgaagcgggcgcgaagcactgaggccacgaagtgttcttacgagccccacaaatttagaaatgggcgcgaagcgcccatcttagggcgaaaagctgcttacaaccccttaataacttttcaaaaattcattgatttcattatgttaatacatgttacatgctaagagaggaaattcatgaactccctccgttttcatgtaacatgtaacatattttgaagcgggcgcgaagcactgaggccacgaagtgttcttacgagccccacaattatagaagtgggcgcgaagcgcccatcttagggcgaaaagctgcctacaaccccttaataacttttcaaaaattcattgcatttcattatgttnatacatgttacatgttacatgctaagagaggaaattcatgaactccctccgttttcatgtaacatgtaacatattttgaagcgggcgcgaagcaccgagggcacgaaagtgttcttacgagccccac

SEQ ID NO: 43980 - DNA, 992 bp, Heterodera glycines
tatttatatgcacatttgatatataataaaatggcatatcggtggggcataatttgtatagtttaattccgtgtttcatcgagatgacctacccgtttgggtacttatacagtttacagggtacttttcacatacattttttttaaaatggctgtgcttttctaaattttgtggagggcaccgcccaactcgccgcacctttgttttatggctttctcgccgccattgaaaaaatgaatgtgaaaaatttggattcgataaatcatttaacgaaatattcttaatcagaactttttccctaaaatcgctgctaaggaaagccgaaaattctagctattttttatcgggacaacaaatttagacaattgccagttgctgatgcgaacaaccccgaaaatccatgaatgaattttcatgatttattatggaaacattttttgcaatcaaaaaggtctgtctataggtctttaataaaattcacgtttcatcacagttaatacatattaggcgaaacaattgatcacaagtcatttgaaatgataacacagagatacaacacattgataatggtgatcaaccaacaacagacaattatggtcgcttaaacagtaaccaggcgacataatactgtacatacagtgagatacaataatacaatctttacagttgggatcatatgtgggaatagggtcagttgaatgtatcctcctcctcctccctcttcggcggttgtcttctgcatctctcccatccatcggtcgtttgtcgtgtcatctcatcgcgtggttcttcgtccattcacgggcaattcggttgtactcctcgcggttgtcgcggtacatagtcgcaatgtcctgccgcagcgcactgttcggattcgggtcacagagaagcgaagagatggagagcagcactgaaatggagaggggataaggattaaaacggcatttccaaatgtgaaaaatcccattttcaaacgacaaaatatcaca

SEQ ID NO: 43981 - DNA, 1550 bp, Heterodera glycines
  misc_feature (16)..(16): n is a, c, g, or t
  misc_feature (1542)..(1542): n is a, c, g, or t
aaattgtaaatttttntggagttaggtattttgaaaatttcctgtacctatccggggtagttccgcagtaccaaaaataattgccgaaattacggccccaccaaattagttaaataaaaatttaatttcaagaaaaaaaaccgttgtaccaaattttataggcatactccacggtccataattaacttaacctgaaaatatttcaacgcttattggttttaaaaaaattttcgttactttgagttttccatgattttattttttgcaaaattaattatattttaagctaataaagattcttttctcaagactaaaattagacttctaaatactgtaaattttattgattggataatgattatttaaataaaacttttaaaatattccaaaaaaacaaaaagaaaaaaaagaaactgaccaaaacagctgaaatgagtgcaataatgataattgccacaattaattgatgcactgcttctgtgatttgttgatcgccaagaattgaatccaatcgcaaatcccataaactgtccacaattcgcttgccttggcccgtctgattgcttggctgatattctgccttagcaaaattttgagtttaaaatttaaatagaaaacagttaaaaattgattattaataaaatataagaaaaattgaatttttgtaagctaaggacgtccttttaaaaaatactctgttatggcatttaaaaagatcattgaagcaagaacgcataaaaatcgaatttttcattaattttttggtttttggctaaaaaaataaatcattttcaactaaactcaaaaaaatttcgtaattaaaagttaacattagcagttctctgcttttatgaaatttctttatgaatttaaaataatattgatttactattatgttgctaaattaaaatgaattacaaattaataaaatgtctttataaatgaattaattttgtcaaaaaaatattctataaatttataaatttttttatttaaataacaaatcacaaacattgggttttctgctgctgattgaacttgatggtggtgggactgttttcatttgtcgataatcgtttgaaacggaggccattgttgaggttgattgattataattgaaagttttatttttaatcatcgagaattaaaaataaatttaaataaataaattatttgtgttttaaaaaaaaaaaaattaaaaaaggaaacaatttaaaaataagaacggactgatgacttttttgtgatcattcacacaatccagtgcttactgactgaccagatcacaagtcattatatcaattaaagttgctcaaattaaaagcggaccgcggaaaacgatcaatttcttatcgaaaagtggcgatgagtgacattaattggtaaaatgaaaaaattaattaatatcaaaatgagaaacgaagaagggtcggcaaattgcgttaatttaatttttctagataataaaattattttgaaatttttggtttattttttttacgaaattagaagaattccaaaactaataggatttttttcaanatttttat

SEQ ID NO: 43982 - DNA, 998 bp, Heterodera glycines
attaatcgtatttatatatagcattaaaacttgtaatataaatatttcctaataaagaatttcccagaaacctaatggaaattattgcccatctcttttcacttcttggcattacccggacaaaatctgtcgagcccaagttggcacttcggccgtgtaactcctattcaaaaagtcaaataaggcagtaagaatctgtacatcttataacaaagtgatgttaactttcaatattattactttaccaaaatcaataaaatgtaacacggtctctggatagaccattgacgcgtttcacatgaaaatgtaacgtactaacgattcattcaattcagtcgctcatctcaccgtcagaaaaggacctacatgcgttattataggcctctgtttattcgttccaagagataggttcagtccttacattcaaaattaagagagcatcacccaaagcgagaaagagtaaatgaagaataaaatccggctctttgatagaattcgtcagaaaaattataacgatttcatcatttctaccccccccccccccctacatggcgtcaaaacgtcggcgccaaaacgttttggttgttttaatctattttagaaacaaaaagagaattttgaaattttttattttcgattttttattcgaatttcggctccgggttccgaattggtcgaaatggatgcctggttcgtgagcagcgaccctgaaaaccattggaagcatgttttcatgacttttgaaaacaaaaaaattttcttcaaaaagggaggcaaccaacaaccatcggcagtattaccttcgcgaaaaatacgttttttttgttgttttacaaaatttttcgaaaatttttaaatttgggtgtttttctttttttattatggcttggcgccaaaacgtcggcgccaaaacgtcggcgccaaaacgtcggcgccaaaacgtcggcgccaaaacgaccctggcgccaaaacgtcggcgccaaaacgatacggacccc

SEQ ID NO: 43983 - DNA, 1298 bp, Heterodera glycines
ggtagggatttaatagtgactttcagagatagccatttttgtcaataactatttttcgtgcgttttcaaacacactattagtgctttattcaccgctacaatagaagacaaaagttggtgtccaattcccggtagggatttaatagtgactttcagagatagccattttttctcaagaactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttaatcaccgctacaatagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtccaattcacggtagggatttaatcgtgactttcagagatagccattttttgtcaataactatttttcgtgcgttttcaaacacactattagtgctttattcagcgctacaacaaaagacaaaagttgatgtccaattcacggtagggatttaatcgtgactcagagatagccattttttgtcaagaactatttttcgtgcgttttcaaacaaactattagtgctttattcaccgctacaatagaagacaaaagttggtgtccaattcccggtagggatttaatagtgactttcagagatagccattttttgtcaagaactatttttcgtgcgttttcaaacacactattagtgttttattcagcgctacaacagaagacaaaagttgtatccaattcccggtagggatttaatagtgactttcagagatagccattttttgtctagaactatttttcgtgcgttttcaaacacactattagtggtttattcaccgctacaatagaagacaaaagttggagcccaattcccggaagggatttaaaagggcttttcaaaaaaacccttttttttctaaaaatattttttcgggggttttcaaaacactatttatggtttatttcacgcttcaaaaaaaaaaaaaaagtgggggcccattccccgggggggtttaaaaagggtttttcaaaaaaaccctttttttttaaaaaaatttttttcggggtttttaaaaccccttttaagggtttttttccgcttacaaaaaaaaaaaaaaagtggggggcc

SEQ ID NO: 43984 - DNA, 1030 bp, Heterodera glycines
cagcttaacattcaaatcggtcatgcgattctccagagtttccaatcggtctttagtctgacgaccattttgagcatgcaaaaattgcaaagagtgaaaatcgtcgcgcaatttgtccaactctttgccaatgttatggtcacagccttaacaagtgtctgtttttcctttttcttaattttgatttggtcactttttcttccattgttttctccaagtccatcggccgtttcaatccaacggaaatcgcttgggctttcgtttcggctgttcgtcacaaatgtatggcacgtgttgttcaacgacttttgcttgttcccatttggcggttcgatgtgcaacaaacggttgaggatggaatcgtccaggcgagaagcatgtgtctgatattggtaaatgcaattcctttttttgcataaatgttttatcactcgcctcatttcggctctcttcctgcgacgttcccttgcggctttggccgtgaaaaggttcctcgctttcggttgtgttattcgtggaattcaaagtggacgaggcggtcgaagaagtcaaagacgaatcggaagaagccgaagctgaggaggacaagtgttggggacggttgggagcggacgaaagagaacgaaattgggggagaaaaggcgaaatggatggcgaattggtagaagaaggataatgaactgaaacaacaaaaaaggaatagagagagaatatgatggcctcttataaaaggaagtgtataaaagtttaaatcggaaaacaatcagtatgtaaatttggtatcattgggtagagcagaatcgaattttttaattccagtggtatctcacattatttatattttataattagctataaattaactaaaattatttacatgttgatttggatttgaacttagagataaaccctcattagaatttggttttcttaggctcaacttttcaatttttgtcacacatcgctaaaattaaaaattcgcaatacaaaagatcctgctctatccaatgaaacccatttatataccttt

SEQ ID NO: 43985 - DNA, 1114 bp, Heterodera glycines
ttttatagcagtccacactattggcacaattcaagtgcgaagtgccaatccaaacaacaacacaacatgaacaacattggattaagccaacagataaatgtgcattcgatcaatttaaatcactaattgatacggaataaatttaatcttttttcatttttaaattaaaaaaataaatatccctctaggttttcgtgaaattttttataatttgtgaaaattatcgcggtactaattactaatctccataatctttatcataaacatggccatcagctatacatttagaaatgcaatttccgattttaggcattttgaatttaatttcacagtttacgatttcggtgggcgtcaatggcatctcctaattgtgccctatgcattaaaaagtgccataactttttcacggttattcaatttgccattctcttaaattaaatgaaaattcattttgattgacattatcgtgagaaagacaaatttttgtcggttttgcgtttcttgccttgggaaattttcggtctcgagcagaatgtattattcatttttgggccttccgtttcagcggcaccattttttttttctaaattatgggaaaattttcttttttaattcattttcaatgcgatttctcagaaattctcatgctattttaaaaagctcttttccattcattcatttgacgaaatggcaaaatttgcaatcaagctttacgtttcataagcacaaagaatttaaaatgaaatttagagaaaataataattcattttaaaagcaccaaatatttctcttggatttaaaagataatggcgccaattaatatgagctcagaagatccggtatgaattaatatgatataaaataatatataaatatatttttatttattttcagctttatttggcctaccgttctgtcggtccgtccgccgatttaattgtgccggccgttgcgctgaatttggttgttttggttggcattgtgttgaacggcacagttttggtggtcactgtcaaatccaggcaaatgccattggcattttttattttaattatcataattgaattgaatttcaatttctatttttcagttccctccgcggctccgccaattt

SEQ ID NO: 43986 - DNA, 1489 bp, Heterodera glycines
  misc_feature (1414)..(1414): n is a, c, g, or t
  misc_feature (1435)..(1435): n is a, c, g, or t
  misc_feature (1466)..(1466): n is a, c, g, or t
aatagcgtagcaatggctgagagacaggagtgagactatgtgtcatagtttatttgtaagttatttttgacgagttcaacgaacgagtcacaccactgctacccgtgcaaaaacagcgcatcaaccgtttgacactcaagactttctaatgtccaattttgctgcactgaaagcttcacagaatttgctcggccaattccagcaacatcaacagatgttgaataattgtcacgcatcgcccgctattcagcgtcaaagatccatcgattatgacacggagcgggagaagaacagcgaaatgggaccaatgacgggcggagttgggacagcgatgtcaactgccgatttggtcaccgcacttgggacaatcaaagcgcagaacaacagcagcaatatcggaacggacaaatgtgaggataatgaaaaaacaagaaggaatttgaggaatttcgttaagtaaattctgacatggaacacctcaagcgggacaacgaattccccgtttattcgccctctcaattggccaattccatcatttcgcaatgcaaaactgaccaaccgcatcagtcttcggcatccgttgacttctccaacggatggagaatttcatcagacgcacggagggatagcagtgagccggacggagaaattggctcggacatagccgaatcatttggtgggtttgttactttgggtctcgatatttgccaccatccccaaaaccgaattcaaaacataccgagaagcattatgtcgttaaataagtaacaggaagtaataacattcgaattcattgttagaaatattattgccacagtatgacgtataatgaacttaccgtctcaacaggtcgatgcattgttcaacaactgcaaacagtctcaagaaagaatccgatgctcgcagtgcaaatgcgccgggaattgatggacgtgtgcttcaaatacgaaatgcaagcatgcgtcatcgacggtggccatggttgactcgccattacttcatgtgatttttttcccttcaataatctcgaaacttttgtttgtttgttttgcgtttgtcagggaaaatttcctatgtggtacttcttcctcggctttttcttgataagtatcacaacaaatattatttgtctcttcaattcattttcctatggagaagtcaacagattaaacatactgaaccattttggcaaaattcatacccctgcatttgattttgcatattcccggttgttatttgattattggtcactgatcacctcttccgatttcaagtcatccaaataccaaaatttttgattctctaataaatgtattttaatcgaataaattatttatttgttgaaaatttatttctccttttataaaaagtaaaatagaaatttcctaataaatttggcggtttaacagctaancataagataccattctcagtntagcacaaaaagggctttattttcagacaanatcgcgaattaacacaaaaaaac

SEQ ID NO: 43987 - DNA, 943 bp, Heterodera glycines
atatttagaggttatccccagaaaaatggctatctctttttttgataatttttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatataccttttatttttgagggaatttttaaatttatactctatcccagaaaaatggctatctctttttttgagaaattttatacacacacaaaagcgctcgagcatgatacggagggctgtgcacaatagccattttatttttgagagaatttttaaatttagacgctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttatttgataaattttatac

SEQ ID NO: 43988 - DNA, 1329 bp, Heterodera glycines
ttttatttttgagggaatttttaaatttatactctatctcagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggaggacggtgcgcaatagaccttttatttttgagctaaattaatatatttaaatttatttcatgaattttgtcaatttccttaaataccaatattttaattttcaaaaaataaatattttccattgctttagtattggctgacttgcgtgaaggaattaaaacgtgatttttcacaaaaaattgtaattgcatcaatcatggcatcgtttaaccaagtgaaattaaattattatttggaaataaaataaaatatttttaaattatagcaagattgggaatttttggcatcccgttctgaagaagcaggcgctgatgctttggaacttaatttgtcgtgtcctcatgggatgggcgaacgtggcatgggccttgcctgtggccaagtaattcaaatttcaatttttaaatatatttctttttcattctgaacaaaagtagaaaatatttcaacttattttatta

SEQ ID NO: 43989 - DNA, 779 bp, Heterodera glycines
actttattgggaaaattcctagaaaattttaatttaaaaatttgaagtggatttaacatatagaaaataaaaagtttagcgaagtaaattaggttttccaatattagcagagataaagaaataatacgccaaaatgagagatgtatttttctttgcactctctattttttggttcatctctcttttattttttaaaaggtaattttttttttctttaaaatcggaattttcaccattaaaaaccgggttggtctcatcggccgactctcttcgtcaccaaagccaaaatttagcgttttgatatccaatttaaacttagaaaacacacaaaaaaatattcccctaaattatgctttaaccgcctgggtgtcgaaatgtccgaattttctcaggtggcgaaacgtccgattttggcttaggtggcgaaacttgtgccggtggcaaactgtcggctcgtcaacaacttccatatccactgaaaaaattgataaaacaagacaaatttatgctaattaaaagaatggttaagtggaaaaagcgtaagaagagccaaccaacaaaagtgaataagaatggccaacgaaaaggccaactcggacattggaggaatcgataagcacagaaacgatgggagacgatgttggctgttgtggaagtggcagaacggagagggcaaaccgtcgccgaatggcggacagtgagcagaagggggggggggggaaggtcagcgcagacggcgaacatcgatagaaatggacagaaaaagcggggcggggggg

SEQ ID NO: 43990 - DNA, 1059 bp, Heterodera glycines
  misc_feature (29)..(29): n is a, c, g, or t
  misc_feature (37)..(37): n is a, c, g, or t
  misc_feature (53)..(53): n is a, c, g, or t
  misc_feature (74)..(74): n is a, c, g, or t
gcgtggattttgctcccccataatttgtntgagtacnccaaacgggacactgnaaaaaaatcgatttttttgtntcggggcagtccccccgaaccgatgcgcccatatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtacattaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagccagtactttaattctgcgttggatttttgctccccataattgtttgagtaccccaaacggacacttgaaaaaatcgatttttttgttttcggggcagtccccccgaaccgatgcgccccagatttatgggggagaccgaatccttcgggagtagcttccctatagcctgtactttaattctgcgttggaattttgctccccataattgtttgagtaccccaaacggacactagaaaaaatcaattttttttg

SEQ ID NO: 43991 - DNA, 1124 bp, Heterodera glycines
aacttaataatgcatcattctgtgaatgccaatgtcacataaatattaaaagtacttaaaaaacattttttttcaaaaaaatttgaatgacttggaaaatttgcaaaaaataattttaattttacttaaaaaaatgcatttaatttttctgagaattctttctttttgaaataaaattaatttggtccattaggcagaatgaacccaatttccgttttttgtgattaagctttaagcgcgtcattatgcttttcctatttaagggcatgacactgttgcgcatggtctaatgtggtatcaacgaacaaaaaatttctcactttaaaagtattttttttaataaaaaaggtttctgtggtccatggcatgccatcccgaataccagcaaaaagtacatgccgaaattgttgaacattttggcgcaattgatggtgaggaggaagacgatgagcagctgctgcaattgactgcctctgatgtgaacaaattgccgtatttggaccgttgcattcgcgaaaccatgcgcatgttcccggtaatgatgagaatttggtgccacaaattattaaattgccacatttgtactggggatttcaaatgtttcattaaacaaacaaagctagagctccccataaaaatatagatttttaacaaaaaaaaaatgggataaaaattaaaattgataatcattatttgtctatttttaaagcaattaaaaaaaacattttaattcctaaacgtaatgggaattaaaataaaattaaaaataatcataattcaattttagctgattcccatattggagcgtgagcttcaggccgacttgcgcatctgtgacaaaactttgccccgcggggcaatcgtcgccattatgccactggtcattcaccacaacgaaaaagtgggggaaggataaaaaaaaataaaaatttaatcaatggtgaaatgccattggaaaattttgtattttattgcctcaatttgatcaatttttaaaggtgtggccacggcattgggaatttgacccggacaattttctgcccgaacggatggccaaacgtagcccatatgactatttgccgttctctgctggcccccgcaattgcttaggtgtggagcaggga

SEQ ID NO: 43992 - DNA, 1041 bp, Heterodera glycines
agcagagaaagcgcgacgaggcgatgaaggcgatgctgcagccgttgttaatgcaagtgatcagtgctaacggaaacacgccgttggaagcgaatgacgtcaccggcatgttgaagagaaaggcggtgaaacgccctttagaaatgtctgatgccattgccgaggataaagcgtaattaaaatgtgtttctctgttgccattctcaatttttttttttttttaagtgaagccgatgttgaacagaacgcgaagatgccgagaaatgaaacggacggcggaaagggcgaagagcgaccgacgaaagactgtgaagcgaatgggaactgacgcaatcaatgcatttttgattcggaccttccttcaaacctcgaacattcccattttttgttgttttccaaaggttgccttcctcgacgaatatgccacttttgttttatttatctgctcttgatctgatccttatttattttttgatctgatatattctgtttgatcttgattgcaacaatttacgaaatgaaatctgtcaatttttatgttgacatttttgggggaaagaacggttcggtgccagggaagaatgaaagtgaaatgggtaataatactgccgatgatcaccctaaaaagtcgaaaattcatttttgtgttcgacctgtactagagaccggacaactggggtcggagggatcccgactgaatcccgatcaatcccaaagattttttttcgggatcccgctggattatcgggatttgctaaaattctttttttttcttttttggttttgtgccaagtttggttaaaatgcttatctaacatttagaattgatcaattcgattttgaaaaatagggatgggaattatatcaggcttttataaatatttcaaattcgaatatcatgctcaaaaaatagattttatggtcaaaaattagaacatttaacaacattgctttaaatagtttttttttacaatttaaatcaattaatattaatttttgtattttcgcctcctatgatcatttttaacaatttcgaggaaa

SEQ ID NO: 43993 - DNA, 213 bp, Heterodera glycines
gctcgagcaggacctgcagaagctagcttgatggggatcagattgtcgtttcccgccttcagtttaaactatcaagagagggaggggagcggcgcgtagcgggggaggtgggtggcggaagaagaaaagggtggggggagtatgagtatgatggtcaatatggagaaaaagaaagactaaaaggaaatacttattcaattcaaaaatgtagat

SEQ ID NO: 43994 - DNA, 1009 bp, Heterodera glycines
tcaactcaatgattcgtcaactcagccaaatgtcaacgattcgtcaactcagccaaaatgcgacgattcgtcaactcagccaaatgtcaacgattcgtcaactcaatgattcgtcaactcagccacaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagtcaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgacaagtcaatgattcgtcaactcagccaaaatgcgacgat

SEQ ID NO: 43995 - DNA, 1103 bp, Heterodera glycines
  misc_feature (8)..(9): n is a, c, g, or t
  misc_feature (22)..(22): n is a, c, g, or t
gcctgcannggtccaggctatnagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatatttttcagtgtccgtttggggtactcaaacaattatggggagcaaaaatccaacgcagaattaagtacaggctataagggagctattcccgcaggattcagtctccccataaatctggggggcatcgggtttcggggggaactgcccccaaaaacaaaaaaaaaaattttttt

SEQ ID NO: 43996 - DNA, 1240 bp, Heterodera glycines
  misc_feature (1151)..(1151): n is a, c, g, or t
ggggtttggtataacgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatataaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgggggtttggtataaccgttttagaaatagcgtagaaaacagcttcgatatcaagaaaccaagtcaagtccagaaaggaatattttanaacgatttcgttttgttttggcattatgataccgaataactttcggaaatatgggaaacaaattggagaaattcgaataattttttgac

SEQ ID NO: 43997 - DNA, 815 bp, Heterodera glycines
tagagtagagcgggaccgggaccaaaacacggacaactgagtacaactgagtaccgaggtcccggttttgaccgggaccggggacccaagtccgggttttttcccggttttcccagccaaaaattcccggtttttcaacccgaataggtcccggtcccggttaagcccaaaattcccggtcccgctctacctctagtttcgagaattgcaatggaatcatatgtttgtggattgaattgtggcgatggtggaaaaacagcctcagagtttggcattattcgtccacaattggcacacggcagtccgctggcggcggccgttagtaagtgtgccaacagcaaattttgccaaaccgccgccgccactggcagaagcagcagatggttgtttgccagaacgtaataaatatgctccgtttcaaattataaggtcaaaactttgaagacatgtacatatcgttttttaaagagcaaaaaaaaacctgaaaaattcatataagcataacttttatgctgaacaaaaaatcttttacagaaactcgatcagatcattccttcatggtgatctgaaaaccccaaaatggcttgaaatcaggatatcgaaaaaaattcctaggggctggaaaattttcgaatagcaaaaaagtactttatttcttaagaaaacagtgcatttgacagtaatcttaatcacttcgaaattaatcgtacatcgtccggagtctcagcaaacagaagtcgtagagaaatgcggttttttgcatttagtagcaaattttgtgctctttctgtccgccatattcgtcttccacgaaa

SEQ ID NO: 43998 - DNA, 1308 bp, Heterodera glycines
atgaatttatcttagagtaattaattaatatttactctttttcaattaattgctaattaattaattaactgtctaagattgttttgaatttaggatagttaattaaataattaatgactattttaaagtgattttcggtttaattaaaactagggttgttattaattaattgctaataattagtagttatacgtctcagataataaacctcagataattatttaatattaattaattaattaccctctctcagatggttgctctgcctgttgttgcctttgattatgctttccgtgctgttcgccggtgtcattgcgttctgtcgccagtcccgtaaaggtgccatcattttctctggccttggcttggtcatttttctcgtcacatggcttctcttttctgcggcatttccgctcactgtggtaaggccaacaaaaaattaatttaaaatttaaaaaaatagttggaaataatttttagcgggtattttgtaatcgtctatcggatttatgcatttaaaactgtaaaatttagttcatttaaaaaaattgctaaaattttaatgggaattactaaactttttttgaatttttagttacaaatttcaaatttctccaatgaactctcaactatttcacttggattttcaaaatttgtcaaaaaaaaactccaaaaattaaatgattttcgactatagtatcattttaaaattgttattttttgacaattgctcaaattcggcacgaatctttatttgttttttcaattttggcattctgttttctctctctttttcaaaggcttatgccgatttctgctcggatggtcgccctttctgcgcacgcatctcaacgacgagctaattgatgtcatccaattttactcggactgcacaatgcaggagccgaacacaagccctggggcaacatcaaaggcattggggtaattaattattaaaaaatactgtagtcggcttactgtcgggaatactgtgtttcccttgtcatggaaggcatggcggaattaattaattaaaataccgtatcctgggtattttcgtgaataccatatttcccctgccatttaatgaattttcagtgataaattagtgcccggggcactgccgctggcaatgattcgtcaacttagcatggaacagaatgaagctgaacacaaattggaggcactgcttgcacgtctgttcaacggttcagcggaggtaacatcgaaaaaacattttaaattaattatttaaaatttaattttaatttgtttttgagggattgagggtgcccactggctatatat

SEQ ID NO: 43999 - DNA, 686 bp, Heterodera glycines
atacaaaaacaaaattcaaaatatcttaatttctgtcttctgagtgagccatgggaaaaaagtagaaaatcaaggagcctagccactaggccatttacacaatagtcagtgtgctttaaagaatttattaatacttttttaaattttttcctttgacttcaaaattcatcagtaatttttcactcagacccccattcttaccagtgcttgtttttcccggtatgcatataaaaattaataatttgacaccgaaaaaataaatcttttgaattggcaaaacgttttatgtaatttgaaaaataaaacgggcacttgaaaattggaaatcagcgaaatttttatttatgataaaaatatcggaaaagaaaaaaataatataaagacgaaagccattcaaatcaaaaatcctttaaacacttcaaaatcattcaattcgaaaatgaaactgttttccatctgttcagtgttgcaaatggaattcccaatttctcagcaattattttgtcactaatttttggattgttttctttaattttgcgatatttccgcatctttctcaatttgtcctcattcgtatatttattttgtgcttaaaacgaaaataaaaaattaaaaataatacaaaaattttctaacttttatggtattttggcatcaattcttttttccattttcgaaatgtaaat

SEQ ID NO: 44000 - DNA, 824 bp, Heterodera glycines
  misc_feature (744)..(744): n is a, c, g, or t
  misc_feature (768)..(768): n is a, c, g, or t
  misc_feature (798)..(798): n is a, c, g, or t
aattttcaattttttatagtctaatctactcaaaaccgttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggtgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttanatattatctagtcagttcatttanataatttttatccaaaaaatttttttttgngttttcggggcagtccccctgaacga

SEQ ID NO: 44001 - DNA, 905 bp, Heterodera glycines
  misc_feature (658)..(658): n is a, c, g, or t
caaatgatgaacaccagcaatgacaagtcgagatgaccatcagcattcgggaacaccaaaacaattcctctcaaaattctcttatcaaattgacctccaagaaaattgacctcccaatataaagtgaacgaccggcccttccactatcaacggcctacggccaaagtacagtacaactgagttttacctcattgaaaataaaagaaaaatgctttattttactacatcatatataaatttcacccattaaatagtgacttttttaaataaaaatgactaatacacaaatataattttgttcattgtcgaaatcggtcactgtcgtaatcagccactgtcggaaatgtcggaaaacagtaaaataaatgaaaatagttcactgtcgaaatcggtcactgtcgtaatcagccactgtcggaaatgtcggaaaacagtaaaataaatgaaaatagttcactgtcgaaatcggtcactgtcgaaatcggtcattgtcgaaatcagccactgtcgaaatccactgtcgaaatcggtcactgtcgaaatcagccactgtcgaaatttcctggcaccattagaggagttggaaatttattagagttgagcggtaatcggtaattgcaaaaaaaccggtaccggtactgaccggtactgcaaaaanccggtaccggtaccggtaccaactttttcaaccggtaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattcaggttgaccaagttttttttttcaaattcaggacatagaacactaaaattcagatatagaactcaaa

SEQ ID NO: 44002 - DNA, 1190 bp, Heterodera glycines
  misc_feature (43)..(43): n is a, c, g, or t
ttgggtgttcgttttgtaccaaaatgactccgaatagtctgangcaccgcttcctccgcaacatttgtgctgtgcaaagaaaatgctaaacctcatgaaatgggataaacaaaagcttacataaaatggatgggaatccatcagaggtgtcgcctaaagtggcattttgtgggaatgcatttgtgtaaattgtgcgagttcacccatttgtcgcgatggtagcgattttgggccattttactgaggtactcagtcatatcggtgtcatcagggaacttaaaaccaaaaatggagaaattaaaaagtggtgggaaccgctcaattaggcgctggccattttggcgcagaacgaatcatatcatttttatttaccaaccaaattaaatagtcttggtatgattttaaatggcttgatagtgcctattaacctgaaaagtttaaaataatttagctgagacacaaaaaagttatggccaaaaaacctcaaaaaattgcattttctggccattttggtgcagcgcgctatatctctttttaagcctaatataattttgaaattttgcaggctaataaagaacatttagacctatagcttaatatcaatatcatttcatttggttgaataaaaaaaaagttatgaaactttaaacttgtctgcgcgaaaattgcctatgccaaagtgaccctgaccccccaaagtcaccttaaaatgataggcaaacaaaagaataaggatgagcaatttgcaatgtatcaacaacagaagcagcacagagaactgagttcagaagaatgattttttgactgttttcaattgggatggtaatttgcatatttgtgcatattcgcgatttatgtgcatatttggggatttatgcaaaaaatcctctattaaaacggccccctctattagagcgatcattttgactctaggaaccgttaatagtcaaaaacattcatttttagttattttctcaaaaatttaataaaaatgtaattctttaaaaattggaaatttatgccaaaaataagttcaaaatggaaaattttcgattttattcattttctgcaaaattaataaataggctcggatttatagttgctaaaaactgccaaaataattaatttttagtttctaaaaaacccccaaaatagttactaaaaatgggtaaatagttgccaaaaacttc

SEQ ID NO: 44003 - DNA, 1091 bp, Heterodera glycines
tgataattacaaacttagaaacttttcaaagaaaaaatttattaagttttttataagaaaatttcaagaaaaaaatcaaaaaatgtttcagcgtttttttggaaatttttttcttgaaaaatcttagtaattcatcataaatttcaattcattcacctcattgtccgtctgctcaatggcgcagcaaaagtaaagcgaagcgtaactgagaaattaaattatttatttaaaattggttttcaatatggcacaccgtttgtacacaactttcgtgtccttatactcgaggaatgcgcacattttgggcttccgtgacaaaatggtggttaccaactcacgggtgattttcttttttgcctgaaaatgcagtcttttttaacaattttgtaagagctaaagtatgctagctaatattgaacggcaaatgcatttttccggtaacggtaaaaacaaccggtttttcagagatagtcggtcggtaaatctaccggtcacaaaaaaggccggtaaattttaccgtgccgctcaccacttgtttaatctctaaataaaccgggacaaaaattaaactaaacaatcagataattaatcacaacgggctagtgcaattttgccatcacaaacaattagtagtcaaatccaatgtgagagcagccatctaagcaattaaccgctcccgaccccactgtcaatggtctgctcccgctgtgtgtgttgcccaccttgtccggatatgcgacgtaccacttctgcagacggagcttgccctggcgcgagaacagcagcatgtaattgatcatccttttaataaaaatgggcaaattatggtaaatgaaaaccgaggaaaaaaaagggtattataaaaccaaatcgaaaaaacatagacaaacagacgcatgcgccccaagactttttaattatgcaaaattagcttgattcataaaaaatttattgcttcttggacataattaggaactaatggtggataatgacagaaagttccaagtcaaagaagcaaatttttaaaaagacaaatgccaatcacaatggaggcataaaattgtttcatcacagttcacaatcagcagtgg

SEQ ID NO: 44004 - DNA, 1292 bp, Heterodera glycines
  misc_feature (59)..(59): n is a, c, g, or t
  misc_feature (68)..(68): n is a, c, g, or t
  misc_feature (80)..(80): n is a, c, g, or t
  misc_feature (104)..(104): n is a, c, g, or t
  misc_feature (133)..(133): n is a, c, g, or t
atcaaaagtttatcgattggattccactcagttcatgccattttttctaaatttcatcncagagtccnttaaaacaattntaattgcctgtctctgtgttcttngcgaattcgggtcccgactcgggactctntgaaatataccctggaccaccaggcatttatctcatccgtgttgggtttgagatttttcacaattatcaagccctttttacttggtcctaatttcgttcgtctccttatttttttgattctgccaattgttaggctgttgttgtacctctccaatttgacaggtgacagtcgacgcgatggagcgcctgttgaagagttgccatggctcgccgtcgctgaaccaattcattgagggctatttgctgatggtgcaaaggctgctcgagacgaataatgcacatatggaaaagctggcaaccggtcggtgtgtaatttgggcgaaaaattgaaaattcatttctctctcaacaaatttaatttcataatcaaacacaacttctatagtttttcctcggggtcttatccgcttttctccgtcggcacaacgcgggaaattttgattgcaatttaaccaaattcttttaaaaaaaattaaaaagttttgccaccgaaaaattttaaataggttttacaactgaaaattacatctttattaaatttgagaaaatagtaaattattagaaaattgacggttctatgtcagttactcaaaccccaacaaaaagggcgttactcaaaaatacatttgacacttttttaaaatctgtctttttttgcttagatttgtttgagcgcttctccaccattgaggaggactcgccgtcctaccatcgccaatacgactttttcatctccaaattctccgcaatgtgtcatgcacaaaacgatgtgtacgtgagctcacagcgctacaacggattgcgcgggttgagaggtggcctaacaaaaaaaaattctaaaaaattttttgaaaaaatttccaattttttactatttgaaccattcatttttaggtgtcatttggaagtcggcgtccgatgatttgcaggccaacatctgggagaagcagcacatgaacaaaattgtgccctccattctgttcaactttcaacatgacgacgaaagcggtgggcaatataaatcatttaaatgccgtgcagaaaaagttttaactgttttgaaatgtccatgctgcacattccatccttcgcatcatcattttctccctaccaattaaaaaaaaccaagcggtttctagtaaaaaaattgaaaattttt

SEQ ID NO: 44005 - DNA, 990 bp, Heterodera glycines
ttgattatctagtgaaaaagtgaagaaaaactacaccctttcacattgccgcccaccttttggcccattaaacattgctgtaacacaaatttaaatttttaattttataaaaattgaaaatttggaaaatcaacaaaatattggtccctacccgacggagtgaccgtaagcgaagcaccggtacgatttgttggcacttggagttggaaggccacaacggcgccagcggaagtgccaagccaaaggcacaagcccaattttggcactaaattttttgaaaaattagatttttggatttttaaattttaaatttttcaagaaaaaatcttaaaaaatttttatgagaaaaattcaaaaaaaataaattaaaaatgtatcagcgattttttggactgaaaaaaactgtaatgcatcataaataacgctaaatctttttttaagttctttttaaaaaattattaagaattttttttttaattttcgagggaagaaatgagcgggtggaaatgacgaggggggggggggggggaacgacatgcttcaaattatttttacaaaaaaaaattaaatttttaagaatttttctgacccaccccttctgatcgccggtgagttgatgaactgaaggctgcacacgtgttcttcctctccctgatcatcttcaccatcacccgccgattgtcctgcaacttttgctgcaattttgtgctgctgcttttccgtgcaggcttccgccggcggggaggaagggcgcgaatcgctgcttaaacgcccttaaaatgcaaaattgaattttttaaatgtccatcttaattacccattttatttattaccgttgcaattggtggacgaatggtgtttaacgaggccggcactttgtggtggcgatgttgtgccggcagcgccaaattcttttgggcttccgtcgccgtttccgcttgagctttgagtcggattgaaggtgaaagcctttgaaaatttggaaaaaaa

SEQ ID NO: 44006 - DNA, 1100 bp, Heterodera glycines
gggggggggggggggaagggcaccccccccccagggggccgggaagcgagtgagtaccttcggtgcaggaaaattattaaattttaaaaatttttaattgctttttaaatatgccaaaaaatgtaggcttacttttttagtgaaaattcgatcactcatatttttgctaatgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcatttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagag

SEQ ID NO: 44007 - DNA, 914 bp, Heterodera glycines
  misc_feature (82)..(82): n is a, c, g, or t
  misc_feature (90)..(90): n is a, c, g, or t
  misc_feature (104)..(104): n is a, c, g, or t
  misc_feature (127)..(128): n is a, c, g, or t
catgaaaatgtaaatggagattatgggacttatcagctcggtccttcgcaaacactgattcagtttatatttagaggataanggagtganaatgggtggaattnccaaaaaggtgaccaagaaaatnngtatcgaaatattattgacgattatcagctcggtcattccgaaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacatcagatttactattttcgcgaccccactttttgaat

SEQ ID NO: 44008 - DNA, 1138 bp, Heterodera glycines
  misc_feature (1014)..(1014): n is a, c, g, or t
ttttgatatgtctaatggagtatgcgacgagctctggaatgatctcaaaattgatggatgtgggtgacaaagaaaaaaaagtatagatcaacaaaaactgggctgggccgaaccgtgcgggccgaaatgagccggtccggttcattttgtttccaacgttcagtaaagaatgggtcataagtttgaaatttgcggaatgccttagaaatatattcaatttcaacattcagaatataaacaattttttgtcaatttaactttttgatttttttcacaaaattagaacatcagcagctgttggctaacccattttcagctgtgtttcaaggatatattctccatttttgctaaaattccattggtttgctctcactttgtttatttatcagtggcatttttgcactttggcaatcgaaagggcgcggcattgggtttgaatttgtcactgatcacacatattcttggcattttgtcttcgtctccgtccgtccatcggtcggtcggttcggctccttctcagtgcgcttatccattctgagcaatgttcacattcgcaatgtttattggcacccagcgctgctgttgcggactccaacgccattgctgttgctgccgtttgacgcgcttcttaatgagtcaaaggcaaaaatgccaaaaacggaaattagaagccaaagcatggcgcaccatgccaccgttgtcggccgcgtccgcatcaaaagggttgttggaattagcagagacggcagcgaccaaagacacctgaagcatggcacttttgaccggtgttcaatgaatgcttataaaagtgcctaccaaaaggatcacaagcaaagccagaggggcaaatttcataatgagctaatgagtggggatttggttggttttgattgaatggtgtggacggcgtgtgcttttgccttcgtttgccctcccttttatacggcaaattgtcaaaaatccaattaatattcatcgcatgcaaagagtgaataacgctgggattggccgagntaaaggccaagctggccaaaaaagtggtgaagcttaccatttgtgaacttacaaattattgaatgagtgcggagccgaaacgaacaaagtgatgactggtcgcgaaattggcatcgtccaaagg

SEQ ID NO: 44009 - DNA, 641 bp, Heterodera glycines
gggcgttatttgaaaaatggcactttttgaattttaatacaacccaaagggggtggctaccctttaagtttgaaaaaaatttttttgtcatggttagtcatgaaaatatgatccttggagttttggggattgctgattacaaatctatcatcttaaaataagtttttgcaaactaaaagggcccctgtggtttttaaaactgacacttttttaaatagtggcaaaaattgctttttcagaattctctatcgcataaatttttttgatttttttttgcaacagtcgtgctgacgaagatcgccgtgagcgggacaggggacgagaacggcggaagcaacaccaccatcatcaccatgaacaccaccatgagcatcgacggaaaagtggacggagaggaggaggagagggggagccaccgccgggcggctgggacaagccgaaatgggaggacgacgcggtcaaaaaagaggcggaggaggggggaggagaagaagcggagaagcagcaacagcacaggggggagggggagaaggaaaagccgtcatttgtgcccagcgggaagttggccaaggacaccaacacgtacaaaggagtgttgatcaaggttcatctccgaatagggaaaatttgaattccttttt

SEQ ID NO: 44010 - DNA, 1605 bp, Heterodera glycines
tttccagtttttaaaattttgaaaattttcaaaaattttcgagttaggcctaaaaacggttttcgggtttttgattttaggaatttttaacgatttttctgggaaaaacggagaccacttccaaaaacatcatttttcgagttctatcgactggtaattttttggaaaaatttcgtttttttcccggaaatagaaaaaaattttggcctgagcgggacatttgagtcctgggcccataactcgtcaggggttgattttagcgaaaaattgtcttagaacatttttgtagagcattttaaatgctattgaatggtgtactacatgatgtaaaattttcaaaaattttcgagctaggccccctagaaattttcggaaattttttttcggacgaaaatgggggtgaaaaatatttttctggggtaaaataaggtactgagtacgaatatgatgtctattttaagtttcataatttttggaattttttaaaaattctttattttttggcaattttttggccctcgggattttggcctaatatttgaaaattcataacaaatcgaagggttgatcaattttacaggtataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaaataaaatactacaaaaatccgcagttttttgctctattatataaattttatttggcatttttatcacttttttaagaatttttataaaaataaaagtgattttgagattcgggaccaaaggggggagcataggatttttgagttgaaaattttttcaccaaaaatcttccaaaaacatgtcattagggctaatttatgacgctgatcacgaatacgtgatcagattttacttttgacatcgtttagacctcagaatccctgtgtgattggggattctgaggcatcattttgagggggggggggggcaagttcgaagccgggcggtgtacattatttttctatttatttttgtgttatttttcagtgcgtttaatttatatttaaagatttgttgcaaattaataataaaagaatttatgtaaaaaataataattatgttttaataaagaatttcatattatttttaaattgaatttataaaaattaatttcatattaatttaaatattcaattcttgtacatttcaaaattctctttttaattaataaaaggaataactaagtttattttttaaaatttataataaattgctttcaatataggagaaattcagtaccaactttgtccagttcagtcccgggtgaataactcattagggtttgaactgagcgagggggtgccagcagacttattgtagagttcaatgagctggatttttccagtttttaaaatttcgaaaattttcaaaaattttcgagttaggcctaaaaaacgtttttttggtttatgaattttatgattttttaacgatttttctgggaaaaacaaagaccacttccaaaacatcatttttcgagttctatcga

SEQ ID NO: 44011 - DNA, 721 bp, Heterodera glycines
attaaattcccaaaaaatgacaattttagagtaaaatctttcgcccccgggcgtcaccttttggctcctccggcgggtgccttccttgaaaattactttaattaattaattttttgtaattaacaattatcactattaactgaaatataggaaataaaataattaatgtttgttttttacttggttgaccggcgcaaaaatggcacgacagcgcacataataaaattagaaaaataaaaatcatattttgcaggttgagcttattaaacgtaataaagaaaatatttgcataaattggcaaatgaatgctaatttgtaaggcattttatagcgatgtgaaaaggctaataaatgcatttgtgtaaaaattatctgacggaaattaaagaaaaaaaggctggcaccgggattatgtggaatttacaatcacaaaatattgggatgcttcataaaattgccataatttttgccaaaagcatatgaaaatcaccgcactttttttatttttatttttttgccttgcattattttaagtgaatattgaattttatgagaatattatatttaatatagcgaaatagattttatatattgtgtaagtattaattattattttacaaaaatctcataattttattttacagttaatgaaaatccattatttaaaatgcttcataacattagactgaatttttaaaaatatatatttgccacattttaa

SEQ ID NO: 44012 - DNA, 517 bp, Heterodera glycines
cgataaaaggctacaaattcttgcttatccgatgctgaaaatttgaataatagagggatctggcggtgccggtagaaccgccgtggaaaattttgaaaattcgagtacaaattatgataaattctttaaaaaacgcaaaattgtttcaaaatatttgttaaaagattttatacgcaaagcttcggctataaaaattaaaaagctaaaaaagaatttattgactcaagatcccgcgaggaactcgcaattttaaatgagagatttgcggggtcttcgctgattaatcccgtaaatccagttcggcagaaaatttaatcccaatcgtcaactttgtccttaaataaatctcagcaaactgttactataaggttggctttatatcaaattacctctatttgatattaaatttttaatctggaatgccatgactagggatcggattcttagttttttaactattttttctgcggctttaactcgacgagaaatgcacgaaaaacacattctttttcgaaaa

SEQ ID NO: 44013 - DNA, 659 bp, Heterodera glycines
  misc_feature (597)..(597): n is a, c, g, or t
  misc_feature (604)..(604): n is a, c, g, or t
acctaatggatgtttaattaccgtatatgctctaattatagcccagtctctattaatcccgcagtctccaattattccccagtctgtctacgaggtgttttgaaaaataatccctctatcataatcccccagtctctaattatccccccttttctgaggaggttgaaaaataatctcccatgggctataattagagcatatacggtatgcaattcattgcttgctttttaaacatttgatatgtttaggtcaatcagcaccttaagaaggcgcctggaagtcctaaaattgaaaatttggtaagtcaacctttggaaatgagatgattttatttcggctcattgacacacgtttcgtatttcgtgttaactcgcaggtcggatgccacacgtccaaccaatacataaaaaaatatctatctgatttcaactataccttagcccaacttttctaaaatctttaaaaattcaaatatctttgatccttaactgcgaattgcaaaataaactggcaaaggtatagattattggtccgttccgaaaatttttttaaataaaatttgaaaaaattgtttttaggggtaggtagtcttaggcnccgagcncgaatccggcattattagaaggtttagaaccccgaacccggattcgaacaaaagt

SEQ ID NO: 44014 - DNA, 1493 bp, Heterodera glycines
  misc_feature (411)..(411): n is a, c, g, or t
  misc_feature (1445)..(1445): n is a, c, g, or t
  misc_feature (1456)..(1456): n is a, c, g, or t
ctccgatgccttccctatcaaaaagggggagaaaaaaaaatttaaaaatttttattgctttttaaatatgggaaaaattttaggtttactttttttttataactggtcagaagcgaaccagattttgcggagagcatcaaaaagacaaagaaaaagcactgctatgatgctaactccaagtatttctgaattttaaaattttttattaatttttaaaagcttcactattttatttttttagcaaaatccattcataaatattttttcagaaactgctttgaaacgcaccaaatgttaattaaaagttaaataaggctctctgatgctttttctatcaaaagggagatgaataaaatttttaaaaatttttaattcctttttaaacaggccaaaaagtttaggcttatattntaaaaagtttcatcgaacctagcgcactaaaatcgatataatctctccaaattttgcaggccttctccattgtaaaggactaacttaacctgaaaaaatgccaacgcttgttgtttttaaaatttttcaaaattctgactttttcattacttatttattttttgcaaaattaattcataagtattttttcagaaagtgctctgaaacgcacaaaacgttatttaaaagttaattaaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatatgggaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccanattttgcaggncttctccatttgtaaggactaacttaaccctgaaaaa

SEQ ID NO: 44015 - DNA, 1431 bp, Heterodera glycines
  misc_feature (1419)..(1419): n is a, c, g, or t
tttactaaatgttgttgaaatattttttataattatcatttcaataaaaatgtgcaacaaataaatgggtgaaatatgcataacaataataataaatttactatttttttctaaattattaaaacattaaaaaaaaataaataatgcttatgaatttgaacaaatttatataatttaataaggaacaatgaacaaaaatattttgtaatgtagtggaattgattaaaaatattattttaacactgttttattttgtttatttggccaaaaagaactttataaaaatgataaataaaaccaatcacacaagttggaaaggtcatttgtaaagggatcataaatgaaaatgtaaattacctttaataaaagaataaaaattgcaaaaaaaaataattagaaagtagtaaactttaaagcttaataagttttctatctcaaaaataaatgacactgttaattaaaaaaaacaataaatttaattactgacaactgtgaaagtgaaaattaaaaataaatgataaatacttatgaaactaagttaaaaatataattgatggtaaaaaaataaaatttatacccatttgatattctgctcttgggaaaatgtacaagataaatataagattattgactataaaaattaattttattcttttcattattataaaatattttactaaattaaaaaaaaggaatttagcgaatagcatcgatgctttttgccaatgaataccaatttttattaaaatatatcaaaggtgttttcttgtctagacttggttaatatgaatgaaaagatagtgataataaaacatctcttctgcaattattaatagtttttgtaatttttcacaaataaaatataattctttaatagaaaccagcttacagagcaaaaattgctgattcttttattatgtgaatttacaaaataatatacaatatagaaaagggagttctgaattttttgaaatatcaaattttataaaaaatttctcgaataaattaaaaaaaaaaaaattaattttaaggatacaaattccaaaagaacatatattaattctcctgattattttctatttttaaaacattgtacattaaatttataaaattgatcacactgattatttgaaatattaaaaagagaatattaaagtagctaataaaggcatacaaaaatttaaaatatattttattagttgatttcattaatttttagttaataaatttctagttcccagtatttttttggttaaactaatttataaattgaatcgttggctaaattttaaattaaggtttttattaattttttaaattcaattaataaatttattgcaaatttgattttttaaaaaaattaattaaatgcttaagattccgatatacaacaaccatgtgaaagatgagacctgccanggcatgcaagct

SEQ ID NO: 44016 - DNA, 746 bp, Heterodera glycines
  misc_feature (12)..(12): n is a, c, g, or t
ataatgtttaanttgtgagtattatttaacgaaaagagcgccttagggaaaggaaagaacgaaatgagtgaaatgagtgagtgccattgtaaaagtgagtgagacaatgccaattcagtcactcgtcgccctcattttttttatctatgccattttctaatactattttttggggggaaaagcaaattcaaaaatattaaaatgattacctcatattttcgccaaaaccgttccacaatttcgccaatgcctttcttcgcattttgttttcgttgcccccccccccccatcttccgattattaataattgtcatttcgtgaccgtaagggccattcaatctctgcgcatgggatgatgatacgataccatctctctccagcgccgctaatagtgctcaaattgggaggacaatcgctgctccgtccatcccaaatgccccccccccccaccccctcttttccggtgacatccctcggccacaaaacaacacacctttggccgcccattatccctcgtcgcaaatggccaaaacagacagcacagcaagcattcagcccaattcacccacaacctcttcatccgcccccttccgtttaaaatagggatggggagagaaggcaaatccattagaaggcaaaggcgcccgcctctcttcccccccccccaatcgcgaaactcttccatttcctgcggacgatgagtccatcttcatcatccatgcatttattgcgtgtcgtgtcactcc

SEQ ID NO: 44017 - DNA, 1774 bp, Heterodera glycines
  misc_feature (26)..(26): n is a, c, g, or t
  misc_feature (111)..(111): n is a, c, g, or t
tccatttattccaatcgcctatgctnttaaggttttgtctttgactttgcttttttgtccatttattccaatcgcctattgctttaaggttttgtctttgactttgctttnttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatgttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggctttt

SEQ ID NO: 44018 - DNA, 1179 bp, Heterodera glycines
  misc_feature (823)..(823): n is a, c, g, or t
agaataggtacttaaataggtaaaaaaaaatctcaaaataggtattaaataggtacaaaaattccaaaataggtaccaaaataggtaaataaaaatttttattgacgattttttagtggaaaaaagcaaacaaagagggaaaattttggttctacatatctctttgtaaacgaaaatttaaatatattaatattttcttatattgacattttaaattaaaaattttgtcaatagaaaaaataaataaattttgggataaatttttgagaaatttttccaattcttagggtgcatttttgaaaatttttttggtcgattcttatgggtatatttttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattgtaggtatttaactaaaaatcgcatccctatttatcacaaaattttgccaaaatacctttttgtaagaaacttttggctgggcctttacgacaaattttgggtaaaaacaattttgaagcattctactaaacaaattctaaaaaattttctcagtgatgaaatgatcagtgacgaactgaacagtgacgaaacgatcagtgacgaaatgatagggagccatatgagttatttaagaaatcagacaaatttttcgtgccaggtgatttcgacangtgagtgatttcgacagtacggtaaattgaaaaaaacgagtatatgaaaaattggaacctaaaatgaagtggtatgagcacgttcaaagataaatttaggattacgattttcaaaatcttcgaaggggcttgtgggtcgtgattttgctctcaatgtcacaattcatttataatttttcacaattatttcaataacaagtataactttttatgtacaagtcgtagccctaccattcaaaagaaaattcggtagaaaattttgtgctctttaaaggagcttattcaaaattacctggaaaatttcccaactccctatgaattttttttctaaaatttcagcgaatttcaacggattt

SEQ ID NO: 44019 - DNA, 935 bp, Heterodera glycines
gtgaatcacaagaaaattcaacattggggcttaaaatccggagaaaagtcaattggtgcaatggtttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggtgcaatgtttttgggatttacctatagaattaaagaataaaactgacaacttattaactgaaaattataggtgaatcacaagaaaattcaacatttgggcttaaaatccggagaaaagtcaattggtgcaatgttttcgggatttacctatagaattaaagaataaaactgacaacttattaactgaaaattattggtgaatcacaagaaaattcaacatttgggcttaaaatccggagaaaagtcaattggtgcaatgtttttgggatttacctatagaattaaagaataaaactgacaacttattaactgaaaattataggtgaatcacaagaaaattcaacatttgggcttaaaatccggagaaaagtcaattggtgcaatgttttcgggatttacctatagaattaaagaataaaactgacaacttattaactgaaaattataggtgaatcacaagaaaattcaacatttgggcttaaaatccggagaaaagtcaattggtgcaatgttttcgggatttacctatagaattaaagaataaaactgacaacttattaactgaaaattataggtgaatcacaagaaaattcaacatttgggcttaaaatccggagaaaagtca

SEQ ID NO: 44020 - DNA, 1387 bp, Heterodera glycines
atgggatgggacaaactttgccgcagaaaatttctaatattttttcttgaataatttctaaattttatatttttaaaagaattttcggcttcgagattttgggatgcaccggttttcgagatttttttcaaattttcgaggcccttacaacttatgtttttcgccatcggaccataaaataaaaattcacaatagaactcagcccaatgaaacccaaatttatttatgttttttttctgaataaaggactgtcttgaaatgatgtatacaccatttttggggttttaaatcaaattaaattaaattgcgctttcccccagggaactgctcgcgtgccgcgctacgccattttggtggacgacaacgaatattcaatggacaaaatccaacagttcacattcgtatgtccaaataaatgtttgattgatttggccatttctttttaaaggccctctgttttggacaccaaattgtctcttcgtccatttctctccctgcgccggtcagttggactttaattttcatttgcattttaaatatttgtccatccaattttcccatttttcctttcacacaggtgtacattgcactggaatacgtatgtgtaatatatatatatatatatattctcttggacattatttctgtttcccaaagaggagaccaccctaaatttctgacagtcatttcccagggacggtcccaggatttcggcttggacggggtaccacacccgggcgacgattttttttttttttttttgcttttccagtcctttttttgcgatgcacttttggaacaaaattctggggaacgcaaggggtacgtcgccgcctgaaaaaatctgaaatttttacttttttaaaatagattttgcaccaaaaattttttttttttttgaaaaacgggtggacgaggtattgaagggagtggtaccaatcaaaaaaaagaaaacgatactttttagctatattttcgcatgacatcatcgtcatcattttgattgttttttatgtgcttcacatacaataatgttttggctttttaggccaaacgaggccgcaacaacttcaacacgaaccagcagtcggctgaggcgagagcggaagactgggacaactacgacacactgaacgaccatttggggttcgagaacaaaacgtatttgagcaaatggcgcgtcaatgcctaaggggcggatcgaacgagttttttcaaccaaattaaagtgattttttccctttcattattatgtacaaatataaatcaaacatttactctttttcttaacttttcttttcctcctttctcatttttcttttttattgctcattattctttattattacgacacatttttttgtttttgctctctcagcaaatcttt

SEQ ID NO: 44021 - DNA, 496 bp, Heterodera glycines
agacgcaagcagctgatgtactggtcggccttccgttgctccaaaagcacctccgcttgacgacaaagaagccgttcatcctaaaataaaaaagcattcagtgcattattttcaacgggataaaaagaaaggatgtacagtcggagaaggtcacttcccgtgcttcattaaaataaaatttaatttttctggaattttaatatttttaggttaaattagaccaactagcaaaaaaagtttcatggctagactacgccttgtatattgggaggggtgggaaagaatgggcacggctttacagggatgtgggagcaagaatcatagttgaggtctttgagggtttcgagtgcaagttcggactggtccaattgctgaagaattgttgagaggttaatccgtgcgtcgatgtgccccggttggaaagagatggcagtctcatacgccgttcgtgcaagcccaagttgaccaagagcctgcacaaattatgttggaatga

SEQ ID NO: 44022 - DNA, 890 bp, Heterodera glycines
acaacgaagaatggttgggatgaaccgattggattgggaaatgcattttaaagtggtgatcggaattggaatgctaaacagcaattgctaagtgaaacgattggttggaaatgccgtttcaaaaggagtgccctttccctttgctcagagtgatcaccgtccaaccgaccgtcatcacattcagctcccgtgcttccgcggatggttcgcactgatcgatgagattctcgcaaaaatcgacgccgacgccggaaaggccctgctcagtctccaggaacagttgcaggtcctgtcaaagtcagcagaatgtttagatggtgaggatggtcaaatcaactcacatttgtgttcaaatagtctttgttggcgtagcgtaccatcaaaaagtaaatttcgggccgtgtggacatgtctttgtaagcttcgatgaattgcgcctcgtctaagcgtcccttttgctgcagttgcgcttccccgccgttgttctgctgctgctgtgccgcgctcgtcccaatttcctaaattttgccaacttttgttttcaaaatgccgctttttgaaaaatattggcatttcgccgtttcggtctcccaatatttgttccgaaatttgcggaccttcatttttttgctgattcgatttgtcaatagtcgcgtgttcagagatcggatcagtcgcatcgccgctttttcgctgattgttccctttttgtccgcgtcagcctcccgaaatgccgtggccaaccatctctcacgcaaatttggcggcactggtgagatgcttccgctcgcggtggtgccattggtgccgggcaccgttccgctggccaatgccattaatccggtgacccacacattggcatcacccgcattaagcgcaatgagatccaa

SEQ ID NO: 44023 - DNA, 1317 bp, Heterodera glycines
  misc_feature (683)..(683): n is a, c, g, or t
taatcagcaccgtttttttcaccccagtgaaaaacaacgtttaaatttttaagtttatttcccgtcgggaccgcaattctacacctttgcctaattttttgaaacaatgaatttaaaattttgtgtgctagtaaatgatactgagaaagccaacctaaaagccagcaatcaactcgctctctccaaatttcttcatactgtatgtaccaaagattagcaaaaaatcaaatacggactacgcatgcaaaattggaacagcaaaaccggaatttagaaaaatcccaatgttaacaccacaagtgtgataaattaaacaacaaaagtttggaatccaattctttcaaagaaacaaaaaaagaaacaaagcgaagtataaatataacatccgcaaaagatcatcgtcagagaaagaaacacggagaaatgttcacaatcttcattattcctccacaatgtagcctccgagctgttcttggtacacctaaacaattaatgaaaaacagtaaggacggcctcgtcatccacctatccatcaccccacatacttcaatgacgtcgtcctcctccatttcaagtgatttgggggtgtcgtcgtcattgacgcggcggccatcgaacaaaaagcgcaaagaagtcacctaaaaatgtggacacaatcagtgtattggtaatttatggatggnggtgggtggacacccctgtttaaactttaaagatcccaagtctggcaaacctggacgccagtccgctcggcgtacgcctttttcagcttgcccatggatgtgccgtatttgacccggaaatgcacttcatttgagtcctaaaatgaacaattaaaaggtttggtctcgccataacacaaagaaaacagacctggccaacgaccttcagtttgatgtactcagcaggctgagcgcctccagctgcaccggttcctcctgcgtttgttccactttcgtcggccattttgaaaagaatggatagaaatgaagtttaatctgctttaaaacattttaaagatgtacttgaagaataccatagataaaaccaatgattctgcaaaacccgagctcagacaactattttggaaccaacacgcttgctatataatttaatatggcaccaaatataatttgtgtagacttttgccagcccaactcaaattgatattagagacggcatatacaaaatgcgtagccgttagcgaaattttagatatttgcaatttaattacttggcattttaatatcaatttgcggaattttttccgctattcaaaaaaatgatgaatattaagattaacagaacattatggcg

SEQ ID NO: 44024 - DNA, 1176 bp, Heterodera glycines
ctcacttcttccatctccctcatatacaccgcttttgctctcaccacggccgcgagatgattggcttcagcggtggcctaataaaaataaaagcaattggcattcataaggagggaaagcatcaaaatgcttacatttagaattgtcttcggttcgggcatttcagccttgctgaacacctcgaaataagcctaaaaatttgaacttaaatatttcaattcgacgcgaaaaagggcacatttatgtagccggcaagctctcggcaagtgatgggctgaccgccaatttgtttgacgaccaaattgttggggtagaacacatagttcgcaagtgaactgagctgtgccttgaagtcgagttccattcctaaagggaaaaccaaaatgctttgaattcagtggacagacaaaaagataaaacaataaacacactgtcaagttcgcctcggtagtgtggatttgtggcaacgtagcggccggggtgaggcatcaaaaagcagcgaatgttgtcgaaagacgagcgaatgtgacggcgcagctgccgaagttccgggtgttgacgggacgtaacctggcaaaattaaacatattttttaacaaatccatcgacaagccgtgaataaaatacgggggaactgatcctggggatgtagtacatccgtttacgcatccgattttatatactagtcaaattgagtacctccaatcgtttgtcaagaatgcgttggccaccgattgagccgtactccgcgacatgaggcacactccagtcacggacaaggaacaaaagcgactgaaattgatgagagaaagggtcaaccaacaaaaaagagcattgcctggaacggtttgctctttttgtcctcgtccagcgccagtcgggcgtactctgtgaacagttgcaagtgctgcagatggtcctcctggatgttcttgttgatgttgaaaatctgggaagcaaatgaatggaaaacggatggaattccttaaattttattcaaaaattcttttcagtttaaaacctgaacagaggaaaccatcgtggacaacgcgaaaacggtggcgcaatttttgaaagtgctgacactgtcgaaaatgccttgtgtgtccatgaggaggacaacgacctggaaaatcatcctaataaagacagaccaatgaatttctagggaattaa

SEQ ID NO: 44025 - DNA, 449 bp, Heterodera glycines
agtcccctcctttccatactaaatacagtaattactaattggtaaacactattatataaatactgtaatgggtgcattttttaccccaaaaattgggcgatttgatcagcgatgagaaaagaatgctgatcgactgattgactgactgaccacctgctgctgctcccctctttctcttgtttgtcatttcccctcccccgggcgctgttccatcgaggacatcgatcaccgccaccaaagccaccaaaagcatatccacccatccgatcgggagggaatgcttttttggtggccggcgatccgccgattggctctgctgatcggcggctccaaaatcaggaccagatggacattgcccccccatcgaaattattattgaaatattctttctacagtaaattttgatgatgatctatgatcactatatttattttaattctaatgccttt

SEQ ID NO: 44026 - DNA, 1220 bp, Heterodera glycines
  misc_feature (46)..(46): n is a, c, g, or t
aagcaaaagtccaaggtcggtttctttctgaactgattccaattcnaattagggtatctgtcccttttccattggcttagccttcgcgtcctttgccccgtaatgaaaaacggcggacccgagtttctcatcctcccagcgacgtccgtccccgccaggcaattcgttctcctccacatattccgttggaataattttgctgctcgcatcggggacatgatacctttggaaatcattgtaaaacatggcaaaacagtgccaattcacctcggcaccttaagcacattccccgcctcgtcatattgcttcacatagtgaagcacttcctttctgtacttggcatccaattgctctcgtttggtaagcctgaaaattgagtttgaaacttattaaaatttcacttatgttttagtaaaatggaaaatatgtccttttcatttaattattttgtcattcgttcgaaataaaacctagatttttttaatgagtagaaatgcacccataaataaattatttgttgaattgcacttacttttcattcgcaaaaatagtctcatcatcgtgaaccttcgcctccaattccatgcgtttgtcctccttgcgcttcgccaaataactcttccgactttcgtatctcaatttgcccatcatatcgttggcttcgtcgtccttttctgaaatgttcaggcgtttcgtcgcctccgctttgctcctcgcttccgactttgacatgacgtgccgcgtgttgtgcttctccctttcccttatccttttggacagtgcgtcgcgctcttcgatgtccttttgggcttcctcttccattttttcgaaatcggactccgaattttcctccttcgccccattctcttgcaattgaatagcctttaaattttaataaaatcagttagagtgttcaacaattgcaatataattagggctcgaaattgtatggatatcatattttttacgcatatgctatgaagaaaagggctcaaaaatagcatttctgcattaaattttttggtttggtgaaggtttttggtccatataaatccatattttgggggttttcgggaataaatccatattttcgccattttttgccttgttaagcctaattttttgggccattttttggcaaattttccccaggaaaaatgagaaaaaaagcaaaaaatacaattttaaagaatactttttgaaaaattttaaaaaaataa

SEQ ID NO: 44027 - DNA, 1518 bp, Heterodera glycines
  misc_feature (1365)..(1365): n is a, c, g, or t
cacaaagggcggacacgggaccgaaggggggtcacaggcgcggaagccaaatgcgccaatgtgtttgattgggagccgacaaaggaattggcccagcaaacgtacgaccaaattgagcgatttcgaaagtatttggacaaacccaaaatacggtaaaaaatataggaaatctataataaaaaataatgtaataatttttgtatagaagtgtgctcgctgttagcggaatcccaatggggcaacaggtggcggcgatcaacgccggggtggacattctgacgtgcacaccgggccgaattcggggccttgtccaggagggccaagtcgagcttgaccaggtgaacacctcactccatcttgcaaacattctgtttacatacagatacgttttttcgtgctcgatgaggccgattctttgcttggtggccaaagcgactcggcccaaattgtgcacgaattgcactcgcgaattcccaaatattccgaattcggtgagcgtttccaaatgatcgtttgttccgcaacacttcacaacatggcagtacaacggctggcggtgggtcgataattcgtatattcccaaaacataaaaatgaatttttttacaatcagactcagtatatgtacttcccccaatggattgatctgaaagggcaggattcgattccggaaactgtacaccaggcaagtctaataaatatttattcatttacacttaaaatggaaaattaaggttgtctgtatggtcgatccatgtgaggacaaaagttggattcggcttcgttcaaagcctggccaatcagttcaggtcactcgcactttctccgtcttttttctctttattctcactcctcttctctctttctctctctctctaactcccctttctccttgtctaatgatatgtccttgccgtcgctttgtaagaccgattctgtccacgcacgtgatcagcttcggcccggaagcgacaacccagaaacactgtcggaggcggtcaaagtgttaaaaggggaatatttggtgaaagcaatcgaagagcacaaaatggaccaagcgatcattttctgtcggttcgctttactgcaaaataacttggaagagaagtgggataagaaatttagaaccaaattggactgtgacaacatggagaagtttttggcgccacgcgggtacaaatggcgtttgtttgcacggcgaccgaagcgcggacgaacggacgcggaatttgctttcgtttaaggcaataaaaagcaatttctgctgtacttctcaacaattgttttaggaaaagatagtgcgctttctcatctgcacggacgtggcggcacgaggcctcgacatcaaaggggtgccctatggtanaggaagcggataacttgcccattttccatcttttacagtggtcaatgtgacattgcctccggcggaagaaaaggcgaattacgtccaccgaattggacgagtcggccaagcagaacggtcctttgaagcattccaatgttttttcgactgaca

SEQ ID NO: 44028 - DNA, 870 bp, Heterodera glycines
tctcagaagaatagatattctcagaaaaatggctatctttttttttctacaccgttgtacatgtgggggtttccccaaaaacgcattactatctgcggttgagccctacaaaatgtcgggttgaaaattgctttctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaaatggctatctctttttttctacaccgttgtacatgtggggtttccccaaaaacgcattactatctgcggttgagccctacaaaaggtcgggttgaaaattgctttctcagaagaatagatattctcagaaaatggctatctctttttttctacaccgttgtacatgtggggtttccccaaaaacgcattactatctgcggttgagccctacaaaaggtcgggttgaaaattgctttctcagaagaatagatattctcagaaaaatgggtatctctttttttctacaccgttggacatggggggtttccccaaaaacgcattactatctgcggttgagccctacaaaaggtcggtttgaaaattgctgtctcaaaaaaatagatattctcagaaaaagggttatctctttttttttacaccgttgaacatgtggggtttccccaaaaa

SEQ ID NO: 44029 - DNA, 1111 bp, Heterodera glycines
  misc_feature (12)..(12): n is a, c, g, or t
ttctaatcctcnggctggcactaaaccccccccccccccttcccgggggagggttgtgttatccggcaccgatttccgccttctcttttcttacttttgctcccgtcgcgccttttgaaaaagtgtctcatctcccggaaaatttgaaagcatggaaatgggagaagactttctttggggataaattcagagagcaacaaacaattcttttatgacttctcctgcgtaggaatgactgattaatttggggggattaaactttttgcgacttttttttaaataacacgaagactttcaattgttttaggaattttaattttgttttttcgcaaggtttttgattatgatgatcttttattcatattgttatctttttaagccatcaaatcggggcggagggcttaatgcatttattgggcttttttgggtttgggcagttatgaatttggggaatatatggccataatttgggggcgagagaggtgggcaaaataaaaaaaaaggactgaaggggtgggggtattaaaaagctgttttattcctaattaatatatgtgcataaataaatatttttttaaattgaatcaattggttgtcttttgagttttttatataaaaaaagacagccatttttaaataataaaacaacaaatatattcaacaaccaagtgtcaattcgggaaaatataaatgaatggccattaatgactagggagcttggatttgtattttttaaacacttacatatttcgactaaaaatcaaataaatagtatttttagcttggtttgcttcttctaagatccatttttattccctattttccatatttcacgtttttttttaatttttccatattttggcattttcataagaaaaaatcaaaaaacaaccctataaacatcagatattttcaaaactaccctcccaaagaccgaaaaaattcgaaaattgtaaaaaatattcaaattcttattttaaaaaattttatttgaagattactttttttgagagaaaaaaattttcttaaaaataatttgatatatcaaatatagaatatatatacatatatattaaattctgtttttcgtgatttaaattggttttttttt

SEQ ID NO: 44030 - DNA, 1454 bp, Heterodera glycines
atttgggcacggccgatgcacggacgaaggcggcatttgaaggggaaaatatggacaaatgaattgttggataaacaattttgaaatccagaaaaattaattatttgaattttaaattatttttaataacttttgaagatttaaatatcgaacgatacaaataaaattaaatttgtttgatttgatttggtttcaattaatttatttgttggattaaattatcaaaatcaaatcacaaaatagagcaattccaaccaactgcaaattgacaagcaaaaatatccaaaatataaagaaaatcaaatctcggcatgaatttcattaattaattaaatattaattaattaagtatttttcagttcataaatttttgtacaaataaaatgtaataattttacatgtcaattcattacattcacttttgagaaaatataaccaaatggttgtcctttcactaattggccaattacctaacttaattaattaattagtgttaattaccaatttcgccccattttcacttccattgactctgcgcaacgcccaaaaaaaaagaaaaaaaaagaaaacatttgcccgtcggcggagtttcgtcgcccattttctccgttttcatttacgcccattcggcccgtctctccgtttttctgttttcactttttttgctgcgcattttacaatttttgagttccaccgctgcgccctttcccaacccaaaaaatgaaaatgaaaatgcaattaattaatttaaatttttattttctttttttaaattttcttttttcgcccatttgtttgcccctccggcgaatttccaacggccgaatgttttttttgtgtcaccgccgcgtaacggcccaattttggggcgccgaatcgttccactcccgcaacaaaatgacgacaaccaaaacgacgacgacaacgatgacatgaagacgcaaaagatgacattgccccgggcgatgggccccgggggaagaagcgtatttaagcggagagaagtgggggaagggcatcagttgcagttcaaccaacagcagcagaagcaaaagtgaggcaatagttattcaaaacaatttaaaatatatttaaaataattaaattattcaaattaaattaaaatccaatttcaatttaatttaattttcaattttagatggctgactttgacaaacacgctgcccagcgcgaggcggagtctctccgcactttggccttcttcggcgtgtgcctgtccaccgtggccacggttatcgctgtgctttccgtgccgttcgcctaccagcacttccagcagatcggcgccctaatgcatgaacgaagtggacttctgcaaaatgcgctccggcaacatgtggcgcgaggtaaagccgaaaaggcggaaggcatgagccgagaattgtcacaagatttaacaaattttcaggtcacccgtacacaggactactcca

SEQ ID NO: 44031 - DNA, 1697 bp, Heterodera glycines
tacctacattattctatcgactagaggctgttcacccttgagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccactacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacggggaatgcagac

SEQ ID NO: 44032 - DNA, 1052 bp, Heterodera glycines
  misc_feature (16)..(16): n is a, c, g, or t
tcaaacaaacacaaanaatgtgctcattattttattaattattttatataataaaagatgggttataaataaggaagggatgcgagacaaatttcccattatctctccctttcctttcttttactctcttttcttttccattgcaatttactctcttttttcccactccctccttctcccacacacacgcacgcgtccaacaagactgctgctgcacagcagcacgcgtctgttcactgtatgcccctctcacccgccgctgcccgcgtagacagacaatcagacagtgcactattttcccacctttccctcgctctacttttttcaaattcatttttaacgcaaaaattaaacaaaacgctacacaaattcaaacactggacacacacaacagacactcaactttattatataggataacattatattgataatgtcatattctttttgattttttatttattaaaataattgatatttttgggttttttctgaattatgttgaaacagaattcataattatttacaatctatatttctgtttttaattgtttatttttattttaaattgaaattatttagattctctttattttttaaatttaattttcaatttatttacattttatcggtgtaagcaatgaaagagattaaaaaacaacaactctgcgtaattgactggtaaaaaataaacttaattgttttaaattttgtttcaataaataaattttatacatttctttatattcaatcagcttttcctttagatagcattaggaatagtcaatatgatctcaaaataattttaaattttttatcaaattttttactcttttttttaatattgacgcatttatttagatttcaatattttttaattgatatattatatttatcaatttgactttagaatgtttttttatttcatctgatttcatcagatttcgcttcctttttaattattctgtaattagagtatttttttttgcatcgaaatccatttatatttgaagagttacagaattcctatgttttattatctttgtaattta

SEQ ID NO: 44033 - DNA, 1473 bp, Heterodera glycines
  misc_feature (16)..(16): n is a, c, g, or t
  misc_feature (27)..(27): n is a, c, g, or t
  misc_feature (1344)..(1344): n is a, c, g, or t
  misc_feature (1349)..(1350): n is a, c, g, or t
  misc_feature (1418)..(1418): n is a, c, g, or t
  misc_feature (1442)..(1442): n is a, c, g, or t
gtaatgtctctaaatnttcttcaaatnttgttaaatatcatgtaaaatcttcaaaaaatggctaatgtggtattaaaaatcattttagaagaaaaaaacatgataaagcaaaaatttactcattttttgcgaaaaaccaacccaaaaagcgaaattttgctttttttgcttatttttgacataaattaaccatttttgagaaaatttatttattcaatatttttcgtgaaaattttgctaaaaaattatttttttggaaaattttccggtttttgaggtcaaaaaggccaatttgtctgttggggggccgttctattagaggttttttggaaaaatgcccaaatatgcacataaaatatgcacgaaatgccaaaatatgcacaaatatgcaaaacatgcatatggaaagtcatcctagaagcttcaaaacacgctaaaaacatgtttttcgtgcgtttcaggcctcccacagtccaggaaaaaaatatgcatgtgcatataattggactccctaatgattagctataatttcgacaaaccattcgtttcacattttcaaataagctcaaaattcatcaaatcctaagaattaaagccgaaaaaacagatacaaaagtcagtgcatgcgaacctcccatttttattaaaaaaaatttacattttgaaaagctgtgcaaacgcatttcagatcgttttcggagtctcaatgaatcatgaatatgatatgataacaacccatttcaataatcttggactagattctgaacttaataactaactattaatgattactttatatatttagaccataaacctgattttttaaaaattcaaattctcgactttaagccaaatcggaccagggttttcagaattgaccgtaatggatgtcacattattgatcagtgactcagaaaactcataaatatgttttcacggcctattgtgactcagaaattttacaaaaaatggtgctacaaactgaaatgtttaaacttataaataaggctaattatgtttctaatgaaaattggaaaattacttaatgattggaatgaatggaagcggccccattaacgaaacgccactgatcgccatcagtgagcccatcaaagtgatcaatttggatgagtgcttcacttgcttttcgatcataaggccccaaattggggcactgagcaaataactgaagctcattatcgtcgacataatgccaataagcagtgccgatgggctcaactaaaaatttatttgttttaattctatatttattggattttattgaaacttttttccattattgatttatacgtggaaacattccatttttatatgattttttanatttnnttcaattaaattctgctttttactcccctacgattcaaatgagtgggtaatgatgcttggtaaatgangtggtatgccccgcagcacattanaatgagcatcatccatgttttgctgactcgt

SEQ ID NO: 44034 - DNA, 883 bp, Heterodera glycines
gactcccggataatgtaaattaaaagtgaagcaaatcccaaaacatgcaactggaatatgccaaccattagatgtttacattttccggtagttttgttgccaaaaataaaataaaaaatagttttagaatttggaagaatttacgagaaaaataacggaatttgtaatgatttatgatgtgaaaataaatttgcacgacagggataacattgttaaattacaatcgttaatccataatcagtttcaagcagaacgttttcatggatggattaattttgcctggagaaaatcgggttattacggggacgagcctctgccaaatttttgccatcccgttaaatactgctttgaagtgccaaaaaatgtgtcagaaattaaattgtgaatgttttattttattacggtgtgcttattgtgaattatatttatgctttaaccatttttttaatgattaccatttgtgtgaaaatgaataaaattgaatgaaaaaggaggaataaaaatttttgacccgatggaattgatttcaatggccattaatttgcataaaatcaaaaataaaacggggaaaataaattaacatatgagggattcgaaccagcgagcgcaaaaagggaaggcaggagcacaacctccgcaccaccgaataacacaaaacagtgcaaatatttatttaatttattgcgataaaaaaagtttggcacgtcataactcggcactcagactcatttcgcagaaaataaaaacacttttcttaagaacccatgggtgctctatccacccaccaaatttcatttggaaatcccacggacacctggggaccttcctttgtcagtcgaattccgtcaaaccaaatactcaacatcggtactagttcagtttg

SEQ ID NO: 44035 - DNA, 1134 bp, Heterodera glycines
  misc_feature (40)..(40): n is a, c, g, or t
ttttcgcgtggccattttcgcgtggttgcatataaaaganaattcataactcacattatattttaccaaaatttgtttcactcttttttctagcgagtttttattttataatttaatgagtagggatggtaattatatgcacataaaatcgcaaaatatgcgcataaaatatgcaccaaaaattgcaaaatatgcacataaaaattgaaaaatatgcacataaatttttccaattgagggtgtaatttctcaaaatttcttcaaatttgttaaacataaagtaaaatcttcaaaaatggctaaatgtggtattaaaaatcattttaggagaaaaaaacacgatacagcttagaatttactcattttagcgaaaaatcaacctgaaaagcaaaattttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggttttttttgaaaaatgccaaaatatggacataaaatatgcacgaaatgccaaaatatgcacaaatatgcaaatatgcacataaatcgcgaaatatgcacaaatatgcaaaatatgcatatggaaatacgtcctagaagcttcaaaccaagctaaaaacatgtttttcgtgcgtttcatgcctcccacagtctaggaaaaaaatatgcatgtgcatataattaccaaccctattaatgagtttataaactaaattaaagctatttaaattatataatatggaccagcagcaaaaaattaaaacaaaacgaaacaaagttagttagaacatgacggcgcactctataacgacatcaataacattcacctcccccaaaatgatcacaattatgccaatgccaatgtgaatcccgaaaacattatcaattttctcactggtgtttcctgaaactatgaaatgcgaccttagtttgttctgaaatttgttattttttttataaaattttaattattttttccgtttgacgcacatccgccaaactgacaaattattgtagaagatattagccgcaagaaataaaaaaa

SEQ ID NO: 44036 - DNA, 953 bp, Heterodera glycines
cgacttcccttcccccccccacccgctcaaaaaaaaactttcatgggaagttttggtgaccaaaaaaagacgggggttcacttttgtcacttttgttggggcagccaacaaaagtttgacgaagaacaaattacgatcaaagaaacgaaattattatgcggaattaatgaaagaaaagaatgaatgaatgataaggagaaaatggaaggaattgcggaaaatttgcaaattcatttttttgtgtgtacgtttcaaaattctttgttaccaaatgttgcgagattaattcttgtaaattcgtataattatggttcgattggttagaaaaagtgtaagaaatagcgaaacgaacggagagaaactgtcaaactacatttaattgacaatttaaaagaaagcatcgaatgaatattaaattaatgattatgcaattcgtagaaattttcaagtgaggcaaatggacgagagaaatttgcctaaagaaattaatatgctccttccagcagaagcgcagcatcattagcaaccaatttgttatgtgttcaatcctccaatggataaggagaaattttcttcacttagaattttaaagacttaaaatttgccaaaaaaccgcaaaatatttttgaaaccctttttaaaaagataaaaacaaagtaaataattttattaatattttcaattaaaaaagtaattaaatttaaaattaaaaataattttttcttggaaaaatcccgctatttccggtccggtcaaaaattatagtattcccagtcctgtttccggctattctgatcacggtcaacccagggccaggtttttcccaagaatcccagtcatgagatattcaagaaaaaactaatacggaaaagcgagcaattggccaattaattagtaaaacataaaatgaaaacccttttatttattgtgatcagattcgggatcatgttgca

SEQ ID NO: 44037 - DNA, 1074 bp, Heterodera glycines
atacacatacaaatgctctcgagcatgatagggagggcggtgcgcatagccctttatttttgagggaatttttaatttatactcttcccagaaaaatggctatctcttttttgagaaatttatacctcacaaaagcgctgcagtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtttgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacctcacaaaagcgcttgcgtatgagacggagggctgtgcacaatcgccattttatttcacagag

SEQ ID NO: 44038 - DNA, 1388 bp, Heterodera glycines
ctacgtgcgccaaaaatgatcaaaaaaaaaaagcgatcaaactttcgaaagaccgataaaaatgacccagtttttaaaaattcataaaaaattttgaaaaaaggctacaaccatatacttcctttactaatggtcagcaaacgaattctctatcaagatatcatcataaaacaaattgaaataactgcataaaaacatgctagggggagtaggactttaaataaaaaatcaaaaaaattcatcatcgtgtctagcgaatccaaacccccgacgaatacttctagctttgatgccgactttttagcaccatccaagacaagtgggacgttcttcaacatgtggtacggcattgttgtcgtggtaaggtgtgccgtaacaaaacatacaatgatgaagcccaacatttaaaatgggatcccacacataaataaaccccgcacggcgggaatcgagaatttgactcgagattgggtctaaaacaagggatttataacgtacctaatagtggttctgaaaccaaaaattctcttaaccacgactctcgagcatcgcttattcgtaggccgtcggtctctatggcgtttttagccttttgctctatgacacccgcagtttttcaccgcactaatttcagggaaacagtcattggaaaacggggaaggtacggcgcgacggtgctgcgacaagcgccgcccaaaattcttttttgcaaatttattagttaacgaaccgccagtataaaattttttacctaactttttaaggagggactggtgctattttgttccgccacccctttttgcacataatatgtacacatgcttttgatcggacaaaacaaaaaaagttccgctgatatttctgcctaatttttgaatacacaaacagaacgacctgttgctcatcaccagcaccgtctgcaaggtgtccatccaattccgtgactttgactcgtcggcactgttcacactcaccggtgtactgctcggtctcggcgtgttcctggtgttctttggcctactccgctacttcactttcttctcccagtacaatgtctgttctattatttccataatttgctaattacaacgtgattaccccaactctcaatggacttcttatttcaaggtcatcattctgacattgcgcaaatcgtttccatccattttgcgcttcttggttggcgcggtcattctctactgtggatttctgttgtgagttgtactattgaacatactgtaatttgaccatttgtctttttcagtaccggatgggtaatcattggtccctacagcttgaaggtgctgtcttctactttaattttcttttgagaatttgtataaaaaactaaaaattaagtttcaagaaagtcatatagtcaggcggat

SEQ ID NO: 44039 - DNA, 1701 bp, Heterodera glycines
  misc_feature (964)..(964): n is a, c, g, or t
ggcattctgttattttcaaaaaaaaaccgtcgggcaccagacgcattttcgacgggttacaacattatgtgttggcaaatgtttgtttgccttttctccttcctgcccatttttgaaggtttttttgtgttactcaaattgctaaattggcactctcaccgaaaatggaggatgagaaaatttccaaaaaaaattctcctgggtcttcttctcctccaacagttttggcctctgccctggtggtggtggcctgctggcagccttgcaagacgaccgatcaaatttcaagatggcgagaacaggaggccaaaattttaaatattcactttttttttgactgggccacaggagagaattaggaaaaacgaaaggtggcgagcgaaaataaaaaaaagggaaacaaaaataaataaataaaaataaaaatttaaacggagtatgagtgaattaaaaaatttgtaatcaaaataaaaataccctattgaaaaaatcacttggttacaaaatttatatggcaaagattcggtaactcgagcaaaattctacggtattttacatataaatcctgccaaataccattcaccctagggcttggatttttaggtgcgaaaaaccccaatttagaggcctaaatagaggcgaaaaaaccacctaatagtggcgaaaatggtaaaatattggcgaaaattttaaaaaaatttgtgctttttttcaatgaaaataaattaagaccagtgtaaataacttattcaacaattttaattacaaaaaattaaatttcatttttttgaataaaaagcaaaaaaaaatttgcttaatgaaagttcgatttttcagcttatttttcatttgaagtctatattcaaagaggaaaaagtttttcaatttttttttgtccaaaatctttaaaaaattatttctattttttgcaatttttgaaaaattttcaagaagtcggtccttnatggtgcattttttaattgcatttttggtaagaaattttttaaaaatgccgaaatagtggtaaaaataagggcgatatgccaaaaatgccaaaataggtaccccctattttaggggcgacaattcaaaaatagggattcctagggacgtatagaggagccttaaaacgaagaattttcgcgctaaaaaggttttttttcgtgcttttctcattgaatttaagccgcagaaaaaataaatactaaaaaactaagaatccgggcactaattttaagtaaatattcctggctttattctagtttacgcgtccaatatcaatgagcatcctcagtttctttggccctaacttttttttccctgggtcagtgccaacattcatggcatcaaatgaaagccctaagtctaccgaatttttatttaactaaattatggacaaaaggtaaaagacaaaaaattatcttgaataaaaaaattatcttgaatatactcttaaattaaattccaggttttctcattgaaatttttacgaagcaagaaaaaaattgatggcctaagaaactgagggtagtcactgacttggacgcacgcttaaataaagaatagagcaaacattcttaaaatttgtggcctaagaaactgaggatagtgtcactgacttggacgcttaaataaagaatatttttttacgtaattgaaagtttttctgagtataaaaaaagatttttaattaattttttg

SEQ ID NO: 44040 - DNA, 908 bp, Heterodera glycines
cggcagaaatttttgttattctgattaagagaacgaagatcagacaaatttatacttggggaactttttcattaaaaaaataataataaaaattgaggagaccaaaggaatttttgatttagcggcgatggaaaatgatgatgagatcgaagtaaatgctgatgagagatgaccaaacaagcagccccctcccttcatcaacagcagaagaaatgagtcacccaaatggaaaagccaaaagtgactgagagataaggaaaagtggacggcacagagacgactagagccatttgggaacaaaatagtgatggtggtacaaagaatgaataagcaagtgaaacataaggcgagaggagggaagagggggcatcgtaagtcgagtaatggacaacagaaggggggcaataggggacaatcaaacggcgtggcgccagaaggcacatgccgggaaagcgcggaattcgccgtgggctagaaggagagagggaaaacattaatatgctgacagaaaaaatcaagtaaaataggggaagcacaaacaagttagaaaatcaaaggcttttaaatgggcagctattgccgtgaagcgtttgaataaaaatgagaaatattaccattcgagagttttcaatattctttcaaataaacgaatgaaatatttaaaacagatgaatttgaggcataaaatacaaataaaaaaagggacggaggaagaggcaaatgacacagaattaattggttttgcgtcgtcgtcgattgatggccctttctctctctctctcttctctctttctctctctctctcttctctctcttctctctctctctctcttctctctcttctctctctctctctcttctctctttctctctctctctctcttctctctttctctctctctctctct

SEQ ID NO: 44041 - DNA, 168 bp, Heterodera glycines
ccactctctctcgccgcttccttctgatctgtttgctttgtttatgtccgatcagctgatcattcgtcctttggccaacgactgctcatttggcggtgattgagcaacaaaataaaactgccgaattttatgattaggaaaagcggaaaagcatatgggtaaacggag

SEQ ID NO: 44042 - DNA, 1299 bp, Heterodera glycines
caattcaggataaagaacactaaaattcagatgtagacctcaaaattcagattattgcaaaacaaggggtcagcagccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtaccgctcaaccctagaaaatatttatatttaaacaataatttgaaaaattatttttgctcatcatattttcattaaatttttgctatttttggcttcctatttataatctcatatcagcagattttggaagtattatctcttctaataaatccttcgatgtgatatttcaaataaaactttgttttataaattataattcacccggcaaatcctcgggcaaatcgaagtcggccaattcgcccaactccgccggttcgtaagcaaaagggtcgtcctcgccaagtgcaaatgacaaaggctcctgaccaatcgttggaggagggcacagatcgatcaacgaatcggagaaagtgatttgagtcgatttggtgggcttcgcctttgccgctttgtccgtttggtgaacggacaaaagacgagccaaaatctgatcagaattcgcttccgaatcgccattgtctgacgatggactcagcttttccaatgtttccactgaattgtttaaacaatttcatcccttccccgtcctttttcgattttctcaccgtccaaaatcactttttcctttcgctgcttttccttcacaaaaagttgtgccaaaaaatccttgcgtcgaacattggcttcattc

SEQ ID NO: 44043 - DNA, 674 bp, Heterodera glycines
ataattagggctaatatttatagttgctaaaaattgccaaaataattagtttttaatttctaaaaaaaccccaaaatagttgctaaaaatgggtaaatagttgctaaaaagttccgaatttaggggtgtaaaatcgcaaattttcttcaaaaagcaaaaattttttgccaaatcattaagaatataaacaattttcaaaatcaaaaattctcgtcaagaaataaaaaataaattttggaggtgaatttttgagaaatttttcatttatcagatcatttttgaaaattttcgggtcgattcttaggggtgtaggtttatatatatttgatcacttttacagtaatatttaattaattctttgttatcaattttttcaataaatattttgactgaatgcaagtttaataacacgttttattcgcatccaaatctctttaatatcgtttttaaatttttgaataattagtagggttgtaaattatatgcttttgcatattttttctgcgcatatgctatgaagaaaggggctcaaaaatggcatttctgcattaaaattttttgctttggtgaaggtttttagtgcatacaaaagcatattttgggggtttttgagaataagtgcatattcatttttgcatttttagagcatattttggtcattttttggaaatttt

SEQ ID NO: 44044 - DNA, 951 bp, Heterodera glycines
tggaatatttacgtgtcaaagggtgtgcattaagcgactcgctgtgcttgcccactgcatttcaaatagctggtaatttttatttctccggcctaatccagaaaaaatcactatctctttttttggaatattttacgtgtcaaagggtgtgcatataagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcccaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaa

SEQ ID NO: 44045 - DNA, 453 bp, Heterodera glycines
acaatggaatgccgctttgacccgagtgggggtgagctttgccgttgttgttgctgcagttgtgcgcccattgagctggtcgatttctcagaaacgacactcgcgcgcggcccgccaactttggcaccgccggtggcgccacccgtcgaagtgccagccgttgccgacgccgcggcggtgcccgctgcgccgtccattatccgctcctcctccaacagctgccgctcgcgggtctgttcttgggacatgcgattgcacaggtcgaacgcttggccaattgtgcgcactacagcgatggcctgatcctaatcagtgcaaaaatgatcaaaaaacggagtggaagagcagagggagagaaaaagagagaaagagagagagagaaagagagagagagaaagagacagagagagagagagaaagagggagagaaagagaaagacagaaagagagaga

SEQ ID NO: 44046 - DNA, 1138 bp, Heterodera glycines
  misc_feature (1027)..(1027): n is a, c, g, or t
  misc_feature (1095)..(1095): n is a, c, g, or t
atcaacgggactcaatccaccatcatttcaatcactgggactcaatccaccaacatttcaatcaacgggactcaaccctccagcatttaaatcactgggactcaatccaccagcatttcaatcactgggactcaacccaccagcatttaaatcactgggactcaatccaccagcatttcaatcaccgggactcaacccaccaacatttcaatcaccgggactcaattcttcagcatttcaatcactgggactcaacccaccaacatttcaatcactgggactcaatccaccaacattccaatcaacgggactcaaccctccaggatttcaatcactgggactcaatccttctgcatttcaatcactgtgactcaacccaccaacatttcaatcactgggactcaatccaccaacattccaatcaacgggactcaatccaccaacattccaatcaacgggactcaaccctccaacatttcaatcactgggactcaacccaccaacattccaatcaacgggactcaatccaccagcatttaaatcactgggactcaacccaccaacattccaatcgacgggactcaaccctcctgcatttaaatcactgggactcaacccaccagcatttaaatcactgggactcaacccaccaacatttaaatcaccgggactcaattcaccagcatttcaaacaccgggactcaattcacctgcatttcaatcactgggactcaacccaccaacatttcaatcgccgggactcaattcttctgcatttcaatcactgggactcaattcttctgcatttcaatcactgggactcaacccaccaacatttcaatcgccgggactcaattcttctgcatttcaatcactgggactcaattcttctgcatttcaatcactgtgactcaacccaccagcatttcaatcgccgggactcaacccaccaacatttcaatcgccgggactcaattcttctgcatttcaatcactgggactcaatccaccacattcaagtcactgngactcaattctcccgaattcaaatcactggactcaatctcatcaatccttcagcaacacaattaaccnggactcagttctccgacattttcatcaccggaactcaacctca

SEQ ID NO: 44047 - DNA, 1011 bp, Heterodera glycines
agctgctgctttgtctgctccgcaatgttcgtctgctttacattttaaattatctaagtcatgccattgttgcgtgttcacctcatcaaatgcttccattggctgcacttcttgaggctgcgacattttgccgttctgttggcccacccggcactgctcgagtcgcagctgtgcatgccgttcggatgcgaagtgaatgttagccaagcattggatgcgcgtcaccgccttttgctgcgggttggccgcgctttgttcggccaattggagaccggaggcaatttgggcgttgtagatgaagctgtactcagtgtccttctgctggaacggctccagcagcccggcggcgcttttgtcgcccgactttgggccaaaccgtgccgtgccaatgttggcattcgttgacgaccgaaagccgtcaaaactcatccagttggaatggcgtattccgccggtgcaaacgctgaggaatttgctgataacagtcaaatgaacaaaaaagggctggccaaaatgacaggcgattgaccccaaattgacagcagttgttccttctgctgctgctttgactgactgattgtttgacggttttttaatttcctcccctccccctccggcgccattctgccgtcaacagcagctgaacgtgttcaactcgtccctccgcctctcccgtcgaagtgcccctcggctgtccccggcgcttcgattggtgtgcaacaacgtgggttaatatttcttcatcagcactagagaccggacaacttgaggagatcccgaccgattcccgatcaatcccgaacattttggaaaaacaatcgaggcggatcccgaggtcgggatcccgatcctgtccggtctatagtcagcactaattaagtgtcattaggagtgattaattgatcactactgctgatcagccgtgatcaccaccaccacccattgcttttcctgctcgcccttttagcactttggtcagaatgccaatctttctcggttcgctggtgatcg

SEQ ID NO: 44048 - DNA, 941 bp, Heterodera glycines
tacctcatctgtgcacatgattggcacagatgggcacgggcatttgtttgcctttatttgctaacaataataaatggagatgggccttatcatttaatccagagcagcagtttaactgctgttattaatcgcattgggtggccccagtgaatttttttttttgttttgcagagaaccaaaataaaatggccaaagttgtaaataaacaaaaattaaaccccaggcaaaagaattggaaagtcggcaacttcaaacaaaaacccggcacggcatggacccacaaaaggtgacaaaaaagccgatggtctccatataaaatgctcccttttgaggatgaccgcaattattccgttcggcaacatcaaaaaaaaaaaaaaaattcggcacggcatggaccctcaaaagatggcaaaatgccgaggctttccccaggtaaaatgtccccctatgaggaatgaccacaattatgccgtttatttaaaattgagaatttgaaatccgcaactgtcctatcagagattttgttggtgatatgaaatagataataataatgactccgcttcacttcagtctctcataaaaatgatgtgcgatttgtgtacatttattctccccttatcttttcttaggcggcgatttttgttattttccaatttgcctcattcattgatcaaaatcaaacattgccttcattacattaattattactaattacctatgtccatatttggtcatttaataaattgtaaaatgaaaatttttttttgaaaaatattaatattatttaaggttttcccgagttaaaaaaacatttttaaacttacaatttttgccctaataaaaaactaataatgtcttcagttcattcagtaagtttaaaaagaaaattttctcatttttttctcgacaatttatgtgataaataaagaaaaaaatatgcg

SEQ ID NO: 44049 - DNA, 993 bp, Heterodera glycines
agtgtccgtttgggggtactcaaacaattctgtgggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctatttccgaaggattcggtctccccataaatctgggcgcatcgcttcggggggacggcccgagaagccaaaaaaaaaaaaaattattttgaaaaaaaattattataaggaaatgactagttactatttgaataggttatttcgcgtccgttcaatgtccctgcaaaggttggtgtgcgtgcttctgatcagtttctgaaaaaaaagtaaagcctaaactttttggcctgtttaaaaaggattaaaaatttttaaaaa

SEQ ID NO: 44050 - DNA, 1066 bp, Heterodera glycines
  misc_feature (42)..(42): n is a, c, g, or t
  misc_feature (67)..(67): n is a, c, g, or t
  misc_feature (1057)..(1057): n is a, c, g, or t
ttagcgctcataatgggatgtataaaggcgatgtagaaaggnaatggaagcgctaaatttgttgagnaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattgcgatttttacttagaccatttttttctaggcttagatcacatgcgattttcggcactctgataattttagcgttcataatgggatgtataaaggcgattgtagaaggaattggaagcgctaaaattggttgagaagctttttgagcgtaattacgatttttacttacaccatttttttctaggcgtagatcacacgcgattttcggcactctgataattttagcgctcataatgggatgtataaaggcgattgtagaaggaattggatgcgctaaaattgtttgagaagctttttgagcgtaattacgatttttacttacaccatttttttctaggcgtagatcacatgcgattttcggcactctgataattttagcgctcataatgggatgtataaaggcgattgtagaaggaattggaaacgctaaaattgtttgagaagctttttgagcgtaattacgatttttacttacaccattttttgctaggcgtagatcacacgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctaataattttagcgctcataatgggatgtataaaggcgattgtagaaggaattggaagcgctaaaattgtttgagaagctttttgagcgtaattacgatttttacttagaccatttttttctaggcttagatcacatgcgattttcngcactctga

SEQ ID NO: 44051 - DNA, 844 bp, Heterodera glycines
tgttggccacgtgccaaaatttaacgccgttctcttcgccccaaccgaacactttcactgaatgtgcgacgttttttctcaatgtgctattcgcagagtgctaaaatagtgacaaaaaaatattgtttttttatgagttttttgggccaaatttctaaatttaaaaaaaagtttaaagagaaaattgtttaaattttaatgaaattgtgaaaattaatcaaatatatttggtcttaaaatagagacactccatttttgggagtttgatcatttccgagaaccattcgcgctaaagtagagccatcctataactattttctattgtcttataagtgatcccattgtcttgaaatttcaaaaaattatttaaattttaagaaaatatgtcagaaaaacgtccctaaaaacgttcaaattggtagattttactaacgagccggcacaggattaacccacctcgtatatttcgttgtttttacagcaacttccgtacccagtgtacatgatgtgagatgcgtggattggtccatttttcataatctcgcgcatcatttccttttctctgttgaaagccattaattgtgtgagtccggtgattactggcatcctagtagcctcttaaagtgatgaaaaaaaattgattgaaaaacagcagaaatccgatgaaaatcccggctcaagaaagtacggttaccccaataccgcagcgggatccgcaaattttttttgttgtgacaccccgaactttcttaaccctcagagcccttcgaaaaatcttggtcaacccatcaccccctttttatgcattccgccagcccctaaaaatttcttttccaaattaggc

SEQ ID NO: 44052 - DNA, 883 bp, Heterodera glycines
ggaatttttttagcgagaatataccaatgaattttgaaaaaaatgttttctgaaacgaatgttttaatctttttttaacataatgactgaaattaaatttttctcacaaagcagtgttggattaattctccccgatataatcaagttttttggttatttagcaaaaatgtcaaatatctgggaatattttacactatccgaaagagtagctttttgtaaggaaaatggttgctcatacaaaaaggatcacccttattaaaaaaaaatcggaatcgcaattaatcggattttgggccataatcgtaatcggttttaaaaccgtatcggatttttggccataatcggaatcggcgatttaatcggaatcggattttgtctggctcggcacatccctgctaccaatccttttcaaattttgcaaatcgatagagaaaaaaattctacatagtttaatactgattttattagtaattatgctaacaataaaaaagttatggagtgattaaaatttttgcatttcttttcctctcgtgttagcgtactattttcacatctctaacacacaaaaaacatcaaattcgtaaatgctaacaattttggttataaggataaaaaatcactttggacatttagaatcaatagagaaattaatagttttagcatttttgctgaaaacagcagtcaatgagctgagttataaggtgataaaaatttgaaactctcgtaacttttttctgagatgacaaattacttagcatttgcttagaaaaaaattctccttttcaaaatctttttttagataccaaatttgttcagtttagtttggaatgaagcgagttataacagatcaaaataaaaaatacaaaaaagcattttccagtgt

SEQ ID NO: 44053 - DNA, 1309 bp, Heterodera glycines
ataaatttctagaaatgacctaaaatggtctacaaaaaagccaatatgaaaattgtaaatatgactccagaacctatcattttttgattttacatatttaataatgttctcctaaatttacaggttatttttctgcagcatttttttctcatattaccaagttccataatcttatagggagttcatgtaagggccaatataaacattgaaaggcctttttgtgacgaacaaagccaatgaaaccgagccaatgattagctatgaagaattatttctaacccgataattggtgtggtggggactaagcagatcctgaagaaactccaccaatgaaaacaacgaaactaagctgaccttttcgtggaatcagacgtaaaaggaactataaatctctagaaatgacctaaaatggtctacaaaaaagccaatatgaaaattgtaaatatgtcttcaaaacctatcattttttgattttacatatttaataatgttctcctagattttcaggttatttttctgcagcattttttctcatattaccaagttccataatcttatagggagttcatgtaagggccaatataaacattgaaaggcctttttgtgacgaacaaagccaatgaaaccgagccaatgattagctatgaagaattatttctaacccgataattggtgtggtggggactgagcagatcctgaagaaactccaccaatgaaaacaacgaaatgaagctgaccttttcgtggaatcagacgtaaaaggaactataaatctctagaaatgacctaaaatggtctacaaaaaagccaatatgaaaattgtaaatatgtcttcagaacctatcattttttgattttacatatttaataatgttctcctaaattttcaggttatttttctgcagcattttttctcatattaccaaagttccataatcttatagggagttcatgtaagggccaatataaacattgaaaggcctttttgtgacaaacaaagccaatgaaaccgagccaatgattagctatgaagaattatttctaacccgataattggtgtggtggggactgagcagatcctgaagaaactccaccaatgaagacaacgaaactaagctgaccttttcgtggaatcagacgtaaaaggaactataaatctctagaaatgacctaaaatggtctacaaaaaagccaatatgaaaattgtaaatatgacttcagaacctatcattttttgattttacatatttaataatgttctcctaaattttcaagttatttttctgcagcatttttttctcatattacc

SEQ ID NO: 44054 - DNA, 924 bp, Heterodera glycines
cgactcgatgagcacaaagaatttgccttgtcttcaaatggcgttttcaatttccatggctatcagagtctttttactctccaacatcgcgtaattcattctacagccattgttcttcgagactttgtaatttcagttcgattttattgtcgacggcgtcacttacaaaagtgtcgaccagttctaccaaatgaacaaagtcaaggatttgactgggatcgaatcggccaaattcacggacggatcgacgcggaattacagcgcattggccaaggaattgttgcgacaagcaaacgtgataatttaaatgctcaaaatatataaaataaacaattgttaaggtcaaacggcaggaaattgacaaatggcgcaccgggaggggcgttgaggtcattcaggtgactgacattgggcaaaaatggcaaattgcccattttgtgtcgttttccttttcagaaggctcttctcgagaaggtccgccagtgctacgacttgcgcaattcgatcaccagcacagcggacaaactgattgtgcacagttacaacggcgacgactttttcggggcgggcgttccggcgaaatatgtgaacgattggtgcggggggatggagcagaacaaagtctcgctgaaggtggacttatgctgatttgcagtattttatataattattttgatagtacccaatggaatttcccctcactgcggacaatgtgaaatatgtgccgctaattgcgaaggtgagaaagactttcgaacattttcattggttggggctatgctatccttttatttgtttacagggaaggaatgttctcggcgccatttacatgattctgcgtgataaggtcccttcccaatatttgcaattagggtaatagtaaagctggtgccccccttttttgaaaattatttgtttcaaaag

SEQ ID NO: 44055 - DNA, 1018 bp, Heterodera glycines
gtccgattcgttggctgtcatcgcagccaatttggactgcatcccctacttcaaaaacaagacaaccatcggtcagtttttttgtttcacattttcctaacttattgcgctattttttttactatacatctttttaatgctagcaattttttgttttaaaacccgtttttttgtatagaataatttgtcccacccaccccctaatttttttaaattgaaaattgataattttaaagaattatttccattgaaattttaagaataataaaaaataataaaattttggatttgtcttactttttactaggaaaaatgcctctaacaataagtatgaaaaaattagaaaactaaagaatttttatttttttaaaaattctttggcacataatgcatccttttccatcgtcattaactgtgttcaattttcaacaaatctattttttatttttattttttgcaaatttgaatttttttttaaatgcaatttttggcctttttcaggctatgcccgttcaatgccaactgcatgtgcggtggaccgtgttgccaaggcacggggccgtcagtgttatgaggttgggtttaaaaaaaaattgtttttctccatttgcgagagaattcactcaattaccgtaaactgagtcaatttttgattattttttaggtgccaaccgggtggaaatactttggcaatttgatggacgccggcaaattgtcattgtgcggtgaagagtcattcggcaccgggtcggatcacattcggttcgattttcccctctttttgggcttaaaaaatttttttaacaaattattctatgaatttttcttaaaaaaccgtggggtaggggagaaacgacttgctccgtaaatttcgtcctagtaaaatcagtgttcacaacttctaacatttaattaatatttttttttacatagtgaaaaggacggtctctgggcactgttggcatggctccaaattttggcacacaaaaatggcacacaatcagtggaacaactggtc

SEQ ID NO: 44056 - DNA, 493 bp, Heterodera glycines
  misc_feature (436)..(437): n is a, c, g, or t
  misc_feature (455)..(455): n is a, c, g, or t
  misc_feature (481)..(481): n is a, c, g, or t
aaagtcgaaccaaaagtgaattgctttcaaaaggagtcgaattatccctaattgctttccattgacattgccgcaccgacatctcatttcgcaccagaaaagtacgacaaaatggttttttttaaatatttattattggtgttctctatgaaaaatcatatatctttttatttacatatataattgttttgaataattatatttatttaattggatcacagattcaaatttttttttttttattataccaatgtcaaatttattatcattttaaatatctatttgatttttatttggataggtaaaattatttattttttatataaattttgtttatattttacaactaaatttttaattcttaatatctttctatagccctaagagttctctattagcctataaaatttcaaaaactcgtcaagtttaaacaaanngtatggccaaagtacacnatgaaaccggctttttcatttttggnccatactttttt

SEQ ID NO: 44057 - DNA, 644 bp, Heterodera glycines
aatgacggctggcagcaagaagaaaatgaaaatgtgatgggaggaggcagagaaaggtgggggaaggggaggggcgggggcagggcactctcgggggaataatccatccaatggacgacgggcgagcgggggcgggtgcgttaattgggacgactgacggcggcgggcggagaaatatgagtgggatacggtaatgtgcaggaggaacttcgacgacgtgaactgctgctactgggaaagatgcgcataggaagaagggatgggagaaggaggatgagattgacgaaagctcatccatccctccccgaatctgtggggtgccggagagatccctacggaatccccccggggcgtgccgtgtgccgtactccgccctccccccgtccctttcggcttatttctcatttcgtttttggcaccctttcacccgtccattctcgtccatctgttcctccattttccaggatcggtatgccgacaaattggttggatttgtttgggatgaattgtcgcccgccgaggacaacgacggattatgcgtcgggacttacaccgctccgtttggacgagggtcggtcggatcgtcgttttgtcctccaatttggggctgtctctccctctctctctctgctcttttcgtcctt

SEQ ID NO: 44058 - DNA, 1016 bp, Heterodera glycines
  misc_feature (96)..(98): n is a, c, g, or t
agggctagtgatttcggcaggtgagttgttacacactccttagcggattccgacttccatgggcaccgtcctgctgtctatatcaaccaacacctnnntatggggtctaatgagcgggaactttggcaccttaactccacgtttggttcatcccacatcgccagttctgcttaccaaaaatggcccacttggagctcaaacattcaacgcctgggttcagagtcaagcaaccctgggcttcataccccatttagagtttgagaataggttaaggacatttcgtccccaagtcctctaatcattcgctttaccgagtataactgcttaacgagctccagctatcctgggggaaacttcggaggggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgtacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtaca

SEQ ID NO: 44059 - DNA, 940 bp, Heterodera glycines
ctcctccgtcattggcttgtacacgtgcttctcgcgtagtctggccatgacgtgtaggagggtcgtggtgttgcgtggaaggctttgggcgtgggctcggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttct

SEQ ID NO: 44060 - DNA, 1078 bp, Heterodera glycines
ttttctttccccgcagctaaggcaatgggttgagctgtcgtcggatgagcaggtgccgccctcactgttgttgttgacccgtgccatgtacttccctgaggacgtggacttcactgctcgcattcgttccattgttcgcacgctgcccaaggaaattggtgacttcaaagcgatcactctcaaagagttggagggcggctctgacccgcaggtaaaaaacaaaacaaaaaaaaacatatcatataacataaacccaaaaattggccccaagtgacgagagatccgtagactgttttttttttttttttgctttttacccctcaaaattttttctaatataaattttctaaattagaggctctatgggtggaaataccttacatttttgcagattttaatatggctaatttgtgcatttttgggtcacattttaaataatgtttaaacataaaaaaagcgccgaaaacccatcaataccacgaaacaggcaaaacacagccgccgaaacacagccgagacataacacagccgggaataaatttaaaaaaaaaattttaaacaaatttttcaagaatttttcagcgattttttttgaaaattcttagtaaattttgaaaaaatcgcctgaaatttaaaaaaaaaatttttttcttatagaattttcaaagaaaaacttttctaagattttttttcttgaaaaatttctgtttgaaaattttttaaaaaatttattttcgatcttaaaattttgaaaatcctcatttcagccataaaaaatcctcatttggcatgaaaaatcctcatttttaaaacctcataaaattgctaacaaaatcagttaactgtcgtatttttcgtttgaaaccatcacggcgcctatcagcgccgccggaccccaataattcctagtttttcttaaaaaattagcccaaaataacaaaattggtaatttttggtaaaaatctataaactaatcttatttaaaaaccctcaaaaaaaaaattttaaaaaaaatcaatttaaatttctttttaaaaaaattggacaaatctctcttaattttttttgtttttttaaa

SEQ ID NO: 44061 - DNA, 1048 bp, Heterodera glycines
aaaatagttcttgacaaaaaatggctatctctgaaagtcactattaaatccctaccgggaattggacaccaacttttgtcttctgttgtagcgctgaataaagctataatagtgtgtttgaaaacgcacgaaaaatagttcttgacaaaaaatggctatctctgaaagtcactattaaatccctaccgggaattggacaccaacttttgtcttctgttgtagcggtgaataaagcactaatagtgtgtttgaaaacgcacgaaaaatagttattgacaaaaaatggctatctctgaaagtcactattaaatccctaccgggaattggacacaacttttgtcttctgttgtagcggtgaataaagcactaatagtgtgtttgaaaacgcacgaaaaatagttattgacaaaaaatggctatctctgaaagtcactattaaatccctaccgggaattggacaccaacttttgtcttctgttgtagcgctgaataaaacactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatggctatctctgaaagtcactattaaatccctaccgggaattggacaccaacttttgtcttctgttgtagcgctgaataaagcactaatagtgtgtttgaaaacgcacgaaaaatagttattgactaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatggctatctctgaaagtcactattaaatccctaccggggattggacaccacttttgtcttctgttgtagcgctgaataagcactaatagtgtggtttgaaacgcacgaaaa

SEQ ID NO: 44062 - DNA, 1025 bp, Heterodera glycines
  misc_feature (52)..(52): n is a, c, g, or t
  misc_feature (109)..(109): n is a, c, g, or t
  misc_feature (127)..(127): n is a, c, g, or t
aaacaaaaaaaatcggattttttcaagtgtccgttttggggtactcaaacanttatggggagcaaaaatccaacgcagaattaaagtacaggctatagggaagctattncggaaggattcggtctcnccataaatctgggcgcatcggattcggggggactgccccgaaaacaaaaaaaatcgattttttcaagtgtccatttggggtactcaaacatttatggggagcaaaaatccaacgcagaattaaagtacaggctatagggaagctactccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctatggaaaaaggaattaaaaatttttaaaaattttattcatct

SEQ ID NO: 44063 - DNA, 1105 bp, Heterodera glycines
cgccattatttggccaattccatcactcattctgctgttgctgctggccttctccaatgggtgaacaacagcctaggaccaactttgccgattggcttctcaaatggacccatcgcgtgccgcactttgacttccgcttcaaccgcttgcgccaggaaacgccgttcgacgtggacccgaacggagaatatgcgcaagtccgatcaaatttccgatttttgatcattgaactagggagttttgatggaaattttggtttccccatctgatggctaatgacgaggagttattaataattacataattgccattcccaactagggtaattagtaattaattaacctctacgatggcttaattttttttaaggcttacaataaaaaatttttcaaaatttaaaagaaactaatgacatttttttgtcaaaaagcccattttggcaaaagtcattcaaccgccactttttatacctcatccaactttgaaaatgaatgaatcccttttgacaccaactaaagtcgtccgcgtccccgtggggcaaaagcggctttttctttttactgtttccgccctcgaagcgggccgccgcccgctttcccagcaattaatcttgccgacggcgccaacgtggcggcggtggatttttggatataacctcgaccctgggggaggggatgtgaaaccgtttgactttggctttgacttccagctgagggagggcaaatggggggccattagccaatccccccaaatagcaaatagttatatacacaattcacatctgtgttgggttggcgttgtgctgttgttgtgtttttggtcgttagtcgccagcagcaatttaaaaatgtcgcccgtcccccgtgcccccaggggctaacataaataaattattgtcacatttttggagacactttttttggggggaaatgggaggcaaaataatgtgtacaatgaaaaattggagggagagaacgacaatgaaaacttagaagaaaatgaagaaaattaaatggaaaaatggatgggaaactatttggctttttaaattaaattcaaaaatggatgatgttaattaatttttaatttaaatttttcaattttt

SEQ ID NO: 44064 - DNA, 881 bp, Heterodera glycines
aaaatggtaaaatcatagtttcaaaattaaataaataaggaaatggttttataaaaaaatataattaaaaattgaatgtgttaataattttttaaaaattataaaataaattccttcttttatttaaaaataaataagaaattaattttatattaaaacatttatttataaaaaaaatttaattcaaataaaaaaatgtaatttattattaataaaataaaaaatattttaaatgaataaaacaatgaaaacacgaaaaaaatggtagttattaatcaaaaacaacgttggaaattattaattgaatattcatttaatttaaaattaaattaatttttttacaaattcaaaaaataaataatgaaattctttaattaaaaaaataaataaatttaaataatttataaaaaatatttggaattaataaaacatgtaaaagtaatcaaaaaatgcacagaaaaataatgtacaccgatcggattcgaacttcccccccccaaaaaatgatgcctcagaatccccaatcacacagggattctgagggcttaacgatgtcaaaagtaaaatctgatcacgtattcgtgatcagcggcccaaataacccctaatgacatgtttttggatgattttgggtgaaaaaatttttccactcaaaaatactggtcacccacccccctttggtcccgaatccaaaaatcagttttatttttataataattcttaaaaaagtgataaaaatatgaattaaaatttatttaatagagcaaaaaattgcggatttttgtagtattttacttttccctaatgacttttcagaaccgaggtataaatttttttctgaaaaatcgaaaatttgcagaaattctggaaaaacttttttt

SEQ ID NO: 44065 - DNA, 1357 bp, Heterodera glycines
agacggagggctgtgcacaatcgccattttatttcacataggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgagacggagggctgtgcacaatcgccattttatttcacagaggatttttatatttagaggttatcccagaaaaatggctatctctttttttgagaaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagagcggtgcgcaatcgaccttttatttttgagggaatttttaaatttatactctatcccaaaaaaatggctatctctttttttgagaaattttatacacatacaaatgctctcgagcatgatagggagggcggtgcgcaatagaccttttatttttgagagaatttttaaatttatactctatcccagaaaaatggctatctctttttttgataaattttatacacatacaaatgctctcgagcatgatagggagagcggtgcgcaatcgaccttttatttttgagggaatttttaaatttatactctatcccagaaaaatggctatctctttttttgagaaattttatacctcacaaaagcgcttgagtatgagagggagggctgtgcacatccgacattttatttcacagaggatttttataattagaggttatcccccccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttaaaaattttttctccatcttcctttttgatactaaagcatcagagtgctaaaattaagttgtaaataaaatttggtgcg

SEQ ID NO: 44066 - DNA, 1447 bp, Heterodera glycines
aaaattgaccatcattgctttggtaattaattaaattacctcccctttttcctctcccctcccatttcccccctttttccatccaaccgatttttgttttatcatttgtccaatctctcctccccttcccctcgccctcttatcgtcgtcctccaatcggacaaccggtggccaatgaaagaatgatcagaatatgaaaagagaagagaatagtccaattctgttgttctcagcagatcattcattcatttacagcacatcctttgggtggtacaaagtcaaattaacaaataaaagtgataatctcctttttttttcttatcttttgcccatttgtcccgtcccattttttgtccgccctttttgccatttgtccgtcccttttgtccgtccctattccccctctccttgtggcccctttttggcacttttttcaacttatcatttccctttttgcactttcagctttttcattcgttttgctaatgggtcctgctgctttgctgcttctcctcccctccctccttctgctttttctgctcatccgtgctcttcttgagcttatccccgtctcgcggttggataagcgttctgtgctaatcaccggctgcgattcgggctttggcttcgacttggcactgcgatgtttgggtgccgggatgcgcgtttttgccggctgtttgactcagacagtgcgccaattttgcataaaattttaaaaaaattatttcaaatgaatttttggcaacaattttcagggaattcagtctctaaagaaaagtgcccaagaaaagggaattgccgtggaacttttggaaccaattgaattggacgtcacaagtgacgaatctgtggcaaaggcattggaattcgtggaacgaaaattaggaccgggaaaaggtaaccaaaaatggagaaaagcatttgaatgtttcgaaagggcttcacgctttggtcaacaacgcgggaatcagtggcaacgaggcaaatgccgaagtcggaagtgaattttgcataatttgttcaatttcagagttgggacgattggctgattccaaaggactacgaagatgttttccagggtatggtcagacaaaacccagtgaatgaaatctctgcttttaccaaatgccatttcagtgaacactctcggcacaattcgcgtcactcacgcattcaaacgactcgtaaaggtcaattcgaataattatggctaattaggggaccattacgactctcgaaaaaaattaagctctttggttaagaaatccctccctatctgattaaagagatttctaatcaaattcttttggtttggttgaagcgcgagagggagtcccgaattgtgattatggccagctcctgcggccgcgtggcactgccaacgctcggcccttacagtgtgagtgaaaaccaatgcttccgactgttgacctccccccccttg

SEQ ID NO: 44067 - DNA, 1113 bp, Heterodera glycines
  misc_feature (1067)..(1067): n is a, c, g, or t
aaagcatttaacgtatttaacgaccgacactgttgagcccttcaatactactgtatttgatactgtatttcgcgaactccgaatctgtgtcttgaccgtaatttgaatttcctttaaagttccactggcatttcactaattggccaacagccgtccggtccgagttacgcaaccagcgaaagttcgtcgtcctcttcggcgtcgtctattgatgaaagcggtgaagagccaccaaaaaagcgaccaaaaagcgacaaaaaacaaaaaaccattgcgactgacgcagctgatgatgaaaaagcgcttccatcaaaaacagaaagtaatttctgctttcacaattgctgaaggaatttactaagaaattagcaaatgaaaatattttatttttattttttcgtattgatgaacagtgccaaaatcttatacggaaatggaaatttgcgcgaaaaattatagtgactccaatcccgcggcatttgcaaatggtcatgagagatcccgccattggatctcgatgaaaaattgcaaaaaaataaaaataaaatttccccgaaatttgacggccggaaattttgcctctgaccttttctctgtcatatatttttctcatttcaaattttttttaaataagcccaacttttaaggctcaagttttgatggtggcaccagtggcagtgaagctggcggcggcactttacaaagtcatgcggcggcaaccgccacaaaattatcgccaccgccgtcgccacgcgacagcggcggcggcagcggcggcgacagtgggacgacgactacgacagtcgacgggggcggcggcggcggtctgtggcgaccctttcatgcctgctaatgaaggtcgtccgtcggtcgccaacaaattagtgtctgtcgtcgtcgccggcggccggtcgcgcccctgggggcacaaacagcagcaacaacaaacaaacagttgccgccgcccgtcgtcggtgcgcttgtcgtcatccaatcgccggcggcgataaatcagcgcaaccgacgaaaagagacgacggacaagcaaagcgatttgacaaatggtngtgatatgtgtacaataggggagatgacatttgatcatgtgacagc

SEQ ID NO: 44068 - DNA, 1173 bp, Heterodera glycines
  misc_feature (1103)..(1103): n is a, c, g, or t
  misc_feature (1137)..(1137): n is a, c, g, or t
agtcaaatattcgaagtaggcatttaatcgaacggcttagagttaaaacccaatcatttatatcgcattgattttatcatcagattctaaaataaattggtgacgcgtcgtggtagtcggttattacggcaacaaaattttaaaatcgaattagtacgaaaaggagaaaattaatttgtaaatattgcaataaaattatcaatcaaatggcaaaagggagtcggttttgaattctttgctaatgaatatttttataaaaagatatttttaggatgtttggacattgaagcgactcagtaattttctgaggattttccgtcataaatacatgctctttgggaaccttacaatattcttttcttagaaatcctttgcctataacagtcaaatattcgaagtaggcatttaatcgaacggcttagagttaaaacccaatcatttatatcgcattgattttatcatcagattctaaaataaattggtgacgcgtcgtggtagtcggttattacggcaacaaaattttaaaattcgaattagtacgaaaaggagaaaattaatttgtaaatattgcaataaaattatcaatcaaatggcaaaaggaagtcggttttgaattctttgctaatgaatatttttatgaaaagatatttttaggatgtttggacattgaagcgactcagtaattttctgaggattttccgtcataaatacatgctctttgggaaccgtacaatattcttttcttagaaatcctttgcctataacagtcaaatattcgaagtaggcatttaatccaacggcttagagttaaaacccaatcatttatatcgcattgattttatcatcagattctaaaataaattggtgacgcgtcgtggtagtcggttattacggcaacaaaattttaaaattcgaattagtacgaaaaggagaaaattaatttgtaaatattgcaataaaattatcaatcaaatggcaaaagggagtcggttttgaattctttgctaatgaatatttttataaaaagatatttttaggatgtttggacattgaagcgactcagtaattttctgaggattttcgtcataatacatgctctttgngaacctacaatattctttcttagaaaatctttgncctatacagtcaaatattcgaagtaggcatttaatc

SEQ ID NO: 44069 - DNA, 1606 bp, Heterodera glycines
ctgtcgagtttttgtttttcaacttcgagcttttccccattttatctctcccccactccgttcagctgaccaccctttcctattcggtcacaaacagtgccaaaagagtgtttgtcattgccttttcgctgctcactctgcgcaacccggtgactcccctcaacgtttgcggaatgtttttctccgtcttcggcgtcttctgctacaacagagtgggcgaaaaaaacaacattttttcggggggatttttctttcaataaaaatctgacccatccgttcgggataactctggaatttggacgaacaaatagccgaaaataatttaaataaccgatgggagggctaccacatacagaaagccaagcctttttggcactcacaaataaataaattttggcctggttttatttcaaaaaggccaatattccttcgacgatccgtggccattcattttattcagatgaaaatgaagggcaaattcgacaactcccgccgtttcccaacacccccgcccaattctgaggacaaacagcaaaagccctttctgcgccacgacgcctcgccgaccatcgaccaacaatttcatacttcgaacagtgaagtgcgacttttactggcaaatgagtaaaacggagtagaactgctctttaatcagaatgttcacttaccttattattggttctatttttcttcgcattttatgtctaaatctttcaatgattatatagtattttcttatactcatttttgtgcgtgtgatacattcctaaatttctgtgatacaaaatctcttgttgcagcctttaatatttaacgattttctctgattgccaaaaagcccttaaacaaaattgtaacgtttaatttattcgtatttattttaataatataaaataaacatatggggtggatatctctgatacactcacatcttggaatggaatttaatatatggaaaagatggaaagaaatgatcggtttgcataagtgaaattcgagataaaatggggaagcaattctttaagtattctaatcggaaatagtaattgggcaccagcagataaagtatgaggagacaaatgatttctgggacaatatcgctgcaaaaaaataattatttaaaatagtttcaaaggcactttttgtctgggcacaacagaaatgagtaaatagaggcaaattttgtaggattttgatgtagaataaacaaattcctcacaaaatcatgcccttttcggttttgtgcatataccacaaatttaaaaaaatgtcaataaagggcggcctgaaggcatttagtgcatgccactactttaaggcataagtgcattaatccgaagcaaaatttcttcaaaaggtccacattgcgtcttttacattgaatcggcttaagcgcgtcctttgctgacatttttgaaaattgtggagtatgcacaaaccgttaagtacccatcaatgaaagtgccggctgctgtcccatctgctgccgtagtgttgtggtttttgacccgtgcaattagaaggcttcacgtccgtctcggccgagtgggcccatcctccactgaattggcccttcgtcgccgcgagcggttgctggtaataacaa

SEQ ID NO: 44070 - DNA, 1022 bp, Heterodera glycines
  misc_feature (29)..(29): n is a, c, g, or t
tttctgctcaacagtatagggaattccanccgcattctcagaatactacgccgatactcattgttctggaatttgtttctcggcgcgttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaatagggattacaaccgcattctcagaataattacgccgatactaattgttctggaatttgtttctcggcgcgtttgtttgggaaaaatttggaaaattggctatctctttttctgctcaacagtaataggaattacaaccgcattctcagaataattacgccgatactaattgttctggaatttgtttctcggcgcgtttgtttgggaaaaatttggaaaatgggctatctctttttctgctcaacagtaataggaat

SEQ ID NO: 44071 - DNA, 875 bp, Heterodera glycines
ctatgccagagaaatggttatctctcttttgcgagagattttgtaccatacaaatgttctcagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcgagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcagagcaatggccattctattctacagggaa

SEQ ID NO: 44072 - DNA, 159 bp, Heterodera glycines
ccaatggggggtggattatcagtagaattatgaccaattggggtggatgatcagtataattataaccaatgggggtggatgatcagtagaattatggccaattggggtggatgatcagtagaattatggccaatgggggtggatgatcagtagaattat

SEQ ID NO: 44073 - DNA, 861 bp, Heterodera glycines
ttgagtcccagtgattgaatgctggagggttgagtcccagtgattgaaatgctggagagttgagtcccgttgattggaatgttggtgggttgagtcccagtgattgaatgctggagagttgagtcccgttgattggaatgttggtgggttgagtcccagtgattgaatgctggagagttgactcccagtgattgaatgctggagagttgagtcccagtgattgaatgctggagggttgagtcccgttgattggaatgttggtgggttgagtcccagtgattgaatgctggagagttgagtcccgttgattggaatgttggtgggttgagtcccagtgattgaatgctggagagttgagtcccagtgattgaaatgctggagagttgagtcccagtgattgaaatgttggtgggttgagtcccgttgattggaatgttggtgggttgagtcccagtgattgaatgctggagagttgagtcccagtgattggaatgttggagagttgagtcccagtgattgaatgctggagagttgagtcccgttgattggaatgttggtgggttgagtcccagtgattgaatgctggagagttgagtcccagtgattgaatgctggagagttgagtcccagtgattgaatgctggagagttgagtcccgttgattggaatgctggtgggttgagtcccagtgattgaatgctggagagttgagtcccagtgattgaatgctggagagttgagtcccagtgattgaaatgctggagagttgagtcccgttgattggaatgttggtgggttgagtccctttgattggaatgttggtgggttgagtccccagtgattgaaatgctggagagttga

SEQ ID NO: 44074 - DNA, 975 bp, Heterodera glycines
  misc_feature (891)..(891): n is a, c, g, or t
ttttcgataaatctagaattttgtaatatttactgctagaaccaaaattgctgccaaatcccatcgaatccctgtcttttttctcccaaaacagctcgtttcgaaatctaccggcttttggttgttagggcagcactgaaactgaaagttgtcagtacagcacgcactggttgagacaaatccttgtttggacacgcatgcgtactcttcgcagctctcacaaactcgccggatttcttctttgtcgttgcacttcgttttgtccgtgatttgttttggtgccatctttaggaaattgtcacttttcagagagagacgtgagggagaggaaagtcaatcccaccctcagcgattaaattttaaaaatatttgcggaaaattggccaagattataattagggcaaatatttttaagttttagcctatttctttcctgagctccggcttaaaacgcacgtaaaacaattttttgaggggagaattgaaggtacttttcgatttattagagcctatttctaggtttttatttttggagcctaaaagcctaaaaaattttgaaataaaatctatatttgcgtttttccctaaattattaacaaaaaatgcaatcaaaacgaaaaatacaccccaaagaaatgaaaaattactcaaaaatttcttttcaaattttatttatttatagacaggaattttaaatttaaaaaattatttatctcaatattaattttgtttaattttgttactttttaaaatatatttgccattttacaccccataatatatttaagaatttttagtgcctattttggcagtttttagagcctaaaaatatttcccctattcataatcgaggatgtctttgaaactccgatttcttcagttacttattanaagcttatggccactattattttttaagatattttcatttttaataattaatgccgaatattttactgtcgtttgaaaggggct

SEQ ID NO: 44075 - DNA, 1376 bp, Heterodera glycines
  misc_feature (95)..(96): n is a, c, g, or t
  misc_feature (106)..(106): n is a, c, g, or t
  misc_feature (1342)..(1342): n is a, c, g, or t
ggctccaattatttttattttctactaccacttttcgtagtggatcaatttatagatcagggaatttcactgcatgaatgcaaaagtatttattnntattaaaatntgctgcttattttccgtaagaaactttttgggaggaatttcacaaccttgccataggaaaaactcatatctgtctcgtataaaacataactcgaacagtaggtatatttgttgtgcaattttatagtccagccttcgttcgctagggatctcaccgcggtgtattttaggttgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatatttaaaagttttgccatgctatttaactttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtatatttgttgtgcaattttatagtccagccatcgctagggctctcaccgcggtgtattttaggtgtgtctttgatgtatcaaaatttctctcggccgtgttgttgactgaaaaataaaacgaacttaaattattgcaatattgtttatacgaagtcttttgatattcttctgacgacttccatgataataaatacttatacaaagtttatctttttatatatttccgcatcccaaacatggatggaaaataggcaataaatcgacaaatattttcaagttttgccattctatttatctttcgggactcaatttatgacgaaaatatgggctccaattattttttattttctactaacacttttctagtggatcaatttatatattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtaatatttgttgtgcaattttatagtcccagcatcgctaggcttctcaccgcggtgaanttttagggtgtgtctttgatgtatcaaaatttct

SEQ ID NO: 44076 - DNA, 1193 bp, Heterodera glycines
atgcatttaatcagtcaattactgtcttaattggtaacattcttattgtctaaaaagaggtaaatattttcaaaaacctataaaaaagtgattctaattagcctgcaaaacgttcatttttaaattgaattgattaaacttaaaaataatttcatgaataactaaaggtcaatttaaaatgcagttattttttaattaattttattttttattttaattacccgatcattaggctctaagcattggaaatgtggcattgtgcggcacaagtcaatcactgacacaatttcaaacaacaacaaattatatttgccactaaagttgccatgcttggcaacatgcatataaatttgatgaggagaaggatgcggaccgacagctttctgctgatggaatatcataaattgattttaaaaaaatttgtttaatttgtaaatctattaaatatataattagattttttgccacttttaaaaaaatttgacaaattttttcgtttttataattttaaacaaaaatatcaaactgtttgcatttaaatgaacatataaataatatgccggaaaaaattaatgtttcgactaaaaacgcaattaagagtatttatcattagcaattacgcataattttcaaaaatttctccgacaaccaaaatcaaattgataattttttcaaaatttaatcaaattcatcaaaaaatcagacatttttgtataaatctgttagtagatccagactaaatttacaaagttttcgaaaataagaatttttgagccaaaaaaaaactgaaaaaatatgtatgtggaaaaatataatataaagggtggaattttgtaatatatatgaatacgccctcggctaatcgtatctataacggcgtgattttatataatttaattgtaccgtatatttatccggattggctacaatactctccgcattcttcaaaaagtcatttaatgttgaaaattgttcaaaaaatccgtcataaaattcacgccgaatgctaatgaatgcgcgaatttgttgctcaaccgaatgcattgaacgaattgattgacgaatcgccaaacttttgtcatataattttgaagcaattactattggtggccaagcaaatggttggtgctcttaaaaaatgcattattatttcaatattttttgaaaattaattatttattttttaaattaaa

SEQ ID NO: 44077 - DNA, 876 bp, Heterodera glycines
  misc_feature (56)..(57): n is a, c, g, or t
aaaaaatgccaacgcttgttgttttttaaaatttttcgaaattctgaacttttcannttaattatttaattattttgcaaaatttaattcataaatatttttttagaacgtgctctgaaacgcccaaatgttaattaaaagttaaataaggctcttgatgcttttttatcaaaagggagagaataaattttaaaaatttttaattccttttaacaggccaaaaagtttaggcttatattttaaaaagtttcatcgacctagcgcactaaaatcgatataatctctccaaattttgcaggccttctccattgtaaaggactaacttacctgaaaaaatgccaacgcttgttgtttttaaaatttttcgaaattctgactttttcattaattatttattattttgcaaaattaattcataaatattttttcagaacgtgctctgaaacgcacaaaactgttatttaaaagttaaataaggctctctgatgctttcactatcaaaaagggagatgaataaatattttaaaaatttataattcctttttaaacaggccaaaaagtttaggcttatattttaaaaagtttcatcgaacctagcgcactaaaatcgataaaatctctccaaatgttgcaggccttctccattgtaaaggactaacttaacttgaaaaaatgccaacgcttgttgcttttaaaatttttcgaaattctgactttttcattaattatttattttttgcaaaattaattcataagtattttttcagaaagtgctctgaaacacacaaaactttatttacaggttaattaaggctctctgatgctttttctatcaaaagggagatgaataaatattttaaaaatttttaattcctt

SEQ ID NO: 44078 - DNA, 1177 bp, Heterodera glycines
cagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattcagagccgttttgagtagattagactagaaaaaatgaaaa

SEQ ID NO: 44079 - DNA, 901 bp, Heterodera glycines
aagataaggggaattgagataagagagtggattagagcacggcacggattgatggggttcaagtcccaccgcgggttgatcttttactcttccgcacaaagaacaggacggacaaaaattaatttttttaggattttttgcattttttcgtgcttttttgacatatttttttgactttttattcaactttttggaaatttttcgtgacttaaattcccagcccagtcataagagactgattgaaatattatttcgattttttacaatgtcataaactgactgagatgaaaacacttaccagctaggaatacttcccaggtggttccaaacaatggtatccccccaggcgtttttggtgtttttgctttattcggatattgttgttgcagccattctttgttgcacgaaaacacgcaatttgactgtgaaggcattttatacggtttgcagcccgtgttcatcgtatggttggttccggatactgtcagattacggtaatatttccacgcataaaaaggatttcctccaccgcaccttaaagtgaaagaaatacggtggactatttctaaaaaggccactaggcaacgagagatttaaaatggtggaaaaacaattttaaaaatgatccttacgctttctcagcttttttgaaagttttcagtcaaacgaaagtgttgttttaataaaggaggcggttctaatagagttttttaatgccaaaatatgaaataccagtgttgccagatgtgctgatttatcagcatttacctacttttaaaagtgtcaaagctgattttctttgtaaagttttctttcatgaaaataattattttagtggaaaaattgttaaaaccgaaaaaaatttcaaaaacttctcccggcgccgtctcactgtaaattc

SEQ ID NO: 44080 - DNA, 774 bp, Heterodera glycines
  misc_feature (722)..(722): n is a, c, g, or t
ggtccaaaataccaacaaaaaagtgaacgaaaaagacagtgattaaaggtcgtggagctcaaccattttccaaagttcaacaaaattcctttttacctgcagccgcactgttctttcattccaaagttccccgttaaaaagtccgtttatttcgtttccatcttttttggcgttaacataacatgacaattccacgtttccacagagaccgactgagtgccaccgaaatgttgcagttgcgaaaagtgatggagcacgtgtgggagaaaatcctttacccggcggagacggcgaccgacgactgcggtggaggcgcaagcgcagcgcattcgctggcaacgcaattaccggaaaacattgaagaacgtattgagttgttctgcaacgaacaggtggacttcccatgtacaaattgatgtgattgtaaatgctttcgtcgcttttcagaagttggactcggatatggaccttaggacggtcaaacatttgatttggaagcagggcggcgatttgcttattttttaccgtcccgttaaatgatttatttctattgtaaattgtccataaaattgttattttcaatacataataagtaaagatgaaaatttacatggcgcataaaattgcttatggtcgaacagatctgaaactattttctatttttaatccatcagcacgctttaacatccccttttatagatttaacacaaaatacaaactgngcaaaaaattcattccctttgctgggagggtaacaaaattatggaaatcact

SEQ ID NO: 44081 - DNA, 706 bp, Heterodera glycines
atcccccactttgtcatcggcaggcgatttgctttcgttcggcgttttttgagcggaagggggcgttttgaattcgattcgaccatgctcaagcactttgaccgtcgaggtggaatagagtggagaaataaaagcagcaggtgaagaagcaccggaagaagataatacggcgtaattattggattaacggggaaaaatcagcccaaaattcctttatcccccggcactttttagcggggttcgaacaccgccggcgccgctttgttgggtcggctgttgcggagttagcatccaattcggctcctcctcctcttcacctccttcgttatatgccgtcgatgttccctctgtttcgcatcttttgagcattttccagcgaaagtgaggcgaaacgctcctgacaaatgagtggtgatggatggcattgtaaatttatgccaaaaatgaattaactcacggtgaaacgatagatgatgcagcggaggagcatgctgccgactgtgaagtgggcctcgtccgttttcgtccgattgcgtcaattacggtagcatttggtggagttacggtagtcagcgactgtactgctccctcttctccgtcgtttcgtgttggcaattgtatggcattgtgctcatcgtctggatcaccaattacagtaaaactgttcgtgtcaaaacaatcagcaacaatagaacattcgttgtcc

SEQ ID NO: 44082 - DNA, 1027 bp, Heterodera glycines
ttatcccataatcctccccccccccctctcccgcttcccttcaagaaattttactccctagcccacccccctcccccttcccttcccccaactctggtgcactccctatgatgagctccggaaagccagtcacacaaattcccttcccgtcatctctctcccatattggaatttcataagtccagtccagaccggactccgcaaatccggaccatgactcacacacacacacaaatcagagaaagtgtaagggctcagctgacaaagcccgaaaaatgtcagtcggtccgcccgtctctccaattttcccggccaaaattattttcccattcccccccccactcaccccttttacttcctcccactcctcctcccacaactcgtcccccaatcacaaaatttggtgtgttgggtggcgggggtggggctgggcgtgttgccgccgctgccgccgccgccgccgccgatgtataaatacgtgggcggaggcacggaaaagggatgaacactgactgagtcagtcattcattcagtcgtaattgggcggtaacggcgatgacagaaaagagccgtaggcctagctagagctccccccttttttcacgattttttaaaatttcatttttctgcaatttcttggctgactttttttgtttaaatttggatttctgaatttttaatgaatcggctgtcggaattaatgggaattcaagaatttcgggaataggcgctcaaaccctcccctcccccccccctaggcaggcattcggaattccgaggggcttcaaaaatttcgagaaaacggagtttgtatccatgtcctgtccctgacctacaacacgatgaaaacaatgtttttccgttaattagggggcctgtcctagaaaatataattttaatttttcaccggcattttgtttttgtctcttttttttgtttacagcaaaatttttctttctttctttttttctcatttgttttgattttgtgtaaactaacaaatgctgatgatatgtataaatgttgt

SEQ ID NO: 44083 - DNA, 1042 bp, Heterodera glycines
  misc_feature (14)..(14): n is a, c, g, or t
  misc_feature (835)..(835): n is a, c, g, or t
gtatctgtataaantttgctcaagtaaattgtaaatcgcatattattagcgtttatcaactccatacttccgcaacacttatatagtttatttttagggggtaatgagctgaaattgtaagaattatacaagctggccaaaccaaaataataaatggaaaattattggcgtttatcgactcgatccttctgcgacgcctatacaatttatatttccatgataatgagctgaaattttgagaatttcaaagtgataatgaaatataaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgcggaaatattgagttgatagcgccaataatctccgacttattattttcacgaccatctttgtgaaattttcacattttcagctcattttcctccaaatgtatctgtataaatttgcttaagtaaattgtaaatcggagattattagcgtttatcaactccatacttccgcaacacttatacagtttattttgagggggtaatgagctgaaattgtaagaattatacaagctggccaaaccaaaataataaatggaaaattattggcgcttatcgactcgatccttctgcgacgcctatgcaatttatatttctagtatatggagctgaaattttgagaatttcaaagtgataatgaaatgtaaataaagaatctcacaatttcagctacttaatctctanataaatactgcagcaatattgtagaaggatcgggttaatgatattctctgatttattattttcacgaccatccttgtgaattctcaaaatttcagctaattatcatcaaatataaactctaacagcgttgcggaaatatttgagtgatagctccaataatctccgacttattattttcacgaccatctttgtgaaattttcacattt

SEQ ID NO: 44084 - DNA, 766 bp, Heterodera glycines
tcgccactgaacagaaggacagcgaaccccagcctggaggttagcaggccaacgtacagcaacaagcggcgggaatgcagaccagatacaccagttctgtccgtttccacctcatcgaatttcacgtcctctttaactctctctgcagagtgctttgcaactttccctcacggtacttgttcgctatcggactcgtggccgtatttagtcttagatgaagtttaccacctgatttgggctgcgatcccaaacaacccgactccaagacacgtaaagatggataggcaccgccagttggacaggtcttgcaccttctctggagccccggtcaagggaaacttgaacaagcgggccaacccaagctcacggtctatacgctacacctcgcaacccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctaagcaagtaacgtaagaacacgtacaagtacatgatcccacgaagcaacgcacaagcagtgcattttatggtaacgaccctgaaccaggcgtgccaatggat

SEQ ID NO: 44085 - DNA, 755 bp, Heterodera glycines
cgctacctaggctgtaaagcgattcaaattgattgaactggttggagattttttttgaatttttaaaaaattattataggtttttagtcaacatcgaggctcaagacgggcgcttcgcgcccgtttttaaatttgttggccttggacgggcgcatttttgaagccgataaacagaaacaatgccttgaggagaaaacaatattcaatcatttcactccataactttgagagttcgccacggatcgagacccgaataagaccattggaaagaacagctcgagatctaccagaagtcatggaaagaaaaaatagatatttctgggacttcttcacaaatcataattaactctccaatgtgttccagatttgaggcccccagccacaggccctcgcttctcccacgactaagtctagaatttgtcaaataaattcaagacttcaaaataataatccaacattctcttaaaacttttttgaacccaattcgaaaaaggaaaaaaattagcaccaaaaaaagtattcaaatttctccaattttgtgcccataaattccgacaagcattccggaacatagtgccaaaagaaaactaaatcgttttactctattcctttctggacttgacatgggtaccttgacatcgaagctgttgcctacgctatttctaaaacgtttataccaaaccccagatttttgaatacggctttcagaaacactgccttgtgcagaaaacaatatttcacatctcactccataa

SEQ ID NO: 44086 - DNA, 948 bp, Heterodera glycines
agaagaggtacataaatctagaaataagcatattgcagcgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaggcgcttggtggttattggagcccagaaaaattgtagattcagaattttaatggtaataatagaagaggcacacaaatttagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaggcgcttggtggttattggagcccagaaaaattgtagattcagaattttaatggtaataatagaagaggcacataaatctagaaataagcatattgcagtgattgggaagaaagatttaagtgattaattactgaatttttggggccatcaactcctttgtttttgccagagtttgtgtgccacaaataaaaaatgcgggaatagaggaagaagaaccaaacaaagatgaacgatgaaaaacagtttcaggaggcgcccggtggttggttattggagcccagaaaaattgtagattcagaattttaatggtaataatagaagaggtacataaatttagaaataagcatattgcagtgattgggaagacagatttaagtgattacatactgaatttttgcagccatcaactcctttgtttttgccagagtttgtgtgccacaaataaaaaatgcgggaatagaggaagacgaaacccaacaagatgaacgatgaaaaacactttca

SEQ ID NO: 44087 - DNA, 1506 bp, Heterodera glycines
ctccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagggtcgccataattatcgcacatgtgtgtgtttttcagcggtactcgagaggagggagtgcccggatgagggtagaattcattgttcgacggaggtgtgaataataatcatgaaaatcaaagatatagctggcggttcccgatctgacactcattgagtggaaatccacgtgctagaccaagcacggtcagtatcctcgtcatctcatcacgccctcggacgtagcagcaagctcaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccatcaagggagcaggtaggtggtgaataggaatcacttgggtaat

SEQ ID NO: 44088 - DNA, 1790 bp, Heterodera glycines
  misc_feature (38)..(38): n is a, c, g, or t
  misc_feature (58)..(58): n is a, c, g, or t
  misc_feature (67)..(67): n is a, c, g, or t
  misc_feature (1776)..(1776): n is a, c, g, or t
aaaaaatacataaaaaaagtaaattcaaaaaaaaaacncaaatcgatcggtttacgcnttgctctgngcacattcaattgaatctaatttatcataaatttcttcaaattgtgccaaactgtcagctccatacaatgcaacagcttcaggaatacgatcaacgcatttttcatttgcatgaagctaaagaacaattttaccatgaaatacctaaaacaaattggaaaatttatttttattttttagttatccgatttttagctatgaaattttgggaaaaaatgccaaaatatattccttaaaatttaagaagcagctaaaaacatattctttcgtatttttagacctcaaaagctcggaaagaagaggaaatcgcgcttaaaaatctattttttgttaataatataattatatttttttaccgcatttcccacacgaaaatgtgcgcccgcgtcaaacagtgtgacattggccaatttggccaaaatgcccgtgaaaacaatgtcgtccatgttgaagccgttcacctcatggacatgacgcataacagctgaaattgcttgtgccgacgccaaatatgtggcaccttgcatataagccggataccactcgtacggataggcactctttggcacgaacctaaattattttttttttacatttttatttattttttattataaaaaaaataatttaaaaaaacataagtataacttctatactttaatcttattttataatctcaagatcctcagtttcattatacaaaaaattattcgtttatttatttattttattttttttgttatttccgatatattaaatataattatttttataccgaaaatagctcaaaaccaaaataaaaaaatataaataataaaagagttaatattttttttttataatccatggtcatttctggtttattatttagaataattcttttaataaaaattttattagtaattttattaatggaattcaaacttttacaaaaattggaataaatttataaattttatttgtttatttttatccattttataaattaccatcggtgccctttgtctcggattggctttacgccggaaatgatccatccaaaatatgtggccacattttgttttaatgctggccgaaatttgtgctcaatccaacggtccaaccgtggcaaatgcacaattgtgtcatcatccgttttcatcaaaaattcggcatttttgcaaaaattttgttgccattccaaggcggcatgccactgaaacatgaacaaaataaattaattaatttaaaaataatcaattattaaaaaagtgattttttctatttattatttttaatttgtttataaatttagttttttcaataattttgcattatttattttttattttattaataaaatataaatattattgtgctttcattcatatcaaatttaaaaatcttattctaaaaataatttatttattacttttaaatgcaaattttgatagttgtcggtgatgccattcaaaaaaatcaaatcgccaaatttcttaaattcaagctccaatttaatttgttcatctcgggctttttgatttcttgcatcactttttggtgcatcaccaattaaaaaacgaatcaccgtgtcgtttaactaaaagttatataaataaatttaaatatttttttttataaaaattaataaatatatcttacggcatcgctggcccatgttttacgtatcgaattacgctgaaagaatgcatttcgcctggtcatcaccanaaatgagcaatttt

SEQ ID NO: 44089 - DNA, 1060 bp, Heterodera glycines
ccccgaaaacaaaaaatcgatttttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcaaaattaaagtacaggctatagggaagctattcccgaaggattcggtctccccataaatctgggcgcatcggttcggggggaatgccccgaaaacaaaaaatcgattttttcaagtgtccgtttggggtactcaaacaattatgaaaaatttttagatttttattcaagtacagttttgatagggaagcatctgagtgcctaaaataacttgtaaataaaatttggtgcgtttcagacgcagtttatgaaaaaatatttatgaattaattttgctaaaaaaataaaaaagagaagctttaaaaattaataaaaaattttaaattc

SEQ ID NO: 44090 - DNA, 198 bp, Heterodera glycines
tttatcgttatattataccagtgataaaacagtaaataatttaataaagacctaaatcagtaaaatgaacacaaaatacaacttattataaattaataatttttttataaagcgatcaatcaaataaaaatattttattgaaatatattccataataagataataaaagatattttctagatcattgagataaaccca

SEQ ID NO: 44091 - DNA, 966 bp, Heterodera glycines
  misc_feature (61)..(61): n is a, c, g, or t
  misc_feature (76)..(76): n is a, c, g, or t
  misc_feature (120)..(120): n is a, c, g, or t
  misc_feature (901)..(901): n is a, c, g, or t
  misc_feature (940)..(940): n is a, c, g, or t
ttattataattatttgaataattatttgttggttaaaatactttatttttaatttttaacnaaggttatttatatntgattcaaccattttttatttattttcaggattgtgctttccgnccacaaaatggtatattttttaaatttattcctttcaattaatatttttagcttcttttatattaatatttttaaatatgtgctttttatttaattttaagcgttcgaagaagtattgtattaatgttgcattaattattggaatgatttgttacataagaattattctattatagaaagtttaagtttaattattcgaaggttaatttatataataaataaacaagctttaaatatctcagaacttcaaaccgaattcctgcatttgttttgaattggtggcttttttggggttatacattttccttaaaattccaatcattttttaatgtaatttagattatcaattcttttttttgaacaatgggattattttcattaaatggcaaagtctcgcctgaactgcctaatttttgtccttttgtatgtgtttttttaatcattgtcttaatttgttcgtctttatattttagggttgtacgagaatcatttttattacataattttaactagaataactttttttgttttaaataatttgaataaaagttttcaatattgtttccgtatttttagtagtatttcataaaatgaatgttaaattttaatttatttaatattgaatgattcttttataccgagataagttttctgtttttctttgcacattggctctaaatgaatgccttaattgtcgaagattaatttttattaagttttgttaaaatttattgtaagagcggaaaaataatttgcttcttcttataaagatatgattgangtctttattcgtttagagttttgatccatttataaattnatataatctacaggtatattttatta

SEQ ID NO: 44092 - DNA, 1725 bp, Heterodera glycines
acgatggacggtgggtggtggaaaaatcgaaaatgatttattgatcggagaaagttgggattgtgaggggggcacaggggagggaggggacatgggaaggagacagggggtactgacctgactgactgactctctcattcactcactctcttcggtcggtggaggaggtttattggtcggtcggtcggtggtcggcggaaagaagaaaaatggaaagggggggggggggagaaatgaaagagaagtgtacataatgagagaagaaagcagcagcaagcatagccatagccaattgagaaaagtgaatgtgggagggaatgagtgaaaattgaggggagaaatgggaggaggcgaaaaatggtagaaaaacatttttttggagggggtcgatggacagaaagaaaaacagccacagaagagcagcaaagaggagggtgcgctttgctgctgatgatggttgggtggtggtgaagaattgaatcccccaaaaaaacatagggggggggggggggagaacgggtgggctgggaaaatggaatggagatggcttcttcgcccttttaacccttccttctctcgaacatattttcccgcgcttattcttatgtgcgtaagcaaaaaaaaaaaattcatggtgtttttccgtttttgtcaagtcttggacgatgtcgatgggcttttggtgctttgcacaaacaacaaacaaaaaaatgggagaaatttcatttttgtgagactttttttgaatttttttctcttttggcattttgtaattttgaattttttaggtctctttggcattgtgtgggcacgtgaatgtcaagaagtcttttaaagtgcaaaaagcatcaaaatatgccaaatttgattgagaaaagaagggtatcgccgtgccatggatctttctaagagatggcacacggcacaagcaaagaaaagtggttgaaaattgtgcaaagcattaaaaacagtcggatttttttaaatcggcgacaaaacgaaaaattccaacaaattttatggggagaaaaataaaatgaacaatacataattgtgctgttgtaacacatcataacagtcgcaatttaacagaaattcttgttcttcatcaaaacaacttgagtagccaaaaaaaacgaatggatgacgacgacacaacgaccgacggacgacactctctcatttgtgtggaacggggacgacgccgtgagggaaagaaagtgtagggggaggggacaaatgggagaggaaagagagagagggggggagagatagatagagagagagagaagagaaaagagagagagggggagagagatagagagtgagagaagagaaaagagagagtgagcgaggggggagagagagaaaaacacagtgagaaatgagggtggagagagagaagggggtggagcggacagtgggaaggagagagagatagaaaagagccagggagaggggggcgggggtttgctttgaactagctccaaaaaatctcataaaaaaaaaatattttctatgaatgatttcttaggtccacattcctttattcgtggatcgccctaattctatatattttgacataattcgcacagattttgactaaaaaatacccaaagttagggatctggggtaatttttaagaaaaaattcgttttttctttgagggggggcggcggcgttccgataggggtgaattctaaacttatttctaactagatactc

SEQ ID NO: 44093 - DNA, 1665 bp, Heterodera glycines
  misc_feature (21)..(21): n is a, c, g, or t
  misc_feature (23)..(23): n is a, c, g, or t
  misc_feature (1467)..(1467): n is a, c, g, or t
  misc_feature (1547)..(1547): n is a, c, g, or t
  misc_feature (1583)..(1583): n is a, c, g, or t
aatccgctgggcgtcgatgcncnaaatgtggtcacggtcaaagatgtcatgcaccaccgtttgtctaaagcaaattgttcatcatatcggcatgtcaccgcccgtcgattgaccttcgacagcaccactccgtttggggtttgacggaagcattgtctcgaagacaatttgcaaaatccgaaatgattcaacgaaaagcaaaattaaccaaaaaggaattagtggacggagccaccggaatgcaaaaggcgcccgtcttcccactgcccgtctccgccgccttaaatacaccgattcaatcaaaacaaaaaagaaagaaacggacagacggaccatgcaaacgtcgccacccccgagaatggcggggatcgcttcggattgaatgtcagtaggcaagctgaaagctatgaaaattaagtcggaaaaagggagagacggacgtccattccaaatcattgagtgccgttgccaattcgggcaaaacgcccaactcatcaaaggcagtcatcacaagcacacactgcgacgcaactcaaacaaaatacctaaaacattttatataaagcatcgaaatttccaagcactgattaggttataaaatagtaagtggtggggaccgaaatttacgaggtcctccagccatgtaaataatcttttttgcttttcaattaattttttctagaaagttagttaatctctttattagttagtaaaataaggcatgtgaaaaaattaaaaaaatattctatttgtatttgagctctttctattgcatttttctctctccgcttccttcatcccaaattgtgttgcaatccttcgtcgatgttcacgtacaccgatttcacttgtgaatattcgtgtaaacattcaacacagttttcgcgtccgtgaccagaatttttgaagccgccgaatgggatgtgcaccttaaacgaccatcttacaacaaaacagtaaacccaatcgttcgcaaataattattcaaaattgttacctcagcatcattgtaagtgttgacaaaaacagtgccaactttcaattgagcagcaacgcgatgggctcgtgctaaattccttaaaaaattggaattaaaatgcaataaaaccaaaatttaaattttcattacttgtaaataaatatttttacttttattttttgttagcaaaagcttattcgtcgttttgcggtaaggcccaattaaactaaaagtaaaccaaagatttttttagtgatttgaccaacaagagaataaatcggataatattttaaaaaataagtggtaattaggacatcagggtgacgatttttaatttatgcctaaggaagggtacaatgaaaacattttaaataattatgcatctccaatccaaacaaaatctacataacttactattcataatagctaaaaatcaaacgatgtcctttaattgtttacgacctaatctcatcaatatttattattanacccctctcacgtggtgcataatcccgacgccaatccaaattgtgtggcatttgcacgtgcaatcgcttctttgtcagtnttgaaacgcaaaatcaacatcacagccccgaatatntcttctttcacaatttccatctcatcgtccaaatcggtgagcacagcgggctcgaaatagaaagcttttttcacgccggatg

SEQ ID NO: 44094 - DNA, 1339 bp, Heterodera glycines
ctcgattttgttgtcgctgttgttatacactaatattactgtattattattattattgcttcaaaaagataaattgatatggcgtaaccaagctaaaataagcacattactaagcaaccaagtcaaaaataccaaaaaaagaaataacataatttgaacaattttcaggattaaaatgaatttttcgaaattttggtttgaattcgggtttggggttcgaaatatttttaattttgaaaacaaaaaaattatggggcttaaaaaaatttaataaacgcctaaagttgattggtttttgaataggtaaattaaatttttcgaaaatgaaaattcaaaataatgtaaaataacagggtgccaaattcatctaatagagccccggggggctctaatggattgggatgttttgtttttcaatcaccagcgaaggggggggggctttattgaagaggaggcttctaatggagggggactacaataggggaaaaactgtatgtaggcttgtttttcaagaaaattaatcatcgaactcccgcattttaaataacacacagaaattgccgaaaatgcctatgccacaccaaagacccaccccataataaagtcaatacgatgaaacacacaaacattccactaactaactaatgatcaaaaatcattgttttttcacaacagagtatcaaattgcaaaataatttttttttttggccttgacactgttaatgttctataaactctgacttcattttgtacaattttccctaaaaatttggcgcccccggcgggctgcaagccttaaacttcgaatttagcataaagcaaagggctatttgggctcttatgcagttttcccacaattcattaaatcagacataaaatatgaattttgaaggaaagattcggctgtgaggttctaaataagtcaaagatggatgccgaattcatgatcactgatcagcgacccttaaaaacccattgatcattactgatcagcggcccttaaaaacccataaactcatatatttattttttaaatttgaaatgaaaaaaaaaattagtggtaaaggttgaattgcacaatatcccggcatttgatttcatatcaaaaccacaaaatgggagatcgattattatcccaaaaaaaattgcaaaggcaccacagtgaatggggaaagaacaaaggggggggggggtgaaaattggaacacgaagcgagcgaagcgggaacggaaataatatagtaaagcaatagcaattcataaaaagaataacaatgggaacgaaaaacacttttcgcaaggcatttgtcggcggcgcaaaatgaaatgaaaaaggggaa

SEQ ID NO: 44095 - DNA, 1148 bp, Heterodera glycines
  misc_feature (18)..(18): n is a, c, g, or t
  misc_feature (28)..(28): n is a, c, g, or t
  misc_feature (107)..(107): n is a, c, g, or t
ttttgggttaaaaaacgnctttacaaanaaaagcgattctttcgattggaaacggagaaaaaagaaaatatcgaaagatttattggcacgggttaaatcactttccngtatgacatatcacaagaggaagtgacttaaaagaaaatgatggattgttttgctaattcactcattaagcgattcattcccttctccgtttgtttggcccttgggctaaaaatgcttttcgttgtgccaacccatgagaatatttactgacgagagtgagtcttctcacaacgagtcttatgttgtgtttgtgtgcaaacattttcaaattggcaaaggcaaatgatgcattggttttttttatcatttgccaccaattcctttaaaattccatccgttttatgaatttaatattgcccccccccccctcccccctaatcggatgattgaattttgggagtgttatggaaggataaacgccattcacccttctcaaagtcaacaactgctgatgtccgcatggaaatttatggggaaaaactcccgccggggaatgaatgactgatttgtgcattttattggcggcaaatcattcaaacgaacgaatgaatgggcaaagtgggccaatggtcgtcgggaaggttttattaacaaaacacgggaaaagcgaggagtcgagagaggatctttgaacaaaatgataataatctgattaaagggggatggatgggggcagcgataagccaattcaatcatattttcgagaatttgtttctacaaacaccgaaaatcaacaaaaaaaactataaaacccccaaaaaatcatttgagaaatccgagaaatgggattcaagtccaacagctgtaaagagaagctaagaacttcattcatgcgcccattcatttgcttggcatttcgccattgcacttgtggattatgcattaattggcttcatttcacacgaatcattcactgcccccattcacagaaatgccatttcgtggggagtgaaaatgccaatgagaaaagaaaaaatattctttaaaacttttaatttataacgtattttctgcccgttttgacattggcattcggacagaacacagagaattctgttcttcttccttccttctctgctgctgatgtgctgttggccgag

SEQ ID NO: 44096 - DNA, 987 bp, Heterodera glycines
  misc_feature (12)..(12): n is a, c, g, or t
aattaaaataanttttttcttaaacaatcgatacaacttttaaagaggaaacaaaatataaatcaaatcttaaatatatataaatttaaaaaacattctttatatatttaatataaaaggatttcacatcatccctgaaaaataaataaatttgtaattatttaaatatggaacaaattaaacatgatgtcaaatgtcaaaaaaattttaattttaaattaatttaaaaaataataaatgtaataatttaattagccattaaaattcaaaaatcaagggttatttgtattaattaaaacagtaaaatattaatagagttaaattaattaaaaaaagagaattaaaagtaaagtattactaaaactgtcgatgatgaacaaaaaaagtaaagagtctatttgacatgataaaaaaaactaaaatatgaactttaaaactattaattcaagaaagacacgaattaaaatgaaattaaataaatagattttgacaaaacaattgcaagagttagaaaaagtgaaattatatacttataatatttgaaaaaatgaaaaatatttaaaaaacgctttaattatttaaaatctaaacaaataaattgaaaccattgtaaataatatcatttttttatttattaaactaaaaacaaaaactaaacattaaaaatattatgaacatgattatgaaaatgttggaatatttgaccttttgtttgtgattttaaattattgttggcattatgttctcatttttgcatttttatttttcttctcattacttaattaattatatgttcggttctctttttctctccgattctaaaatatttgttcttcatctccttcgacgcttttattcgaattgtgtaatttaatttgtttggaattgatattataaagagttttccaaattcccgctccaaaagctaaaggttccggtcccaattaaaagccccaattcttcgaccaaatccgatcatttccaaca

SEQ ID NO: 44097 - DNA, 1029 bp, Heterodera glycines
aatctatgcagtataatatgatttaaacatttatttaaatgtaaaaatgatctatgaaatataaataaaagcggatcattttaagccaatgttctcttttttatggcggcaacagctgcaaaaacataatttgaaaaagtgtgtaaacaagccacagagaagctgaagcgcaagcagaccgatcgcaacggggacgaaaaagccgaggatgagccaactcttggaaaattacattaaaaaaatttaattattttgtgcttatccgttatatttttaataaaaaatgaatatatttgttttttattaatttttcttttttcgaattagcgaaatttttttggtaaaaatttgtattttggttattgatagggtagttaaaacaattgagatatttaaaatcattggggccagaaaagggtaatggaaaataatgcctcagaattttatttgaaaaaaatatttcactgacgcaaagcgatttttaaattgacatttaataaacctaacaaaaaataattttgttaattatttttcatatgcaacaaacaaattcaaaacattgactaataaaaaatataaatttcggtttttaaaaatttttcatttaaatcaaattcattttaaccttgggttgaagttgtaagcagcaaatgttcccgtatcgtccacaacagctgtaataccaatattggtttgaagctggacagacttggccagcacggacagttccgttgtgcttctcacccagcagttcatcaagtggaaagcacatgtccacaccttctgtaaaatatttttgtaacttagtccgttgttaatgaattttctttaatgagattttttagtaatttcaaagtctttttaaattggttttagaccattgagcatgagtccttaaatatatttgtattttttaccgtttattaatttaattttgaattattaaaacaaagtccgacctcaaaatttgaaaattctactataatttgagtatgagggttttagtcaaaaatccagaaaattctcatt

SEQ ID NO: 44098 - DNA, 987 bp, Heterodera glycines
taaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacg

SEQ ID NO: 44099 - DNA, 1649 bp, Heterodera glycines
aggaagaggtggtggtcgtggagcattgccaccaatggctgaagcctggaatgggggaaatgacaatttgggtggaggaagaggtggtggtcgtggagcattgccaccaatggctgaagcctggaatgtgggaaatgacaatttgggtggagggagaggtggtcgtggtcgtggagcactgccaccgatggactccgggaccgattttggtaaatatttccataacttcacataataaacctattatttatttatcgtgcgattatgttttattaggtccagacaacagtggtgtgggtgcacgcggcggtcgtggtcgtggagcaccaccgctggtggacttaggactcgatttcggtcagccacataacttatcaaatcaccgtacaaatcacggtttatcaggtcccgaaaccaatggtgtgagtgcacgcggcggtcgtggtcgtggagcactgatgccaatggatgatgctttcaatgtgagaaatgacaattttggtggagcagaaggtcatggagcacagccaccgatggattccggatgcaacttaggttgtatttctcaatcttaaaagtaaaactgaaagattctaggaggagaaggatttgttccgacaaagcgttcaattgctgaacttttcgaggaggatgcccgcgtaaaggacaaatatattacaattcgcgatgaagacgaaaacgtgataatcgctggtccgcacgcagacgaatataaggccattgagtacaaatccagttttgaaacatgttaatttttgttttttatgcgttggtccgagttcgaatttgagccagctttgctgacaaatattcagaaggcgaactacacagtgccacgcaagattcagtcgcttacctttccgttgatcaaagctggtaggtcataacattattcgacggatgcgaattgaaacaaatttaggacacgacttgaaggggcatgcagagacggggagtggcaaaagtgcagccttcctgcttccgatcatcgatgccgtcatgaaacttaaaaaaggtggccattacaaatcgcggcgctgctgtccgtttgcccttatcgtggaaccaactcgtgagctgaccgttcaggtgtacgaccaggcgaggaaattggcagaaggttagtgctcatttcatgaattaaaccaggcaggctttactgttttctttgaagagtgtgatgtgtctgtgtctcgcgcctacggaatgtttctgcgtcatgttaaccttcgtcaaatttctacggatggttgtgatattttggttggcactccgggacgtctttgtgactttttccaatcaaaaaatgtaaaaaaaaactatattattgtctatctcataattttagcttttgtgcgaccaaatcaaagttcttgtctttgacgaggctgaccaattgctggaggacggttttcaggctgttctgcgtcagcttaacaacgttaacaattggccccaggttttgtgtattttatttcttaaaaaatctattttttgttttttatttagcctgaaaatcgacagactctgttgttcagtgccacttttccgttagttgtccaaaactgggcagatgagtggatgcgtaaagactcgatgatggtgtccaacaaacggctggttgcggc

SEQ ID NO: 44100 - DNA, 1710 bp, Heterodera glycines
  misc_feature (1657)..(1657): n is a, c, g, or t
  misc_feature (1685)..(1685): n is a, c, g, or t
tttccctttcagtatccctgcaaagttttggggcgcttctgataagtttctgaaaaaaaagataagcctaaactttttggcctgtttaaaaagggaataaaaatttttaaaaatttattcatctccctttttgatagaaaaagcatcagagtgcctaaactagcatgtaaataaaatttggtgcgtctcagagcattttctgaaaaaaatatttatgaattaattatgcaaaaataaataaaaatttctaaaaatttgatcgtccataaataatttgtaattgatcaggggctcaccaaattatgcaggaatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccngaaagattcggtctccccataaatctgngcgcatcggttcggggggactgccc

SEQ ID NO: 44101 - DNA, 1113 bp, Heterodera glycines
  misc_feature (1021)..(1021): n is a, c, g, or t
attctctcattttgacacttacatttgaaccctaaaactctttcaaaagcccgctgtaaaattgtgcatttttaaaggagatgaatcgacattggcaatgcagacccccacttttctagaattaaaaatacatcccatttctgtcctattgtttgcccaatttatacttgataaggcgataaaaaggttgtgaacaactttttacaaagcctgtatatttgtaaattcgagaatggaaattatagaaaacactacgaaggatgagactagatgagaaatattgcaaattgagaataatctatttgcaattaaatgcggctgaaaggcttgagactaggcagataaattgatgtaaaatgaaagagcggagaagtcaatgcgatatgacatcctgagaatggttgcggcgaattgtttgccttcttcttctattctcgcctttttgctgacaatttattgacaagaagacagtagcggtgaaatggacctccgattttattcaattcgctgacattcactccccaaagttcgactggcggttgcaacattcgaaatttctgtaatattacgatgaatcagtcacaaagttacctattacgtaaatggacacgggaaattttcatttttcagctgtataaaaaaacagttttttactcacgggctcattaaggtcgagccgaaagatgaggtggttgttgacattgaggcaggggacagcctcctcagaatcgacggtcagcacgttgtagcggaacgtggcatccctttcaatgcactgagaaaacgacaaatatatgaggaaaatcagtgccaatgttgaaaaaccttcaatatgctttgcgaatctttatcttttccaaccgaaagaatttcatttgttgccacggaaatatgcgcctttaacggcaaagtgccagcgattgaaattggaattacggaataatcggcgaacgttttcgcgacaatctgaagagaatatttgtaagttcgtcgctatatgtaattcttctccgtgaattanagaaaacataaaattggatttattctttgtgtttgttagctcaccaatgccccttctgtatttgttccgtttttgcgaattccacaaaaatt

SEQ ID NO: 44102 - DNA, 1088 bp, Heterodera glycines
tgtgcgcaataaccgttattctaaatcgatatttctttgtttcaccaaaaaactttgcttctctcacactaagcttgagttaagaattaaaatttactcaaaatgaaagggaagcatttaaaaaaccaagtcgcagaaaatgttacacctattaaaaaaacatcataccattttcatttttggtacccgaaacttttattttacttgttaagtatagaagggaaattatttctatactaattgttttattcatgcatcacaaatcttttatatagtgtccatcacagttactaacaactcaaaaagcgctttagggctcccagtcatgtggtgttggggagattatttactgtggttattcagatggcaattttgtttttatagttgccaaaggactgtctaagacgcatacaaaaagcattattaattttgttttttccatgttctttgtcctttttcatgcctctgattcagccctttttgcaggtatttatcccttttatacaatttttttttcgaaattcattacagaaaaaaagaaaaaataacgaaaaacaaaaaatatatagccttgaaaggaagacctttttaaatttatctcctgtgaattctttggttatcaaccgtcgagcttgtgctaatacacataagagcactttaaaaaatggaaaattccaggcaagccttgcctaactccgtagtggaccgaattctatccaaaattgtgttgcatggaagggtgaaaattatgcaaataaaatttaaaaatacaacgccgcttgcggttaacggtcgagggtttgtcaccgtaaaagattaatgataataagaaaggcgagagttagactcctacgaaacgattttatgatttcttaggcttcttattcgattggtgaggaagataccgacccctctctaaacgacgattaaatgattgaatgcgataaattttctggaagaggattaaaccgaactttagattcgattggtgaggcattcttccactggacgaaccgcccgtgattttttctagagagaaaattttacgaataatagaatatacgtactgcgattttttatgttggaaa

SEQ ID NO: 44103 - DNA, 1609 bp, Heterodera glycines
aaaatcctcaaaaaattgatgtccgaagcaataagtcaataagccgagccaggatggaaaaacattgggatggtttaaaatctgttactcaatttttcgcagtcaaaaatttttgtgtaagctgtgaggtgacattcgatcgacccgaccgtcaccgaatggaatgtagggagcgctgcaaaaagtgttgccggatggggttcgggttcccctgtttggatgtttgtgaggcgatacactgtggagaatgcaatcggaatttctacaacaatgattgtttcgagtctcacaaaaagacagcttgtagggagtacaagaaatgcgaaaagtgtggagagacacacaacacaaggaacaaacacacgtgtggggagaaattctgtagaatttgcaaagtctatcatccgggtcggcaatgtttcattaaaaaaatcaaactccgacagcagaaagcataccgaattgtggcttatgacctcgagacgacggttgaagggggcgaacacaaaccaaatcttgttagtgccgcgcatacttgtagtgtttgtatgggagaagagagggaatgcgaaatttgtaacagtccgcggatgatcacctggtctgtagcagatgggtttgaaccgatgagcgaatttgttgattggattttgggatttaaacgatttgaaacggttgcttttgcccattatgctggaaggttcgactcgcattttgtgttaaaagagctgactgaaagaggggtcgaaaccgagttgatgatggcagacctgaagatttatcaaatgaaagcgcgtggtgtgtattttcgggatttctggctgctcagccaaaacaagttggcagatcttccaaagactttgggtttgaaaaccttagcaaagttgtacttccctcataagtacaacaaaaatgtgaactttggaaaaaaattgacacacctaccaccccttgaagattattgtccggacaatatgaaggaggaggaatatgctaaattggtaaaatggcacaatgaaaattatagaattgaatttgagctaggttagagaaaatctgttttccttttaaaattgaatttaggagagcagctcaaggtttattgcgaaaatgacgtcgaaattttgatggaggcaattttgaagtttcgtcatatgtttttggagattactgatgggatggatgtgttgaaggacagtgtaacaattgcgggggttgtgatgagaatttttcgaacaaaatttttgtgagaaaatcatctcccaattattccggaaggcggttatgagagagctgagaatcagagtaaaattgctgtgaaattttttgaatggtgggctcaaagcaaaagagtgagacttagacacgcatgcaatgggggtgaagtggaaatcgggggattaaaagtggattgtatcatcggagctgagaaaaaaatcattgaatttcaggtaggcagaatttccttccctattttattttttgctaaagggatgtgcgtttcatggatgtccaaaatgttttttgccctggaccataggacccaatgggcgtgtatggaagtaaatttccgacgaactgagacacgaatggttttgagggaaaaatg

SEQ ID NO: 44104 - DNA, 1615 bp, Heterodera glycines
ttcctaaaaacattctaaatcagtgtaattgatgtacttttctaatggaaatcaatgaataactttttcaagcaataaacgaaaatttttatatttcgcatttagttttgacattagtcatatgaataggtttcgtgatcaacaacccttaatgacaatcgctagtttagattattaagggtataattataacaaaaatttattttttaatgattacacaagaggatgatgatcaatatttgatatttatttaaagtttttcagttatttaaagcattttatatgattaattgtttttaaatttcaatatttattgcagttttaatttaataaatagtttataagaatatcgtatccccatctcttattgtactcaatgtcaagaatagttttattaattgataaatgtttcaataaacataaatcaataaaaatatattcagttattattgaaaattttgtatgagacaagaatttcagttttctgtaaaaaaataaattcaatatattttattcgaaattttattttatgaatgcattttatttttaagattcgcatcattttcttaaaatttataaatagtttatattttttttaatcgtatgaattatgtattattcatttgtttttggtcttaataataaggcaaatgaaatactattatgctttacacacggcatcaagctgaacaaataatatctctcattattggatcttaaacgaacaaataaaattcgtagtacgcgaatgtcgatgaaattatattatttccatgagtattttctatttctgtctattctctgaattttatttttttttaagaattttcacaccttaatcaaatgtaaataataaaattaataaatccaaggtaagaatttttttatctctagttcttttggttttcactcttgattttcttccataatttttaagtttcttcatgaatgctgtgacattttggtaaaacataggaatattggtatttgattcgctcattagtaaaaaaaagcaaagtaaccggacttccatcaatttaattaaaactattcaactatatgaatgtttttgtatttataatttaaaaataaccgccattaattgtcttacctcttcacgtgtgttttaaggaatttaatttcaagttccaattagaatgaattttttcattactttaatattacttttcttttcagaaataggtattcgcttattttttaatattaagttaatttttaaatcaattaataattttaaatcgttgatgtatgactattttgttattcattctgcagaagatgcgcgcgcctctttctttagcaaatcagcccatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttcgctctatagaacttttttttcgccttacagaatttcttcatattttgcatatcgatagagaaaaaaattctgaatcgattaataaggaaatttaatacaaaaataaggccaactttagagttat

SEQ ID NO: 44105 - DNA, 1201 bp, Heterodera glycines
ttagatcaaaactgaatgttattgcctgtttgtaggtgacagaacgccgaaaaaaggcattacaacttctgcatgagattgcgccataatgaagacctttaatttggtgacattatgccaaatcaattaacgcggctcaaaatatggtatgtcaatattaatcaacaactacggtatgttactcatcaaatatatacagtatgcccttgagttaacgatgccaaatgaatgccaaatttaaatattccgccaaccatctgctggcgcgttgcaaatggcacacagactgttggagtagtcaagccgtgacttttttgagcgcctcgaaggcggcggttgtgccatgttggtggcgacaacattggcacaattgctgccagccggctcaaatgccattggtgtttgtggcgaaccgaacggcgtcatcatcatcaccgttgttgcaagcattcgatggttggaaatggcggatggtgaaagcatttggtagttatgtgcagctagatgtctgactgctgatcagttaacagagtgatcggagctatgtttttatgtcgtttgatacacctttaaggataatctcatttttgggtcatttgatcctaatcaaattttatcactggtcacaatgatccgtttggataagaaaatggtgtcagaatcagtgttttagaaaagagctgatcattttggcaatcacagtaataatcacagatatatgaataaagtttcgatcaccagtcggtcagagaactcgattttaaacgattcgatcaatgatcaattttttcttttaaaatatttcagtgatccatctattatcattaattttcgtttagtgatcacatccaaacagtgatcattaggtttaatagtgcttacttctctcccttacgccttccacaggcgaaatgatccgatcacacacaaattttgctgatcacttttaaatttatttttgcgtgatctggcactgagattatgttgatcaataaaaaatacagatcaatttcttgggacacacaagttgtcaatgttttttcctgttattttggaaaaattttaaaattaaaataaatttgtaaaaaactataaaatgattttaaaacaattaaaatatagaaaaattcaaattttattagtaaaaattttgtgtgagtaaaaaattgaagaaatttctcattaacaaatactttgagga

SEQ ID NO: 44106 - DNA, 1172 bp, Heterodera glycines
cgccgattaaaagatcgatcaaatgtttatgggagccggaatacaaaacatttggccgacggcaaagtgcgatgatcgatgaagcgacgacaaagaagaagactttaattttgcataaggtgtttttgtatgtataggctaatgggtaccatatcagacagacagacaaaccccccggggggagtcttttttattttatcctcctcaaagggagagggggtcaaattatgggcgtacaaaattcaattaattaatataccaattttattgtttaaattaatcaggaaatttctttagttcaaaaaagaaccgctaataagccaatcatctgttttaagtttaaataaatggctttttgtttaatttattggcattgtaaatttcttttttttttttaattttgataatctgttccaaaatggccgtttttgttaaagaccaaaattttgtgccggaaaaacgagtcgacgaagctgggcatattttaaatgatccgaggttatcttcctattttacttatcgcattttttccatgtttattttcttcagtaaaagtttggccgatcgtttccgtgcgcttttccttctcagaagcgtaaaaagcgacagggctgtccattggatttgcaaatgcttctccgacccatcggctcttcttaagcacgaacttgcgtattgtcttggtcagatgcaaaaccccgcggcgattcaaaaattaatcttcgttttgcaagacactgaacaaggcgagtaaatttctttttgtttaacattttcctttgtctttatttatatttttgtatatagaaattcaacttatgtaataatacatttgcttttttcattaattccacttaattcagaaccaatggtccgtcatgaagcggccgaagcgctcggagccatcggcgacccgtcgaatgagcacggactcagcaaactgttcgagcagtacagcggtgacgcagtccgagaagtggcggagacatgccttttggcactgcgacggacgcaatgggttaaagagaagggaaaggacgacacggaaagtcggagcatttacgattccattggcaaggaaatttgtggaaaatttggttttttaattgtgccacattaagcgtttgtcagaccacgagccagcagcggacggagggaaaggagcagccgaa

SEQ ID NO: 44107 - DNA, 995 bp, Heterodera glycines
tccaatcgcctttatacatcgcattatgagcggtaaaattagcagagtgcgaaaaatcgcatggatttaagcctagaaaaaatggtctaagtaaaaatcgtaaatacgctcaaaaagcttctcaaacaattttagcgcttccaattccttctacaatcgcctttatacatcccattatgaacgctaaaattatcagagtgccgaaaatcacatgtgatttaatcctagaaaaaaatggtctaagtaaaaatcgtaagtacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaatttttttagcgcttccaattccttctacaatcgcctttgtacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaaatttagcgcttccaattccttctacaatcgcctttatacatcccattatgaacgctaaaattatcagaaaggcgaaaatcacatgtgatctaagcctag

SEQ ID NO: 44108 - DNA, 844 bp, Heterodera glycines
ccagcatattttttggaaaactctaatgcttctctctagaatttgggtactatcattctcattaagaattataactgtttaaaatgaaatactttttgatactattcatttaacagattcaaaactgtaaaagagcgatttttttgaatcaaactgaagtaatttctgaaaatctaaattatagtcattccttccaacaaaacagaacaaacagtttaataaaggttattatacaacaatttattttatcaagaaaattttaatacagctacttttttattatttgacgaatgatattacaaaacattcaatattcctaattttatgccaattactcatgggaaaaaagaaatgccgtcgtaaaaatatgcctatagtgcctgtggttgggtaccagcatattttttggaaaactctaatgcttctctctagaatttgggtactatcattctcattaagaattataactgtttaaaatgaaatactttttgatactattcatttaacagattcaaaactgtgtaagagtgatttttttgaatcaaactaaagtaatttctgaaaatctaaattaaagtcattccttccaacaaaacagaacaaacagtttaataaaggttattatacaacaatttattttatcaagaaaattttaatacagctacttttttattatttgacgaatgatattacaaaacattcaatattcctaattttatgccaattactcatgggaaaaaagaaatgccgtcgtaaaaatatgcctatagtgcctgtggttgggtaccagcatattttttggaaaactctaatacttctctctagaatttgggtactatcattc

SEQ ID NO: 44109 - DNA, 766 bp, Heterodera glycines
  misc_feature (506)..(506): n is a, c, g, or t
attctttgttttaaagtgtatggggtggaaaccaaacgtttcagctgaactcgacgatggtcccttttttggaccccgaaacaccaaaatggagttggcattccaattaaaaattatatattgaaatttaaattgtttttttcagtttgtcttagcaacaattacaccgactttttgtacacctatgcgccgagtccgtcgtgtaaaagtgccgggggatgcgaatcggagtatttgccaataaatttggcaaattatttgggtgtggcttttccttattcattttccattcaaagctttctgttctgcgacaccaccaatcagagttacccatttggtccgacttgttgctcaaaaattaagccggggggcgactgtctcaaattcatcggaaacagtaacaatttaaataattagtagtttggataaacaaatttttggatttaaatgagctttattcagttgggtaaataattgtcatcagtgggacggggatttgggggggnggggggattaacagccggtaatcccaaatgaatacaaataaacacaaaggtgatcagccctgcttcaactcctcctgtgactcaaacagcggcacatgcgtccaacaacagccaatggcattgcagcaagtaaaaccattattggacgagtagggatgggcccaatcggggattaagaccagttttatggcgtcatgctctggaatatatttcagtttcgtattcgtattgatggaaatagcaatgggaagggaaatggc

SEQ ID NO: 44110 - DNA, 635 bp, Heterodera glycines
tgatcaagacaaaaaattagcctagaaaaagagatcggagaggacccggtttttactggattcgaaaaccggtcctacgatttttggtaaaattctgttttgagaggccgggtcggaaaccggttgcttttgaaaatatcagtccggtccggtcctgacatttttgaaaaatccgattttaacaaatttcgaaacccgttcccaagtttgaaaaagtcgaaaattcaaaattttcaagattctcttttatgctcgtatctgtatagaatgattattttttgatgttgcactggttcgtggttaaatacagtttgttttaatcaattttggaataaaagtgcgaattttgaaaattttggattttaaactgttcgagttcgggaccgggattcgaaattgtcaaacgaaagttagattcgtgatcagagaccctcaaaacctactaaaacattttttcacgaccttatagaagaaaaaaaaaattttacaaaaaaggatcgaccatcggcagtattaacaaaaatctcaataaaaacttgtgtttaatttcatggattttttctcttttccccctaagcccccccccccccctgttacgccgcacttggccctatttatggtttaaatatattttt

SEQ ID NO: 44111 - DNA, 1417 bp, Heterodera glycines
ttttcttgattttttagattataatattatcattttctctatttttaactttatataattactatgtaaagcttatgattataattaggttttccaatcaatacaaaccatagttttttcaattcggattttatttttaaattttccagaacttaatatttcattagtaatatttttatgggaatatttctattaaaatcttatcttttctcattttttttacatatgccacctaatgctttatactacctttttcaagttgttcattttataaagggcaattaatcttcttttcaaattatattacttgcaaatttttaattttaatatttctaataattattcaaattgctgttaaatgttggtttctatttcttttttgggttaattaattagttctttgagatagaattaatttcctatatttaggctagaattatttcgttaatttgaataaaagaatcatgcaaattaatggaataaaattttataaaatataagttcagatgaattttcaaatttgaagcgtaattttaattgccaatttttctctaaatcaatgtttaaagtatgtgaatttacgtttttactttattatataataaaattttttagaacataataataattaagtaaattttaattcatgtcatacattcatgaattataagtgaacagatttgtatgtttaaattttactgatataaattaaggtatttgtaggctgcgaacataattttaataatttctaacattaatttttaatcaatttttaataatgaattttaaattattattttagatttttcgtgaccacattttggattactgcactatcttttatgaatatattgctttctgaacttagtttcttttttttaaaaggatattaaatataaattatattaatttgttattttaatgtattaactgcttattttaacttatttagttatcattatctcacgtcttaggaaaatattctatatgtgccataagctggttttaataatatgtatgtgcaaagaatctattaagatttataccttattatgaaattccaacaataatatttttaaagatatcattaattctgaatcaaaatatacaatattatctgaatttaagttcattagcatttcttttgatttttgcaatgaaatcctttattatcaaaaatataggaaagcataattaacttttttgccggtgtattttgcattatgtgtctgaatttatagtgaaagatacattaattaatcattaagagcataatataacataaacattataacaaatgtgattaaaataataaccaaaatcttttttattctcttcatatttttaattcgattatctaaatttaaaaaataaatatctttatatttttgattatatttcgtaatttttttttgtt

SEQ ID NO: 44112 - DNA, 1042 bp, Heterodera glycines
agagatatgatgaaattctattattaaagtaaaatgaatttaaaactttatcaaatcaaattaaaaatagatgatacactcattctgggaaataaacaagatattcaataaaaaagtacaaaatgatgaaattataaagtaaaataaattaaaaaaagaatcatagtttcacatacttaaatatataacttaaaattctgaaatacgagaagaatttcaataaaaaaaaattattaatgaaaatttattttgaatattttagccacctaagtgtctaaaaaatgaaatatatgtattatcattttaattcatttattagtaactcacaatagtcttaatgacatagcatttaaaatttaaatttcatggctttatccgtttccggtacttgacacgtcagtaacgagaaagtttaatttaatggaaataaaaaattatatgtttgataatttacatatatcactgttaatttataaattagcaaaaaatttcagtgaggttaaaaagttttgaccaaaatgaaagcatttttaaaattttaagccatgtaaggaatattaaaacaaaatatacgaaatttacaattttctagcatgaatgattatttgaaataaagatatttgaacaaagaaattaattgtttgcaatgtttttacagataattattaaaggggacgggacgaaatctcgccgccgaaatctcgccgccgaaatcgccgccggaatctcgccggccgaaatctcgccgagacaaaatctcgccgccgaaatctcgccggctgaaatctcgccggccgaaatctcgccgcagaaatttcaaaaaaaaaaaaattcaaacttagaaatttttcaaggaaaaaattttagaaaatttttttataagaaaattccaaaaaaaactatttgctaagtttttttgaaaatttttcaaaaaaaacagtaaattttcataaaatttcaaaaaaaaattgctgaaaaatttttcaacaatttttttatttaaattttcttataaaaaaatttttctaagaattttttcctt

SEQ ID NO: 44113 - DNA, 978 bp, Heterodera glycines
  misc_feature (957)..(957): n is a, c, g, or t
ggtgtacaaaaggttcaaaatgttcggattccatttttactattgagattgaccaaccagggagggcataacgaaatttttgaaacaaaattttagattttggctgtgtttcttacccattttaagcccgagccattactagagaaattatgagttaagtctattttaagaaaattttggcttttcaaaatcaccttctttcactttgcttgtaacttttatgggtaagtataagtttcttttaggtgaccaccgcaaaaaagacggacgcagccaatgaagacggctctcccgacgagaaatatctaatcgcaacttctgagcagccaatcaccgcctttcatcgtacatttttatccatttattctgctcccctcaactttgccatttgtaaggtgacgaatggcttaacccatcggatttgccaatcaaatatgccggaatgtccacctgttttcggcaggaggtttgtatattctgccaatatttgtttctttaatcccatggcatcgtcaccttttattttcacttttttaaggtcggaagccatgggagagacacccgcgggattttccgtgtgcaccaattcgagaagatggaacaatttgtcatctgttccccatttgacaacgaatcgtggaagcacatggacgaagttagtggacttttgaaaatatagtccattaaatttaattctttttaaaattcagatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggaaaggtaaaaagtgatttgaaancgaaggatcagccggcaatca

SEQ ID NO: 44114 - DNA, 992 bp, Heterodera glycines
attgcgcaccgccctccctctcacgctcgagcgcttttgtaacgtataaaatttctcaaaataagagatagtcatttttcttggatataagataaatttaaaaattctctgagaaattaaatggcgattgcgcaccgcactccctatcatgctcgagagcatttgtaacgtataaaatttctcaaaataagagatagtcatttttcttggatataagataaatttaaaaattctctgtgaaattaaatggcgattgcgcaccgcactccctatcatgctcgagagcatttgtaacgtataaaatttctcaaaataagagatagtcatttttcttggatataagataaatttaaaaattctctgagaaattaaatggcgattgcgcaccgcactccctatcatgctcaagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaagaagagatagtcatttttcttggatataagataaatttaaaaattctctg

SEQ ID NO: 44115 - DNA, 1017 bp, Heterodera glycines
cgctaaaattatcagagtgcggaaaatcgcatgtgatctaaccctagcaaaaaaatgtggtaagtaaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagaaaaaaatggtgtaagtaaaaatcgtaactacgctcaaaaagcttctcaaccaattttagcgcatccaatgccttctacaatcgcctttatacatcccattatgaacgctaaaattatcagagtgccgaaaatcgcatgtgatctaagcctagcaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaa

SEQ ID NO: 44116 - DNA, 1040 bp, Heterodera glycines
  misc_feature (152)..(152): n is a, c, g, or t
gtccgcgttcgagaaagctaaggcaattatgttttcagaacttctgctgacccactacgacccccacactttccgatcgtcgtagcggcagacgcgtcaaaagatggcatcggcgccacaatcagccacatttttccggacaaaaaggaaanagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggcctccaagaaaggcatccccatttatgccgccagccgactacaaagatgggccctaatcatggccaattacgattttgaaatacggtacatcaacaccgcatcatttggccaggctgacgttctctcgcgcctcattgccaattatccccgaccagaggaggatattttgatcgccaacatctgcaccaaaactgagtgctacataagcaccattctgcaaaccaaaacggaacaacttccagttacagcaacgagaaaatcggtcatgacccaaacaacccccctttttggtgtgacaaaagtaatggagcaaaatgtttaatcaccaaaaacttagttccaagttggcagaaaaaccagaaataattcatgcgaacataacttttactgctgatgaaaaaagtcttttataccaacttggtcagatcactcctttatggtgatctgaaaagacaaaaatggcttgaaatctggaaaattttcgaaaaaaattcttagggtgttgggaaattttttttgaaaattttggatagggctgccagaaagagcataaaattccctgccggattgccttttggatgatgggtctacgactaatacgcgcatagaaacagatcgtgaaatattggacatctcaaaaatgaccgatttctaccgaatttcaggggaaaatggtagacaatcacatcatttttatggtaatcaatagtgaccccctctcttgctctg

SEQ ID NO: 44117 - DNA, 1563 bp, Heterodera glycines
  misc_feature (35)..(35): n is a, c, g, or t
  misc_feature (97)..(97): n is a, c, g, or t
  misc_feature (111)..(111): n is a, c, g, or t
ttcggtcggtcagcgttcgggcagctgtcacagcncaacaggaaccacagtcgccttgaaattttttgtaaatgaaaaaactttcaagaaatacggnttcttaaaagtttntaggggcgtattttttgaaaattttaggtcaattcttaggagtgtattttccgttttattgcatttttgttaacatattttggcaaaacgtcacaatagttgaaataattcggaacaggacggttcggtgcccgccgtttcggtaccagcctaagttttataatgctgttcgggaccgaaaatttcccacgactcttcgagactcgagagtctcgaacagcactacaaatcatcctccaatccaccttgtgcatatccactttggatgatttcggcacaatctttccatgcttcgcgtgcgtcaaattcagttggaagatcatttttgtcttcctctccatcggctgccttcagctcagatcgcaaatggatgttgttgttctcatttttgtcctcctcaacagtctcatcgacaggagtgccaaaaaaattcaagaaatcctcatctttcatcagtgcaaatctttcaacgacaacggcctgaaaatgagtgtttaatctgaaagtaaaataaattggcaaaacaaattttctttgtgattttaatacttactatgtatacaatacatatttttcaatattaagcttcttttgcgggctttagaccctaaaaattacgggtgcaaaaaaattttcaaattttctggaatttttataaaaaatatttcttcacaaaattaaaaaacggttgaaattttccaatttttctttgtaagctctttttgtttgaaattttattttaaattttcgggggaggggggaagaagctgccccaaatcccggccattatgacgccaaatttcatacccatgatgtgttcatcatatcaacttccttctgtgcggctgttagcctctctgctctgtactccgacttaaaaaaacatgaaaattaatttcgttattttaattttttttaattatttacaaaattatttggaaattcatttggctcctcctcaattttttgttccaagcagtagacagtagtatcagtgctcaacgccaattcgtccgaataggtgactaataggtccagcacagtgccaattgtccagccaaaattgaactgggtaattaaattaacagatattttttcaaaattcaatcagtcgaattaatttggatgaagttgagctaagttatgcatttatatgtataattttttgttttcggacacattggcggatttaagaaacgctacagcacaccctcccttcacatggatattgtctaattacagtagtaattttcactttctccctctcacttggacattgggtaatactgtgctttgtccccccccctttttttcgaaaaattttttatgtttccaaaagtcatgaaaacatgtttcgaagtcgggtctagaattcggaattgtcccaaaagaatgccggattcatgatcagcaactccgaaaaccttgtaaacatgatttcatgacttttgg

SEQ ID NO: 44118 - DNA, 1007 bp, Heterodera glycines
tttgccagcaaaaaatttttgatcagatcaaaggcctgacctgtaggttaggcaacgtaagaatcactttttttggacacttcagtaccaggcgaatagctcgtaagggtttgctcggagcagggggtcgccagcggacttattgtagagctcaatgagctcaatttttccaaatttaaaaatttcaaaaattttcaaaatttttcgagttaggcctaaaattcggtttttcggtttttgaattttatgattttttaacgatttttccagggaaaacgaagaccacttccaaaacatcgttttttgagctctatcgattagtgatgtttttagaaaattttcgattttttccaggaaatagaaaaattttttggcctaagcgggacatttgagtcccgggcccataactcgtcgggggttggttctagccaaaaattgccttagggcaaaattgtagagcttttaaagttctatcgaatggtgtactaaatgttcggaaattttcaaaaattttcgagctaggccccctagaaatttttgaaaattttttttgggttgaaaaggggggtgaaaaatttttttctgtggtattttgagatgctgattacgaatatgacctttgtttttcgtttcataatttttagaattttttaaaaattcgaaatttttttcaatttttttgaccctcgggattttggggtaaattttgaaaattcgtagctcattttgaagtgggacgattttcatgcaattaagctttaaaaatagcaaaaaatcgggagaattttatgaggtttatttgaaatttataccacaaaaacaaaaaaagttattccagaaattctggaaattttcgatttttcagaaaaaaattcagaactcggttctgtaaaggtgtttttgaaatttttatactgaaaaaatccgcgattttttgctctataatttaaattttatttcatgtttttatcacttttttgaaaaaagtataaaaaataaagtgattt

SEQ ID NO: 44119 - DNA, 1275 bp, Heterodera glycines
cgaaataatgccaaaataaatggacgtcctggaaaaaaataattgctgactccctaacgaatacctggattggttttgctcgttataattttttttcaaaaaacgaccatctcttttttcggggtaatacgaaataatgccaaaataaatggacgtccttggaaaaaataattgctgactccctatcgaatacctggattggttttgctcgttataattttttttcaaaaaacgactatctcttatttcggggtaatacgaaataatgccaaaataaatggacgtccttggaaaaaataattgctgactccctaacgaatacctggattggttttgctcgttataattttttttcaaaaaacgactatctcttttttcggagggaaatgcaatttgggaccaaacgatggccaaaagagggagggggggggcaaagggatgcgaattattggcgtttggaaaagtttaattttagaagaaaatcattgaaagaaatggaggcattcgaaagggggaaatattcggcaaaagtaaagtgagacgaacattaacagaagagaaaagagtggccaaaaggaaaaataaaataaaaaacaacgaaagaaaaaagagggaaaacacttttaaacattcatcaaaataaagaagaaaaaaacaaataaagcacgcttcgcgggtcaattatttttcaatggttggcattggcacaaagaaaaaagtacaaaatgcttttacatttattggcataattatatgtgccacctttaagaataatcatttgatcaaattaaataaatatttgtgtaattatttatttaaacacaatttctctattgtccatgcaaattttctcataaacattcagaaaagcgcttttgcattcgtaacgagcacgaagccaatcgtacaaagtggccttaaaattggaaattataatcaaatggagtgaattgaggagctgttacatcgaacatatcccaaaactctgctgctgtttggtgggagtcggcacaaagcatttggaatctgaacagattgatcagtacggtagacatcacgggtcaatgccccctactgaactgatcagatagcgatctgaccaatggctgaccttctatcaagctttgttaatgggactgatcaatgttctccgtccgttgactgtttccattgtctttccccacttacccttgaacttctctgaccattccttccaccgttcgcattctctacaagggggtcctctaaagctctgcatcccattgcattcggaca

SEQ ID NO: 44120 - DNA, 920 bp, Heterodera glycines
gtgtgactcggtgtaaatgtgcgaatgcgcaggtcacgccggattccggatgttcgacgtaaaaggcgaaaatgggcggatgatggctgactgcttcgccgatgaacgtcttctgaaacgtgggaacaaatgttagatttctcaatgagtgacgaggctatcacttaaactggacctggttggttgctgagcccgggaacggtccaccggcggttcggcttgcggacaacggcacgccaggcagggtccaacggcaacggaacacttcgcccaggatcggattgtacggcttcttcgcgtcgtcggttttgcgtgcagggtagaaggagttcaagtagtatttgaggacggcaaggaatctgaaaaaattgttgattcaaaagcgttgttgtcaaccaatcgggaaataaacaccgcttctcagcagtgttctcgtaggcgccggcgatcagttcatcaagctgaaatgaggtaagattgaacttggaaaaatttaaaaaagctgtgttcaccgaagaattcggcttacatttcgaggagagagcgtcgttccgagcacgaaggtgggcagcgccaaattctgcagagtctgaccggtgccgagctgaaaagagaatttctattaaaacaattcatcgaacaacgcgtcgtctacctgggtcactaaatgtctgaacacgccggcctgctcgctgttccagttgtcccgttcgtccgagttgttgtagatgtagtcgtagtcggttccgttggtgtcgtagttgccccaatctggcgcttgcattttgaaatccgctgccgctaaaaattgaaggggaaaggaaatcattagaattgatttgaagactatgaacaaaaacaactaaaaaaaagaagaaaaattttaagaaaagaaattgtggaggtggagaagagatatc

SEQ ID NO: 44121 - DNA, 841 bp, Heterodera glycines
ccaaaaagttttttaaaaaccacgccgcaaaaaaaaacgttttttttttttaaaaaaagtcgtagacttgccaaaaatcgcaaaatttggcagtttttggtgaaaatctgttaacaaattgcactcaaatttccaaaattttccccggcggcgcctatcggcaccgccggacccacccaccccttcccaaaaatttttgaaaaaaccgcgccgcccgcaaaaaaaggaattttggaccgtttcgaaatccctatctccatctttcaagtgaaaattattttttataatttgtcttaattacaaaaatagttccttctttgccttcaaatgccaatgtgactttgcacaccgctgttgacgaataaaatctctatgttttcaaatgactaaaaacaatggcgtataaaaattgatttatttgaaaagcaaaaaaaaagatcagaatagcgaaaaaaaaggcgctgtagaaaaagttggaccgtcgtatgaaaaaacggtcccgagacaccccccccccctgtcccaatcgtccgtcgtacggcccttggtctgagacaccccttgtatatggtatgtatggttaaatttgcacaaaatgtattgacccaacaatttgccattcactacacctacaacaaccaaaacaacaacaattgttaccttcgcttgcaggtacagcgtgccgccctttttccgatcatttgctgtgaacatgtgcccatatttccgctcaatttcctctcggtccagcggtgtttggacattcaaaatttgtgctgcttcctgcaataaatttatgcattcattaaaaaaaataaccacaaaaaatgcaaaaaatggt

SEQ ID NO: 44122 - DNA, 904 bp, Heterodera glycines
taccttattttttttaattttaaactcaaaaaattggcaaaaattatgccttttttgggccaaaggcggctgcataatgctattttttgctctccggcgtcgaccagtttcgaataactttttgtcccgaagagcaaaaaaaacataaacttttcgtctgcccctcccgaaaaatttttttctggttccgggcctggggcgacctctcctacctcgaaaatacacatctcagggttttcatcgactccgatattcccccctttggaaatgcgtttatttaatgcaatttttccgttatccgctgagcaagtacataatagccgtagtaagtggtctgcttcaccgagtacttcatcaatcagggcctgctcgaactgttggtgtgtgactgagcacatttgttatcactgtttaaccctaatcacatcaggcggcatcaatgattaatccacccgattcattactcgcaaatacaaaaaaaaatagatttttccgtgcctgtggtcagttagtgttccctcaatttttccttttgcctctgctcaataatccccccagtccatttttccgttgcctctctctgagaatgcgtcggattaattgggtcaaattcaaattatatgatggctcccctccccacattgtacctttttttgaaaatttatttaaattaaattgtaaaattgattttgtgaaacccgccaacaaattttttacacctactaattggtcatttaattacagagaatcccattttatttcaaaaaaggtgtgaatttcacacctggtcattgacctcttgaccccccctcccccactcacatttcaaaaaaaaaaatcccgacccaacccctcaacacccacggacccctccccaaactacgcaataggtttaggcttaaac

SEQ ID NO: 44123 - DNA, 1034 bp, Heterodera glycines
  misc_feature (1006)..(1006): n is a, c, g, or t
tcataaatattttttcagaaagggttctgaaacgcacccaattttatttacatgttagtttaggcactctgatgctttttctttcataatggaggtgaataaaattttaattgctttttaactttgggaaaaagtttaggcttaactttttagtgaaagtttgatcactcatatttttttagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggggcgaaggtccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaattgtaccaaactttgcagatactccccggtaaaggactaacttacactgaaatgagcgccgagctagcttgctcaaaaaaatttttcgaaaatctgagtctttcgtttttatttattttttgcaaaattaattcataaatattttttcagaaagggttctgaaacgcaccaaattttatttacaagttaataagattctctgatgcttttctatcaataagggaggtgaataaaattttaaaaattttttaattgctttttaaatatgccaaaaaatttaggcttaactttttagtgaaaattcgatcactcatattttttgctaattgagcagaattataacaaactttacagggatactccccggtaaaggactaacttacactgaaatgagcgccgagctagcttgctctaaaaaatttttcgaaaatctgagtctttcgtttttatttattttttgcaaanattaattcataaatattttttcagaaag

SEQ ID NO: 44124 - DNA, 1051 bp, Heterodera glycines
aaaacaaaaaaaatgtgatttttttcaaagtgtccggtttgggggtactcaaaacaattatggggagcaaaaatcccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggcctcttcgcggcctcgtggtgcgcatcggttcagggggactgccccgaaattttgaaaaaaaaattttttggataaaaattatttaaataaactgatgacaagataatatataaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccccccgcccttcaaaattttgaaaaataaataaaataataggagactcagaattttgaaaattttttataaaaactgatgacaagctaatgtgataaaacagg

SEQ ID NO: 44125 - DNA, 1495 bp, Heterodera glycines
ttgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgaggcataagcgcccgaaggcctttggcctgaggaagtgtcctaaccggaaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaacgagataatggttaacagagacaaacggggccattc

SEQ ID NO: 44126 - DNA, 912 bp, Heterodera glycines
atttccgcagctcttacggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatgccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaataattcacaatttccgcagctcttagggtaatggaa

SEQ ID NO: 44127 - DNA, 965 bp, Heterodera glycines
ttttttccgtaaccagaaattttgagccaaggcctcaaatcactcaaaatcgctttattgaagatcaaaattcaaacagacaaaatttcacggatagacagcagccaaaaacatacgtgaacagaaaccccaactggaaccaagttggtaaccaaaacccgaaccaaaatttccaaaaccaacaaaatttgccaaccatcgacaaaactcaagattctccgaattcattacaaatccaaaaatattctggtacccgaactgcaaatatgattgtgatcactgaacagcgcgaaaacgaatgcgaagacttagttttgtgcaacaacctttcactaaaagaaattccagattttgagaaatttttcaattccttatccactcacgcatccaaatttccatccgaaaaacctgcagaaccagaaatttccgaatgtcttaaattgacactgaaagtggaagggcaaaacgcaaaaactttgggagactcgggtgccgaaacgaacattgtcaatcccgaatttctttataatttggcaaaaaaaatgaagttggatttgatggattggggatttaacccaaacagtgggtctgcaaaaatgccattcgatgatattacaattattggagtcataaatataccagttgaaactacacattataagacaagtgttccctgcttgatctcgaaggaaagatttaattttgatttggttttgggaacaagcgcattggaatcgctcggtttttacatcgggaattcaatcacaaatgaaattaatcaatttacgtctaaggacccaaacgccgaaccttcccaacagttaaattcagtcaaaatttctgcgtttactgttaaaaccccaaaaactgagtctgccgaaacaaagcataagagtcaagcactccaaacaaatcgtttccaatttcactcaaaaatacccaatcatttaagagatgtgatgaaa

SEQ ID NO: 44128 - DNA, 1190 bp, Heterodera glycines
  misc_feature (53)..(53): n is a, c, g, or t
  misc_feature (60)..(60): n is a, c, g, or t
  misc_feature (111)..(111): n is a, c, g, or t
ttttttatattttctgtttaccaaatccgtatagtcaggcgtttcctaaaaancgacaanggagtagaaaaaaaatgtataataaaaaattaaatagattacgttaaattntaaaaatataatttaatctaattgcttctgaaaaagttattggccttcgtccgattgaataaattggccatttgaacaaacaaaatccgatttcggagttcattttgcacaacagagaatgccttattgtttttgggttgccaatttttgtacatattttggcatttttgaaattttaaatatcaaaaaagcatctttaatttgaaatgatatcaatttcttaaattattgcaaataatcttgaaagttttttctcatctctcctttcgttgtcctctctccttggggtcagggtcgttttcgcgtggccattttcgcgtggttgcatattagataattcatgctctattattttaccaaaaaattgttttgctcttatttttctttcggattttaattattcttttcagtttgaattttttggatcattaaattgttttctgacttatttaggtttataacactgatcctgctttcgaagagcagtctaaaatgatcacctcattggccttcctgcccgtgcatgacccagaaaacattatcaatttcctcgttggtatttcccgaaactatgagatgcgacctttcccgaattttgttcctttttgttaaattaatgaatttttataaactttcatttattttttttccgtttgacacacactcgaacaaactgacaagttgttttcaatcatttaaaatattcactttaatcagtcgatattaattaataaagtctaaaataattataatctgttgcaacaattaatttccttttttattttagagaatattgctaaatagtgaacttatttactactaataactctaataaattaaacacttttttataaaaatgtatcgaaaatatattataacgcgaaaattgacatattgactgtttcaatacagagccataagactagttaaagaaaagttgaaataaaattggtcaataaattagaaacaaaattatttataatattctatgcatcatcaaattttatattttagtctcccattatcaattttaacaattttggggaggaaagtgcaaaattttaaatttcagtaattcg

SEQ ID NO: 44129 - DNA, 63 bp, Heterodera glycines
aattcgttggcccacacaaagtcctgagacctgacggaacagagtttggcactttgacaataa

SEQ ID NO: 44130 - DNA, 1158 bp, Heterodera glycines
gcccgtccaaggccaacaaaaattgaaaaacgggcgcgaagcgcctaacaagctaaaaaacgggcgcgaaacgcccgtatgagttcaacaaatttaaaaaacgggcgcgaagcgcccgtcttgagctcaatgtggactaaaaacctctaataattttttaaaaattcaaaaaatctctccaaccaattcgatcaatttgaatcgcttcacagtctaggtagcgaagctcccaaagcgcgaagcgctttttcccagctaaatagccgacggttcttactatatatgttatattgacaaggagtttcgtttgcaaaaacaaaatctcccggccgaaggccgggagcgccctgaaagtggtggaagggtcttacaactttttgaggagaatccgggaaaactatagaaaaaaatttagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtatttttttcggaaaaatttcgattttttcccggaaatagaaaaattttttggcctcagcgggacatttgagtcccgggcccataactcgtcaggagttggttttagccaaaaaatgccttagagcaaaattgtagagctttttaagctctatcgaatggtgtgccatatggccggaaattttcaaaatttttcgagctaggccccctagaaattttcggaaattttttttcggacgaaaatgggggtgaaaaatatttttctggggtaaaataaggtgctgagtacgaatat

SEQ ID NO: 44131 - DNA, 831 bp, Heterodera glycines
ctagcaaaggctgcggctgtcatttgcactcgtccttcgtctgacgcataaatcttcaaatcgtgtctgtacgtgctatgcaaccgtaaaaagccaagtccctgcgtgtcctccggtgagtctttgccgtccgtccggcgaatccccgggtaaagtgttcgaaagagacgtcccaacgcttccgcctgtagaatgccggccgttgtaagcttaaaaagttaacaatgcctttgctttgcttttccctgagcacctctccgccccatttgaggatgagaaacaaagtaggcacagaagaagcattttggcattggtcgcttctctctctaccgcgcgcattttgcagcaaggttttgtcggactcaagcacaaacgacgttttgccagccgtgttcgccttttcggcactcgtcttcaaatacttcagctgaactttgcgattgattcccgaaaaatgaccatacctaaaaacaaaacagccatagaattattggttaatgaaaagaaaaacaccaaaatggcacttcaaattgttacaccctggcaatacttctcttaacgagactaaaaacaaaacacagacatcatcaccaccaccactcttttcatttttatgtttttaaatgttagaacttgataagcaaataggtaaacaaattaaatggcaagatgtgaaggaagatatgtttaaaagtgatcacaaaatattcaaaatagaccaatgtaagttaaattacataaaatgtcaacaattcatttgtattatcaaattttttgctgtcgatttttcaccataacaaaggcaaagcacagaaaaagcctttacgatgc

SEQ ID NO: 44132 - DNA, 1169 bp, Heterodera glycines
  misc_feature (35)..(35): n is a, c, g, or t
tcattggctaatagctaataggtatgtccttttgnagtttatgcagaaattttagaaaaatttggttgaaaaataacgctggaatgtttttgcgctgattttgttgtaattgtaacagatttttgagcaaaaaattgcaaaaatcaaggcaacgtacattcatataatgaattgggcgaataaggttttgtgaaaagtgaatgcaaaaacgacgagcaaatgatgaagaaaaggtgaggaatgtgtgtttgggtgttcccaccactcaataggaagaaaatggaaaatgggggagaaatggatggggtgatttttcgccctttcgacgacgtaaaatgcaaagaacgaaagagggaccaacctaaaaaaaaagtttattgttgcctcctttttttgtttaaattaggtaggtaattaacgaatgtttggaacttaaaattttttttctaaattagggactaattaaaattaaataattatttgaatacaaattctatttattattttttgtagagtgccacgggaccgggaatttttgccaaaaccgggaccgggacttgccgggacctgtgaagccgggaccgggacctcgatttttgttcgggaccgggaccgcaagaaaaaccgggaccaaccgggaaattttaaaaattcaaaaaaattttaaaaatttaaaaaaaaattttttaaaaatttcgcaaaaatttacaaaaagttgtaaccagaaaagtctttgggctaacttttgatattaatagcggtgtgaattaatttttttcaaagagtagccagacaggcagacaatacataaaaattgcgaaaagtcgaaaattttaaagtttttcttaataaaatttttctagaccaaaatcttttggctttttgcaaggctaatagagcacgtgaagagctttcgaatgataccaagattgttggatttggatgccaaagaaaaaaagctatcgtggaaaaataaactggcgccgaaacgcgtgggtcccttttgtatggtttttgctatagtagagagggaacgggaattttgggaaaaaccgggaccgggacttgccgggacctgagaagccgtgaccgagaaatccgtctgattgaccgtggagcgagagccgggaccacccgggatgttttataatttcacaaaaatgttaaaa

SEQ ID NO: 44133 - DNA, 1142 bp, Heterodera glycines
gggcaaaacaccaaaataggtgaaaataagtttttaaacttttttttaggttttttaggtgctaaaaataaaaacctagaaaataggtgctaataactcgaaaagtagcttaacaacagccaaaaaaaaacatgtttttcgtgcatttcaggctacggggagctcaggaaaaaataggtaaaaacctaaaaatatcatccctatttataactagggatgtaaattatattgactgaaatatggacataaaatatggactaaaaaagctcaaaaatggccaaatatggactaaaaactgtcaaaatatagttttaaaacctcaaaaattcaaaaaaaaggtttatatatttaatatttgcttaaataaaacttaaaaataagataaagaaccaaaagatggatttaaaactaaaaatgcaaattttgtattgtcgtccgttgtataaaaaaacacctccaagtttgtcaatttcaaaaaaatttctcatttaaaaaaaaaagaaaaattcgcaaaaaaatggtgaaaatatttattaaaattgccaaaatgacgatgaaaacgcaaatttttcgtatttttggggatgcaattttttaaaatttccaaaaagtcgatctttaggggtgtaatgacgacgaaaacgcaaattttttgtattttcgaggatgcaattttttaaaatttccaaaagtcggtgtatttttcgctttttttgcattttcttgtgaaaatgtgccaaaaaagatcgaaatatggactaaaaaggcaaaatggcgaaatatggatttattccccaaaacccccaaaatatggatttatatggactaaaaaacttcaccaaatcaaaaaattttaacgcagaaatgctatttttgagcccctttcttcatagcataagcgcagaaaaacatgttaatccatataatttacaaccctatttatgacaatcccgaaccctaacaaaattcttttttttttttgttcgaacatgggatattgtttgggaattgttaaatgatcagtgaaacccgaaaacaccagaaattgaattaagacaacttttattaattgacctaaataatttttgctaacttggaccaaatttttcgacaaataaaaatgaatagtttaccaatacagg

SEQ ID NO: 44134 - DNA, 1237 bp, Heterodera glycines
  misc_feature (1172)..(1172): n is a, c, g, or t
cgtacagacgcaacgaagacgaaatcaaacggctaaaggttggttggtggaggcgaaattaatatgaaaatggaaagaatccaaaacgccttgaaaatttgaaaaaattgaccctttttggttttttttgaacaaaccagttaatttttgctatttcgatttgattttatcaaatgaatattctaaaaaattctaaaagggtacaacattcttgggaacttttgatgaaattggtaggtatttttgcatttttaacggatgaaatttcaaaaaatcggttaaaagtcctctcaaatgcatttttctttcattaggaatcgatgggactgtccgacggcgactcggccgaaatggccgtcgacatttttggcactgccgccacggcgaaactttccacggcggtcggcagtctgcccgaacttttggagaagaagcggctgatcgacttgcacacgaacgtggccaccgcactgctggacaacatcaaaacccgaaaattggacgtattatacgaaacggaggagaaacttttgacaggccaaggttcgtgcacttcattccgccaccgtcgttctccccactccccgaaaattaataaaaacaaattagaaattttccaaaaaaaaaatccctaggatttttttcatttttcagaaattccggtcattgaaacgttgcgcgactgtccggacaaagacgacattttgcggctgattttgatcgctttgtgttctcggaatatgccaactgtacattttcacgtttaattaaaatataaaaaaattttgcgcaaaattccccttgtcaggctgaacagcgcgaacttcaggctttcattgacgaacgtgcaattagctcggatgcgctgcattttgtgcggcaactcaggtgtacgaaattgggtgcttttaaatttgggattttgataattcaagccctaatttccccaagatttttcttattttaaaaatattaccgaatttgtcagcattttttttagtcccgaaaaacatgattttcgatagtgttgtacaaataacagtgcatttcttttagggctttttctcatttgggtgccgaggcggaacagcaccaaggggccggcaccaagacggtcagcatgttctccaaactgctcagccactcatcgcgcttcgtcatggagggcgtcnaaaatttggtgcccaaaagcataacttaccactgacgaaggtgcatttattttaattagcttttt

SEQ ID NO: 44135 - DNA, 934 bp, Heterodera glycines
  misc_feature (868)..(869): n is a, c, g, or t
  misc_feature (907)..(908): n is a, c, g, or t
ctgaagtgtgctcaaaaagtacacttcagtaccaggcgaataactcgccaggggttgctttgaccgaaaaattgtttctgagcaaaaatgtgtagtatttgaaaggctatcaaaccaagttttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggtcggttttagccaaaaaatgccttagagcaaaattgtagagttgtacctcttctaatcactcttctaatcgctgttgtacctcttctaatcgctgttgtacctcttctaatcactcttctaatcgctgttgtacctcttctaatcgctgttgtacctcttctaatcactgttgtaccacttctaatcactgttgtacctcttctaatcactcttctaatcgctgttgtacctcttctaatcgctgttgtacctcttctaatcgctgttgtacctcttctaatcgctgttgtactcttctaatcactgttgtacctcttctaatcactcttctaatcgctgttgtacctcttctaatcgctgttgtacctcttctaatcactgttgtacctcttctaatcactcttctaatcgctgttgtacctcaaatttaaaaaaacgggcgcgaagcgcccgtatgagttcaacgattttaaaaaaacgggcgcgaagcgcccgtccaaggcnncacaaaattgaaaaaccggggcgaagcgctcgactganngcgtgaaagcgcctaacagctaaaaa

SEQ ID NO: 44136 - DNA, 1747 bp, Heterodera glycines
  misc_feature (1716)..(1716): n is a, c, g, or t
tttgcccaaataaaaatgaaaaaaatttgtgtttttttttgaatttcgatgaaatcagagagacatttcttcaaaatttcacccctgttagggtcaatgatcaggtcggtgggctctttgagttcgtcatggacaaccacctgcttatgcgttccatccaaccaagctcgcttaaaagccatttgaatatcaatattttttaaatacatttttcatttaaccgaaatgattaaaaaaattttatgatatcaaaaagcttaaagcccaaaatgtgtcggaaacaagaatgaaaaagttttccttttttatattcttttttaacggattgggctaaaattatttaaatttttttttaaatttccattctttgtaaaaaaacaactaaaattttcgcaaaactcacttgaatagcgggcgtttggccttgatcagcccagtaaacgaagcgggctaaatgcaaaaaaaaacaataatcaataattaattaattcacgctaatgatattttaaatcgattaattccgcgcgcgcacttatcggatcaactgcaattgatgtgggcgtttcggtgcgtgtgctgagcaaaatttttctgttttctccattcatttggcacacttcaatgttggagcggtccgagtcggcattgatgaaataaatgttgtctaaagtgtatttgaaataggaataataaatacggtaaaatacaatccaaataaatatggtaaaaataaaaatccatttcccactcatccaaattcgtactgtattgatacagtatgaatcggtcggtgtttgttcaaaaataaagctttaaaatcaatttttactcactgtttatccaatcaatcgcaacgcttttgatgatgtacctaaatatagtggtattaaatttaatgttaaagttctctaaaataatatttattttttatgatattaaaaaaaattttatattttttattcctcaaaaaaattctattatttttgaaaaaattattaaattttttcttaaaaattttctatcaagccataacactaaatagattcaaaaagggattttggggaaataccataaaattttctataaaaataaattttttaaaaacctaaaatttcaactttaataatcaccaatcaattaaataatttactataattaattgattaatttgaaaattaattaaataattagtaaatttctcacccgccataattgttcttcacgatcacttggctctccgaatcgcccaacacaaaacggttgatgcccttgttgatgccggcagcatcgacaaagaaaatcgactttgtctcatggtggaaatcaacgctggtaatcgcggcacccgaaattggctcaaatgcgtccgatttggtgtggctttgatccgtcgggatggatttgacgaaatttttgcccgccaccacgaggaaggaggctgaatacaactgaaaaagcggtaaaaaaaattttggatggattttttattttaaaaatagaaagtttttacataagccaaaaaaaaggtttaaaaatttttgcaataattttgtaaatcatccttcataaaaaatcataattttcgtggatatttaaggattttcttggtttttaaacaagtcccataaatgtttattgtttttcttagacttagtaaaaatggtaattggcaaatcaaaatccgaaaaattgtccggcctttccagatcccattanaatccatgtcacaagccacctgcttttctgc

SEQ ID NO: 44137 - DNA, 926 bp, Heterodera glycines
tgtatttttggcgccctcttccccttcttcatcatcactcccccgcttaacggatacgaaccgaagcacagatttgtccctcaaagttcctcccattcatttttattacttggcccaatcaatcacaaacaaactttcagttaccatttttggccgaatttgttaattgttgtacatatttacataaactttctcccaaagaatatgttctttgtagtgttttgtctttgttttttctgcaattgctattcctctttttttacataaaaccgattaattaattattttgctccgtcagatgaatttcatcgcccttttatcaaaaccctgctttcgctttcatacgtttccttcttgcagtaaaaggtcggtttgcttccgatttgtcctcacatattttattttcaggttctcctacacactttcagtttttcattcattgccaagccgtttttctcgacttcgattgtttaggggcgaatcccataaaaattatgcaactgcagaaaacaaaagaccttcgagacatttaaaagatctcactctgcgagagcttcgcgaaattgcgacccttgcatacccacacagaaaacgcattttaggtatggtaacggaaaagaaagtggagatggggagaggagaccaatgaaacattgagaaataatctcgaatgtttcacccacattttttcatgcatctttgctcttctcactttagcgggcctttgctgtctttgtgtcagttcggtgattttcctctcagtccctcgaattctcggcaaactcatggatgaaatgaacaaagaaaaggaaaagaaatctgactttatttcgaaacttgtccgacttctcaaaggtggatctctccgttttgtgaatctttttcctaattatcctttagaaaatccttttgctttgctcgtcatg

SEQ ID NO: 44138 - DNA, 982 bp, Heterodera glycines
ccgatcctaaggcaccggctaacgccgtaacacactacctactacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgtgtgctgttcttttggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatg

SEQ ID NO: 44139 - DNA, 132 bp, Heterodera glycines
ggtcagagtcgcgggggcggtggcgggggcacgaaaattccgcccccgcgggggcgggggcgggggttaaatttgaattaattccaaaaattctcacaaaaaaattaatttttttgattgatgtgtttggct

SEQ ID NO: 44140 - DNA, 1007 bp, Heterodera glycines
ctgcccaccaaccccacacactaccactctgccacgagaccagttgcaaaaaaaaaggataattgtccactatatgctgcaaagatgatgacgtcatccctgcgaggggtacggtagtccagggaaaatcgcaataaataagtcgcagccaaaaggactcgaacttttggtctgccaccaaacccaacacactaccactctgccacgcaaccacttgccagaaaaaggataattgtccactatatgctgcaaagatgatgtaataggcttaaatttattgaaacgaaaccttcaaatttaaaaattggcgggaaaattcaaattcaaaaattggcgggaaattcaaattcaaaaattggcgggaaattcaaattcaaaaattggcgggaaattcaaatatggcttgtatattctaaaaatagtaacacttgacctagatttgagggcgggccgcatataaaaggatgcgtcacccactttccttcgtttttttcatgcttctatattcttttgaattgtttttttgttgttaaccatggcggtagttctagttaatgaactctgtttatcctggcaacaaaaattaatttgctttttaggtcttgaggtggttccacatgcattgctaatctcaagagacatttcaggtgccctgtcgtcttgtgcttcatgggtggcggtgagctgctcatcaggtcaagattggttaccttttgacaattattccatgtttgctgttaaccagggcggttgatctaattaatgagctccgtttatcctggcagcaatttcaatttgtattttagaacctgaggtctctcaaactatcttgctaagttaagagacttttcaggtgccctgtcgtcttgtgcttcatgggtgacaatgtgctgctcatcaggccaagattggttactattaataaaatcaatttcctttcctgcgcaatcccaatcaggatagtaaatataaaacaacctgatgcgcaatgcctttataaggcagcc

SEQ ID NO: 44141 - DNA, 1068 bp, Heterodera glycines
tctttttaattttggccagaattttctttctcaccctatctaaattcaaaaaattctcgtgaaagtattaaaatttttagtggaaaaaggtgggttgaaaaaatcgagtaatttttcaattttcagagaatttttaaactcgaccgacatataatttggataatcggataataaagataatcgaaatttaaatccaacttgaggcgcgacagataaactcgtgaacatttggcttcacctaaaaaattgtttttaaaaaaattaatttatacttttaaagcggattaaaagaacggacatagtgtgggcgaagtccgaatggggcaaacaatttaatttaattatattttatgaaatgttattatattatatatttttaataaaatcaatataatttctaaagaattcattgaagaaaatgcacttttattaatataataatgcactttttctttatatttttattttattattaaaatatttttaagcattttctttaatataccattctaatcccttttttatattgttattttattattaaaatatttttaagcattgtcaaataaattcatttattaaatatttgttaatgtcaattcattacgcaatttcattatgaattttagaaaatgaaagcctttatttatctggctattattctgtgcatttccaattactcattaagcaccaagtcttgagctttttattttaaaaatttttgttatataaagttatttattaatgcctaaattgttttaatgtacgatgcaaaaggataatattatgaatctaaatttttcaataatatttttaaattctatttaaaatatttttttgcattaattaaattgtttgccctattcggacttcgtcctagcaccaattggactatcactagcaaaattggtggcagcgacgccgggagccacatggctcagcgatctcgccagtcatgttcggcggtgtcccaatcagggctggacgcaattgcggattgcggattgcggattacggaaattgcggggtttttggacccgaaaagattgcggattgcgggttgcggat

SEQ ID NO: 44142 - DNA, 968 bp, Heterodera glycines
taaattttcatgactaatttcccgttttttggtgattcttttaaatcaatataataaatatatttgtttgttctaataaaataaaaaacagatttaaatgatctttatttcaattattcctaaatgcctttagttttcagctatattaaatattaacttcgcattaataataacaattattattttctttatttatcaattttttaaaatgttaaattatttctatactattctttaaaaatttctttataaatttttcatttctatattatttatttttgaatctgatttcaaatattaattttcatattcttaagaaaaattttagctttagtattaaagtgtttcatttattttgtaaatatttatctatttgaataaatattttcattaaaattattataatatgatatataccttttttatttttggattttttaaatgttttttataatgtaactctttcgtagtcttttaaatattcataaattttctcttccatcatattacctgttgaaattttagaaatactaaagaaatttgcatttgcagattttttttctatttaaataaacctattataattttgtaaatgttcatcatagatcccaaactgaaattgcaatgttttcttaggtgctgaaaaggactaaaccaacaaaaatgtttttgaaccagttgaaatcacgaaagtgtgcaaatttgggaaattatagcctttgaaaaagttaaataataatttaatttttcctgtggctaaatttcatgcgcaatacatttagattcattcatgaagcatctcattaaatttttttgcttggtaggatttatttatattgaattataattggtggtggaatttattttattattatttcttatataattcgaccatccaaaatacttaatgggggacaaatataaaaaaaaaaatcaagggaattaagttcggaattttggcttctttt

SEQ ID NO: 44143 - DNA, 1060 bp, Heterodera glycines
catacgccagcgcttttgtgaggtataaatttctcaaaaaaagagatagccattttctgggatagagtataaattaaaaatttccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaagggctattgcgcaccgccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgattttgtgaggtataaaatttctcaaaaaaagagatag

SEQ ID NO: 44144 - DNA, 1059 bp, Heterodera glycines
ggggggggggggaaccagaaacaaataatttagagctttaccaatcatttttatctattaatttgaaattggaaagttttttatttggcagattccaatgggcaattgattgtctgatttacttggtaattttagtcgagtatctggtcaatgatcaaaaataatgagtgagtgacacgttttaccttttcggcatttaatcggttattgccctaaattgctgtccgttgtcttgatatggtctctaaattcgatgttccctcccattttctcaattgtccttaatgttcctccgcttcctcagccgttgaacaatagtcccgttcccgaaaatttttggactttctaatgaatttgttaaggagattttcagaatttgcgaccccccccccccctcgcaggccccctttgcgagcgagggggggggggggggtcgaccccaccccctaaaaaatgtatggtacagtcaattgcctgccacctttgctgtgttgtttcgacaagtgcggtccaccatcatttcgttgttattcgacgtcacgggaggcaacggaacattgcgaagcaccggcggcggttgtggcggaggagtggcgaatcgaatgtttgaaacttctaaaacaaaaatacaaataagcaaatgtttggtacagcatccgtatgtaaagcttttgccttgtgatccgttgatttgttgctggtaatccgacagttcgccaatcggtttaaatttggcggcgagactccctgagaaagtttgaaaaaccccccccttcggccgcaaagtgccccaaaattggggaccccttcgcatcgaggggggccggtgtaaaagaggggggggggaggtcgccgacgaacgagaaaagagggaaatttctgaaaatttttggctatttcttaacaaaattcattaaagattcttaaaagtttcacccggcggcgcatatcggcaccgcccccccccctaaaaaacctaattttttttcttataaaattagctcaaaatacacaccgtttcaatccagtgccaaaaagatttgcatgtgtggcaaagtg

SEQ ID NO: 44145 - DNA, 1130 bp, Heterodera glycines
  misc_feature (80)..(80): n is a, c, g, or t
aatttgaatcggcactaatcccatgagtaatgtcggctaaatttgcatttcctccgtgcatatcaagtgctttcctgacnaatatataaaaagtaataaaaagttttgaaaaacaaattaaaaattttggaatttttttattaaaaaaccaattaactaaaaactcaaattcaattcaaattcataacttttgcagcgtctctttcattcctagcccactcagcagaaagtctccggaaaattatttaatagacaatcaatcaagaccaatctgtcagtgaagaacaattcgtcagtaatgaaaactccgttttacaaaatattttgcgatttaaaaaaattactgaattttggggttcacttcggttgagccccagccatgtaggctaatagagcatgtgaagagctttcgattgatacaaacaatgttgggtttggttgacaaagaaaaagttagagttcggggccaaacacttcggggcccaactgacggagtccggaactttgtcatcatttttttaaattaataatttaatttattaacatcttaaaaactttttaattaaaaatgatttttcactattaaaatagctttttaatcaaatacttatttttctagattttaaaataaaatctgtcgttagaaaataattttgttgacggattgtccactgactaatttttttctcagagtgatgaatttttcacataaaaataatttacctagatgccgaacatacttgaaatgctcaataatgacgctacggttttgctcaatccattcacggcactgtttcaatcggtcaaaaaggccagcctcccggttgttgtaacgcgagattacaacatttacgccgcatttgtttgtaattgttgcgcattctccgagttcacattcctcgtaaaaaaatctgccacgttcccatgcaggtccaacaataacttgatggagaaagctgtaaaaaatgaataccgtattaggccacctttatttttgaaatttgtggtaaaaaattcggcagttatatttttttaaatctgtagacattaaattttgctttattaatgacacattaaataaatttttgagactaccatttacaaaaaaattgtcatactataatgaatct

SEQ ID NO: 44146 - DNA, 956 bp, Heterodera glycines
  misc_feature (934)..(934): n is a, c, g, or t
tgcaaaaatctgaattttttttctaaactttgtaaccctgcaaaatgcctaacccacctcagtgagcttcgttttcttttcattgaattgctgcgccaacacctccctcaaaaaaaatcttagaaagttttttcataagaaaattgtaagtaaaaaaattttccgagaaattttcagcaatttttttgaaatttttttttaaacattttgttaggggtcgtacgaagggaaaaaaataatgaattttggcgcaggataaaaatatctccttacaaagaaataaatttaatagctttcaacattctctattctatactcttaattattccattgtgaaattgaatgtgccttcgcgaaagtgtgctcatcaaaaatattgaaaaagtgatggcttgcttaattgaatttgcaaaacaattaattttctgaattattcatttgatatttgataaaatgttactcctattttattatttaaaatgcattgaattctttctcttttttgtttggctttgcttatccatccaattttatttattaaaaaaatgaatttttactgttttacataaatttgcgcattttcattttttagctttgttttgcatattttcaaatgtttcgttcgccatctgagccaagcccgttctcgtcaactcggtgcccccacgatactcaggcgcgatgtggacgtccgtactgtccatttgcacaccaagccgacgacactgtcgacgtcgttgaaggtgaaggaatgccgaagttcggcgggagggagtcggtgtaaatattggtaatccttcggaattggtgtcatgacaaaaaaatctaaaaattttcctacaaaatcactttccatggtaaaaagctgcgctgttttctcgggttctttatcagagtgcattttttttacctagaaaaaaattaacgaaaattnattctcagaagtgtaaaaactc

SEQ ID NO: 44147 - DNA, 839 bp, Heterodera glycines
gacacggcgccgagcaccgcagccctggccaagtcgccgccggtgcttcgcttcgcaatgaccctgaaggcaattggcacattcaaatgttggcattaatttgagttgtattttaaatcattcaaaaactttatccctatagaatcacttattgttaaaaaaccgccaaattttgactttgaaaaggagtttcaattatttcaagctaattcccgctgaagccgacaaaaaaatatttcaacaccaacttggtcaaatcattcgtttagagtgatcgggacaccttctaatacactgaaaatcggaaatttttggaaaaaaaaaatttggtcaactcaaaaaaacctagcgaattccaaggttgcacatttccattaaaatttcagcttgatttgacagtgttaatccatactgactatttattttaaaatttatgttttttttttaatttaagcaaatattaaaaataccttttttctttaattggttgtccaaaaataagaggaacaacgaaaagttcgttgataagaagaatgaaaaaaatgcaatgaattttcatttctcaaagatttgatgaaattatacaaaatctacaaaacattaatatccaaatgaataattaaatgttatcccaaaataaaacaatttattaatttgtccgtccgtcgaaagaagaggaaaaaaatggagagcattgagacatagccaaaagaacagatcgaaaagaagagattgacatgagtaaattgaacagttgttgaacacaaaaagtgagaaaaattggcaatgccaaaggcataacaaaacaaattaagcagggaaaagtagaaggagatgag

SEQ ID NO: 44148 - DNA, 654 bp, Heterodera glycines
aatctatgttaattattaaatataaatcgaaatacgggtagccctttaaatattaaatagaaaaatttgttttttataaaaatagtcttacaagaaatagtctcgaaaaaataatccaaaagtcaaattacggatcaaaattacggaaaaatcccaaaaatccgtaacccgtaatccgtaactcccaaaaccccgtaatttccgtaatccgcaatccgtaattgcgtgcagccctgctagggacgcgacttttagtgacgaaaaatcccgaaatagttaactaaaatagtgccaaaaaagtgacaaaatagtgaaaaaagtccgaaatagtgatgaatagtgacataatttttagccaaaaattgagcaaaaaataatttttattcactgattgcagttgcaaatgagctgcatttcctttataaaattctcttagcaaatattgacattttttaaatcaaaaattttgtcaagaaaaaaaatttgggggaagaatttttgaaaaaattttccaattcttagtggtgtatttttaaaaaaaggctctactgcattttacgcgtccaatcaaaattttcctaaatcgaacatccttttgacataaggtaccaaccattgcaaaaagaaataataatttaaatattaaaacgtaac

SEQ ID NO: 44149 - DNA, 892 bp, Heterodera glycines
  misc_feature (35)..(35): n is a, c, g, or t
aaaaatgtaaaagactaaaaaacggagccctaatncatgtaaatctttttttagcgaagcataaatactctgaagcggaaaaattggaattaattgaaaaattcgacgaggccaaaagcaaaaacccaacgataagcgacgaagaattggaaaaaatgttaccggtcaaaatttccacgataaaacaatggaaaagaggcaccaaaagaaggaaaactgtgaaactttaggctagattatatccgagtgacaatagagaaattttcaaaaaattcaaaaaataatttaaatgatcaaatgcagtaattcgaaattccattttaatattcgttaattagggtccctcgaagcggcaccaccgagaaaattttagtgaaaaactgttaaaaatgcccaaaatttcaatgaatatctgttaaaaaatggtcaaaatttctatttttcctccggcggcgccatcggcaccgtcggacaccccccggttcccaaaaatttttttttgaaaaagcgcgccgcaaaaaaaaaccaattttattttgaataaacgtaattgtcttcggcattgggctggctacttatcatttcgtcactgatcgtttcgtcactgttcaaaattcgtcacctctgctttgcccaattccgaacccgaattcaacaaaaatttgaaaaaaaatttcaagaatggatttttgggggtaaaagataaaaaaattcgaattctcaagattcctttcacttgccggcatcataaattaaagtttatccatatcatttattcggcaatcctaaagaatgggggtcactaatttaattttttttttaattttaaatttgagctcagaatgagtatttggagattattgatggggctgattacgaatctgaactctgc

SEQ ID NO: 44150 - DNA, 1210 bp, Heterodera glycines
gtccaggcctggatccaggtctcgaggagcctggatttttcctggacctggatttttgtccaggaaatccaggtccaggcttttttcaaaataccgatctctactaaaaatggttgaaaatgtttttgataaccacttttcatcggaattggtaatatttatttacccgttttttgttctcctcattttcagcatacattgaatcagaattcgaaatttgggaggtcgtcgtttcgggagtgacagaattaacgcattggaacgaagggatatcgtcggaaatcttaaaggttgaaaattactgaaaaataaagcagagcaaaataactgattatttctgagcaaaaaaagaatcggctcattgtcagaaatacctccaccaccacttctgtctcctgcttaattgccctcttttccttcggctgttcgatttcttttcgtttcggtggttggaaaattggtggcggcggaatgcgagggtcaaattttggtggaataagcccaaagcgtttggcccgctcaagcgaagaagccccaaatcctcctccctccgtactttttgctaagcttcctttcgtttctcggcctccgttccgctcgccttcctagaaaattccaatgatttttcacatatatattaaacaaaatcaaacgaatagaaattgaaattcaattacacatttaaaaaggaattatttttttcggaaaactcacaaaaataaaagtcccaaattttacatttattttccttggtaaagcataaaattcatcctactgaatgatttacaaataagtcaccactcacatagaactgaattgcttcgcggtcacttgggtccatcatgtcgactggacatgccgaaacagtgccaattgatgacaatgtcccgccacttaaatcccgttatttgtctccatgctttgtttcgtccttccccttgctcacctcgtccctcccgcccgtccgtttctgttctcctcctgctgttgttgagatgagtccacacaagtgaatttcatcccgcgctctttaaacaattccattgactttgtctgtttgtaactttgcatttgtttgaccgcgctggcttcgtacgcttgtgggttgagggctttacgtgccatgccattcctggccatgttcggtttcactccgctgttaaaaggcaacacaacaccagtgacaggaagttgcggcaattcctcttaa

SEQ ID NO: 44151 - DNA, 1076 bp, Heterodera glycines
aaaattattttaaatctaaactcatttataaatattcggcaaacattcagatccaacattttaggcgaaaataaggacccagagttcacgattgaatggtcaacaccatgtgaaatgaatgaagaaatgaaggacaaggcgggatctctcctcatagaggtggcggacagaatgctgccacgcttccaagacgaacacaacaaaaaaatcctgcaagaggtaaaaatgtttaatagtttgaaatttgagaactttgttagattttttttccaattttggaaaattttaaggcaagcctggggcaatgggtgctatattttaaatgttgtttctaaaaattataaataatatacaaaaagtacataaataatttttctagctcgccactagcgtcaccgagaaaggatggttgatggaggagcagatttataagtgagacttaaaaactattaactctcaatctttcaaaaattatttttagatatctggatcgcctccattgagtaaaaggacacaaaatataaaaagtttcaattaataaaatagaataagaaaaactttttataaaaaattttaacgcgcaaaaatgaatgatcgaatttaaggcataaataggctaatatttatagttttttcactattttttcctgacctctccggggcctaaaacttaagaaaaacgagtttttttattgttgttatgctacttttcgagttattggcaactattttttataaggatagaccttaaattttttcaaaaaatacacccctacgaatcgaaccgaaaattttgaaaaaatgcactcctaacaaatgaaaaattttctcaaaaatcaatctccaaaatctatttatttatttcttgataagaatttgtgattttaaaaattattagctcaatactggcttggcctaattttttctacttttttgaataattttgtcattttacatccttagatttaaaagttttagcaactatttacctattcttggcaactattttgcggctttttttagaaactaaaactaattattttagcagtttttagcaactataaatataagcccta

SEQ ID NO: 44152 - DNA, 1249 bp, Heterodera glycines
  misc_feature (17)..(17): n is a, c, g, or t
gagaatgagagtgatgnaattgagaggaggatcagagtaagagacatgagagagacaaagagaaagggagagatagagggaaaggaagagagagagagagaaggaagaggtgagagaaatggagagaaaaatgagagataaagagaaagggaaatgagagagagagggaagagagagaatgagggaaggagtaagagaaagaaaaaaagtatttttgatcagaaaaaatgcctaagaggatattagactgatcaaaaagagaaggaaacgaaaaaagacacgagactattttaactgagactcacaaacccaaaggaactgtccgagcagtacgcttccctccgcgaacggtctcggttggcaatgcgtccacgctcaacgccttccgccgccgccggagggacagaagccgcggtcgatgccctacggcgagagaatgagcgacttaaaagagaaaactcccatttgaacaagtcgctggaaaagcaacgtgaagaagcggaacgaacggcgattcggctgagacggatggaaacgcaaagccgcgccaacgcagaagcgtgggaagagcgcaaaagaaacgaacgaaacgcggcacttttgcgaaaacgggtcgaagaaggtgcggagcgagagcgactgcttcaagagcgattggagaggcgggagagacacattgaacagctgagcagggaacagcagggccgacttggggacacagagcgagttcaggcgacgatggcacaatggcgagcgaaagtggcactattggagcaacgagagggtacattgagccaagagcgagtggtgttgggtgaacggtgcaacgaactgacgcggagactcgaagcaatgacacgcgagcacagaaatgccaaaaagcgattggccgaattgacaaaggcacaacgggaagagaaggcggaggagaagcttagggtggagggaaaagcaattggcggagaagtaagctaaaaagaaattgaaaaagggaaggaaaagccaaaaaatagggaaatcagaaaataatggcacgaaagacggaggacagaagaagagaggcacagacgcagacagaagagccaaacaaagagcaggagaaaaagccaatgccaaacgaagctggtggagtgggaacagaacgcaaaagtgaggggagaattcggtcggcaccgccttcagcgggaaaagcggcaccgacggcggaataggaggacaaatggagagaggccgaaatgagagagatggc

SEQ ID NO: 44153 - DNA, 1404 bp, Heterodera glycines
  misc_feature (879)..(880): n is a, c, g, or t
tgctcccgcgagtggacacttctcccgtgggtgtactctttcggcagcaatttgtaagctctgtgaattcgaaatggaaagtgagcagtggccaaactgagcacggcaccgaatggactgctcgacacctttttgatgttcgccgaattggacgaagcagtgaatggcggccaagcgaatggccgtgtcccgggagacggggtgcaacccgcggagcacttggtccagacactgttcgaacagctcttcgacctgtccggggtcgcttaagtcgctgtgggaaaaggacaaacgacggcgatggctggcggggacaaagtcatcgccgggaggggaacggtcgtgacgtttcattgtgttggcaccgatcgaacgaaaaatgccaaattggggagagaatgaaagagcggagaaggaaatttaaagaaatatggaaattaacgacggaagagatcgacgagcaaaaaaaaagcggaggaatcaaagaaaatgtgtccaattggaatcgctgggaccaaccaatcaaaaaactgcttccccctcccccccccacccgttgatcgacgaattgcgccgattctccgttaccctccgacccctcacgcattttgcccatgggccgcccgatcggcgatttgccatgatcagacacagctgttctgctgctgccctcccaaaaccaaaacaatcgcagcttcccccgttctctttttgtttcttcttctcgaaatctgatctcgcgggtaaagagccaattttttttttgtttaatcgatttaaagaagaaaaatgtttgggaagagttgagagggacaaaagcaatggcaaggcaaaaaagaaaacacaacaaaaaatggggagggggggggggggaggggnngagaaagtggaagtggaaagtgtggccaattaaaagaatggcaatgccaaaatgagggaaaatccgttggcggtccaaaaatctgccggcctttgttttggctctgtctgataaataaataaataattatttgcttcttccatttatccatcgattatctctccgccatcgcttcttcttccctgtgcctttttctcagttccatccttaacatttgattttgcagtcgcttttcctcaatttgttccttaatgagttcaaactaattgcttcgcgctctcccaaaattcacttgcaacagcaaattctgaagtcgcatttgctccactcgcaattgcttcgtttccctttccaattccgaatcggtcagcgaattgcctttcgaagggctcgacgaaagcgccggcggatggaggaaaagcggcgaatcgatgcacgaggccaaatccaacgcacgacgcttgggggcagccttttgctgtcgaagaatgaaacgactgatttcgcatttcgtattatcagcg

SEQ ID NO: 44154 - DNA, 1410 bp, Heterodera glycines
gctttcgaatgataccaacaatgttggatttggttgacattgaaaaaacttatagtccaaaaacctgccggcgcccaaacgtgccggcgcccaaccgacgtagaccggcatcgaataaatgaatggaaatggaattgtgtcgccgccgcattctttgaaaaattcatttttcagcggcgagtggcagaacaaaaattgttttattaggacgacaaagaaatgctgtgctccccgaccgcagcgttgagtgaaaaacgggggaaaacgccccccgggggcaaaatgggaaagtgcaaaaactatgtgacgggaaaagcggccgagaaaacgaccgacggccccgccctagttacacacactctctcgcccctctctctattctctgttctctactctctggtctcgtccctctctctctattctctactctctgctggtctcgcccttccccccgggactgagtcgtttcagcgccgaccgtttcggcgccgccaactttgaaaagttacatttttttccttgtcagttcaagttttaacaaatctggcatcaattacatttacctgttatcaacggcaccgatccggtcggcgccgaattggccgtttaccaccgccaccgtttttgttggaccaaacgcattcatttgttgtgtggcgctgtgaacccgcccccggcgctgctgccccacctcggggaatgtgccgtcgtcgagcgtgccgacaattgtgccccaccgccgccagcgatcgttgccctctccgccgctctttgctcgttgcttaggtgccgcagcggcagcgtccgtgccccggggcaacccaatgaatggtcggcattggcacgtacggttgaaaagttgtacggcacaacgcacacgaaaagagcagcgccgccgctttttttgtaccagaaaaattggaaaaaaattttaaaaaaaacaaattattattttctttcacatttggtggccaacaaaataatttgatcaacaaacaaatcaaatgtgcacataattctaacaaaaaaacaaaaacaattatgatgaaatttaaattatcggggatttttccgtcgttgtttctgtttctgctgctgctcccaatccgtcaataattcatgatcaccatcattaacggcctcattaacggtaccatcattagcatccgcttcttcttcttcttccgttgttgttggctgtggtggtgtcggggcggtgtaatttttgtccaaaaatatggcccacgggaagccgtggccccgcacatggtccccaaactgctccgtcagcccgtccagcgacgggaaggtggtcaggtggtggccggcggccatttggtcacgcaaaaattggaagccgaccacgagcgcctcgccgagcagcggtgagcgggatgactgaattaatgg

SEQ ID NO: 44155 - DNA, 974 bp, Heterodera glycines
caaaaaaagtcgaaagaagcgttatatttcagacatttcaaacacaaatgaggatgccgtgaatttgggagtggaatttggcgaaccgaatgccgtgataactttcgacaacgttgaacaacagactttgaacgaggctgaagtctcagtaatgacctttgagcgcggaaaaacaaatttttaaatgtcatattcgtactcagcgactccaaaaaccctaaattagatccgttttccgggtttttatgtgctttttagacttttggacatttcgtgttttttactcatggacatttcgaggcttggacatttcgtggcttggacatttcgttggtcagcggtttttactaattatgttataaaattcgaattaaatttctttttttcccacatcattgggacccttgattctttataattttttaaaatccacatcaagacaccgttaataaaaagctgcaacacgaaaaccgtaaaaaggtcagatttttgcattttttttataacttttttacatgacggtatttctttttgattgtggaaagccaattgagcttacctacctatttattttccgagtgtccattatcccatccccctttcttcagctgtacccgagtatataaagccgactaaatccaccttccagtcatattcttcatcccatccgcatttatttgataatttttttctgtcacttcttttttctaattctgtttgatttacagctaaaaaaatgacgtacaatccgaaagaagctgatagagaaattgaaaaagcgatgtaataatttaatttttgaatttcatttctatgggtaatcattttgcttttccattttcagcttcatctctgctgactgttggcacaaagtgtttgatttgctgccgccctttcagcttggcttcggaatcgcgatgatcagtcgccgttttgactattttgttgacgaacattacaaaactcgcaaatgg

SEQ ID NO: 44156 - DNA, 1069 bp, Heterodera glycines
caaatcttaatatctggtgaaatttgagcaatttaatatcccccaccattttttgtcgattttgaaattccgtttccatatttagtagagtccgcatggacaggataccgtacaatttccccacgccctcgtcccggtcccgtattcttaaactcgcaacatcgacatcggagtccagtaaaacagttcttttaatccttaattctatccgcttaatccccgacgatttttaattaagaaccccaacaaatcttgttgttgattttttgtcaattgtctcaattttttctcgtcctaaggtcggagacaattctaatttattttttttcaaaaataaaaaataggtcaaaaattggtatttcgtgaacaaattaacagaaatcctcaaaaaaagattaaaattagaaaaataattttttaaaataattttatttttaggaaatatattttttccacttcatcttcaaccaatgtttgacgcagcatatggtaatttcaataatattcatcgggaacgaagcaaaattttcccatgtctcagtggatttggatctgccgatggctcagcttttcggatcgaccggttttgcgctgccgacacatccgggtctcgacaagcagcatattgatcaaattgtgatcacgatttatcaattcttcaatgaaacaatgaattagggttgcgccaattggggggagagaaaatatttttgggaaaattgagaaaataaaaatttttgagaagaaaaaataatttgatttatcgttttaaatccaaaagaaaaaagaatcatttcgtctagtggctaacctacagtcgttctttgattcctatgatgctttcggcgatcgcaaaagtatgttttatagttttagttgcatgtctcgagttttatccaaaattttcgactgtttcttcgaccgttttaattgataattgtggctaatttgtttggcaatttgtacccaaccacaaaaaacacctgttgctgctgtggttgttgcacaacgcccctggcgttgtgatgccattctgttgctgctgctgtttttgctgttgttggtgctg

SEQ ID NO: 44157 - DNA, 1282 bp, Heterodera glycines
  misc_feature (1095)..(1095): n is a, c, g, or t
  misc_feature (1184)..(1184): n is a, c, g, or t
agatttttaaatgtttggattttttttggcttaccaaaactttcatcgaacctgggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttggcttaccaaaacttcatcgaacctggttctttctattctctttcaaatcgccccaaattttttttaaagcttaactaggccctattaagcttatttccagaaaatctcgcatgaattctcatttttaaattttttatagatttttaaacctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattatttgagtaccccaaacggacacttgaaaaaatcgatttttttgttttcggngcagtccccccgaagcgatgcgcccagatttatggggagaccgaatccttcgggaatagcttccctatagcctgtactttaattctgcngtggatttttgctccccataattgtttgagtaccccaaacggacacttgaaaaaatcaatttttttgttttcggggcagtccccccgaacgatgcgcc

SEQ ID NO: 44158 - DNA, 1301 bp, Heterodera glycines
  misc_feature (1239)..(1239): n is a, c, g, or t
gaattatgattaaatttttgcgtttcgaattcatttggaattaagaaaaataaaaattgataatcatttgatcatttttagcgcactttaagcaccgcgtttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcattcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagggcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttagttgaatttctccgcctcttatttgtgcaaaattttcgaaaaagtaattttctatttataattaaaaaattcagaagcaaattcaagaatttttttatttttaaatgcattttttaccacatgaattatgattaaattntttgcgttcgaattcattttggaattaagaaaaataaaaattgataatcatttgatcatttt

SEQ ID NO: 44159 - DNA, 659 bp, Heterodera glycines
ttttttcaaacccattaattttttttacccatttagcgacacaaagtgattgttctgttacggctcaagaaggcattaatggtggaaaattcaatatctttttagttagaaaaccttgcaaaattaaaaccggactctaaacattattttttgataaaaatctgttcttacagctgaagtaaacccaaaaaaccctaaagaacaagtgttaaaattagtgacaaaaatgggaaaaacggacaaaaaaaaacattggtggaattttttttatgaaccgataggtaatggcatctcctgaaattggagcgtttttataagtgctagaattagtgacaaaaatgggaaaaccagacaaaaaacacattggctgaaattttttatgaaccgattaggaatatcggcatacagaaattggagcgttatttctttcttgtagatgcatgccaggggtggagcgcgaccgcgatccgcgattcgcggcattttttttgcgcgatccgcgattcgcgaccgcggcaaattgaatccgcgatgcgcgatccgcgaccgcgggattttaaatccgcggttcgcgatccgcggaatttgagagtccgcgacaattttgcataagattaaaaatattatttatcgaagcgattgattttatattaacatta

SEQ ID NO: 44160 - DNA, 1018 bp, Heterodera glycines
ggcacattcgccatcatgatctccgccgacttcatcacacgtgtcaacgtgaggagcgagaatcaaacgatcgagcagctcttcgtcattcgccaaggagtcgtcggaagttaggatagacataatctatcagctcttccttcgctcttaacgaggaactcgcggaggaatccagaagtgctctccggtttctccgagcccgatttggcggcacatttgcaagtacgctcgctcgacctcggcccagtctctggttgatggtcaatttcatcgtggtgaattgaccaaacaacggagacgtttgaaaacaggctgtcacctgagcggttaagccttcatgaggcacgaccggcagcgactcgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttccattgccgcgtcagtatttttggcaattgaagttggcggggctggcagggtaaaatgcacacagcttaagttaaaagagctgtgcagccgcccatcaatgt

SEQ ID NO: 44161 - DNA, 1461 bp, Heterodera glycines
  misc_feature (26)..(26): n is a, c, g, or t
gtccagcgctgaatcgcagctctctngggttgcgaggtgtagcgtatagaccgtgagcttgggttggcccgctgtttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgtactgctagcctccagactggggtttgctgtccttctgttcagtggcgaatggggcatttgcaggcggagtgcgctgagatgctcggagtagctgcgtgagctcggtcttgaggccagccttttggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcaggctctcacttgtgcgttctcggtgtaaaagccggtcatctgttcgacccgtcttgaaacacggaccaaggagtttagcgtatgcgcaagtcattggggtggttcaaaacccaaaggcgcaatgaaagtgaaggcttcttacggagctcgacgtgtgatccccggcaccgcggtgttggggcgcaacatagtcccgtctcgatcgcacgcgatggggcggagacagagcgtatcgcgctcgagacccgaaagaaggtgaactcttcctcgagcaggatgaagccagaggaaactctggtggaagtccgaagcgattctgacgtgcaaatcgatcgtctgacttgggtataggggcgaaagactaatcgaaccatctagtagctcggttccctccgaagtttcccccaggatagctcggagctcgttaagcagttatactcggtaaagcgaatgattagaggacttggggacgaaatgtccttaacctattctcaaactctaaatgggtatgaagccagggttgcttgactctgaacccaggcgttgaatggtttgagctccaagtgggccatttttggtaagcagaaactgggcgatgtgggatgaaccaaacgtggagttaagagtggccaaagtggcccgctcattaaacctcataaaagggtggttgggttggatatagacagcaggacggtggccatgggaagtcggaatccgctaagggagtgtgtaacaactcacctggccgaatcaactagccctgaaaatggatggcgctggagcgggccacctatactccaccgtcattggcttgtacacgtgctggtcgcg

SEQ ID NO: 44162 - DNA, 995 bp, Heterodera glycines
cttttatttttgagggaatttttaaatttatactctattccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttacgtatgagacggagggctgtgcacaatcgccattttatttcacagaggatttttatatttagaggttatcccagaaaaatgggtatctctttttttgataaatttatacacatacaaatgctctcgagcatgatagggga

SEQ ID NO: 44163 - DNA, 1019 bp, Heterodera glycines
ttatcatttctaactcacttctcaaattgttgataactttcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtctttatcgcggttaattagagcaacgaaaattggtttgaatcgtgaagattatcatttctaactcacttctcaaaattgttgataaattgcaaatatatattccaaaagtctgttgacactttctgaaaataaattctatactcatgtattttccacttattagattctgcaggcttattgctgcatgttctttgacacttcttcaaaataacctatgatctttattcgttcaaaacagcatctttgttg

SEQ ID NO: 44164 - DNA, 550 bp, Heterodera glycines
ccctgcgatgagactgtagttactctcagagggaggatgacttgagaatgagaacatgcataaaaacttgagtatcgtagccacgcattttcacgcatattttaggaattttaaaattaattaaactttttgtaattactaattagaattttaaattacctctttaacaataggataaaattctcgaaattaagaaatctgactttcaatcgacacaactcttgtgctaattttctgaaaaaacgacaagatacatttatttgtgtgaaaattacgaaaaaattcttattgttagaagaaaatagaaaatttcataaaaaaacttaagaatttttgtagtatttttaataatttcctagaatttttttaaaatttccttgtttacaaatttttttcggggggggggggggtacgatgcgtggagtggaatgtaggttatgccggaatcccggcctcttaaaaaattatcgggctcttatacagtttaacccccatgatttttttccccatttctaagtgaaaaatgccaaaattttttttgactttatgt

SEQ ID NO: 44165 - DNA, 1134 bp, Heterodera glycines
aaattattgcgcgtaattgtcagggtttccgcgcgaatcccgaaaaactgaatctcgagtcgcaaaagccgacatttttctcgccctgaatcccacccgaccatttttctcgattcgcggcacaaccaatgcccaataatgccaaagaaaatttaaaaatgcattctgtttgtttgtgtgaggataaatagtgccgaaaaggcgatggtggcgattagctaatttatttttgatttttattatatcttacggatgtctctatttttatttatcatttatttaattttccagcaggatgttatgctcaaattttcttgcatttttatttttattattttattgccatttttcatgtgccatcaatccggatccaaagtttccagttcacacaattcaaagtaaaatatttaatttaatttgaaacatatttaaataaaacaaatttcaattggttccaatatggaatttccaactcataaaatccaaaaacacttaaagtaattttattatattttaaaacccatcaagcgtgggaagaaggctaccccccccccccccccctgaatttttgcgcgtgccttttttaaattttttttaggttgattatttttcaaaaatttccccattgttcattttaaaaaattttcgggaggagggtggctatagctagccataaatcatcagattccgccctggctacgcccctgggaccaaaaattttaagatttaattatataatttattaaaaataacttccaaagcaattaattaaaatgaaatttaattggtcgcaatatttccaatttactcaatctgcattaattagccaattcattaattcaaatagctcatttgtcagttgatgcaccccatcgtacagcaacatttggtggcccacccggcgtcagaccgttcatttcgggcagcattttcaccagcggcgttggcccggctgccgcaggtgcgatcagctcatcccataaccatcagccaaccgccgtctgttccgagaacgaatttcgctgtgacgatggtgaaatttagaataaattaaaagttaattatttatttttgtttatacattttgggaatatgtgggaaaaattaaaatttagaaaatactaactttaaaaa

SEQ ID NO: 44166 - DNA, 1093 bp, Heterodera glycines
ttggttcatagtcacccgtcgccagtgaagttcaacacttgctgcttgaatgtctcgtaacgcagtccttggttgttgatgacgtcgtagttcaacgtcatccctcgcaccttcagcacatattcaaactccgcatctgcaggtgcgttcagcctcagtttcaaaccatactaaataacatttaaatttaccgttgtgacaaattaaaatacctgatttgcaccaccactacagtactccacaatttcatgttgtgggtactcatccgtgaactgacccaaatgtgggccagttttgagcgggcagatgtcttacgggtggagaaagatcaacgaatccgtgtctgggaaaattttctatttatttgttgatgaactaataataattgtaccagtgtatagcagcccgcacccaggcgttcgcaccactttctgcattgcctttagtagtaggagccgtgcagccgaggtcatccacagagatatcactgaaatttttatattatatatatatttgcgctaatttattgatccatacttatgttggagcagtcgtgctcctcaacccactcttttttattttcgtagctgaggaggatgtgctcctcatcgagctcgtcaattgcggtcacatcgattgatcggttgtccaagtgttcccttaagacaaccgggtcgttagttatcagcgtctgcgaaagtccaaagatgcgcaaagagaaacgccccctttaaattaatccgattattattgacacttgaaaaggaaaacccacataaattattcagacacagctttgcaatcgaccgctttccttttttttgacagccatttttgatgggtcgatgcttattccaaattgctcatagcattcccggacgaactgcgtttcttggtcggcgttgcctttgattttggagtcgaatcctgatgcttgaatcttctgcgccatgaactcagcaatgtatggtcggaacagctgatcatcactctgctcgtactccagcacgcggaacactttgttgacgcgatacccctactcgatcgctgcgttcagttcaattgaagtgctcttgttgacccaaccgcgttg

SEQ ID NO: 44167 - DNA, 1155 bp, Heterodera glycines
ttttgctccccatattgttgagtacccacacggacactgaaaaaatcgattttttgtttcgaggcagtccccccgaaccgatgcgcacagatatatggagagaccgaatccttccggaatagcttccctatagcctgtactataattctgcgttggatttttgctccccataattgtttgagtaccctaaatattatctagtcagttcatttaaataatttttacttgaaaaaattttttttttggttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaaatcgatttttttggtttcgaggcagtccccccgaaccgatgcgcccagatttatggggagaccgaatccttccggaatagcttcgctatagcctgtact

SEQ ID NO: 44168 - DNA, 706 bp, Heterodera glycines
  misc_feature (345)..(345): n is a, c, g, or t
  misc_feature (350)..(350): n is a, c, g, or t
  misc_feature (356)..(356): n is a, c, g, or t
  misc_feature (385)..(385): n is a, c, g, or t
  misc_feature (392)..(392): n is a, c, g, or t
  misc_feature (402)..(402): n is a, c, g, or t
  misc_feature (411)..(411): n is a, c, g, or t
  misc_feature (419)..(419): n is a, c, g, or t
  misc_feature (435)..(436): n is a, c, g, or t
  misc_feature (439)..(439): n is a, c, g, or t
  misc_feature (443)..(443): n is a, c, g, or t
  misc_feature (445)..(445): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (457)..(457): n is a, c, g, or t
  misc_feature (471)..(472): n is a, c, g, or t
  misc_feature (477)..(478): n is a, c, g, or t
  misc_feature (488)..(490): n is a, c, g, or t
  misc_feature (493)..(493): n is a, c, g, or t
  misc_feature (505)..(505): n is a, c, g, or t
  misc_feature (507)..(507): n is a, c, g, or t
  misc_feature (510)..(510): n is a, c, g, or t
  misc_feature (515)..(515): n is a, c, g, or t
  misc_feature (522)..(522): n is a, c, g, or t
  misc_feature (539)..(539): n is a, c, g, or t
  misc_feature (547)..(547): n is a, c, g, or t
  misc_feature (549)..(549): n is a, c, g, or t
  misc_feature (563)..(564): n is a, c, g, or t
  misc_feature (577)..(577): n is a, c, g, or t
  misc_feature (590)..(590): n is a, c, g, or t
  misc_feature (622)..(623): n is a, c, g, or t
  misc_feature (626)..(626): n is a, c, g, or t
  misc_feature (628)..(629): n is a, c, g, or t
  misc_feature (637)..(637): n is a, c, g, or t
  misc_feature (639)..(639): n is a, c, g, or t
  misc_feature (641)..(641): n is a, c, g, or t
  misc_feature (643)..(643): n is a, c, g, or t
  misc_feature (646)..(647): n is a, c, g, or t
  misc_feature (649)..(649): n is a, c, g, or t
  misc_feature (652)..(652): n is a, c, g, or t
  misc_feature (654)..(654): n is a, c, g, or t
  misc_feature (657)..(658): n is a, c, g, or t
  misc_feature (660)..(660): n is a, c, g, or t
  misc_feature (678)..(678): n is a, c, g, or t
aaaatttagaaaacttaggaaaattcaaaaactaatcccgcccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaaagataagcctaaactttttggcctgtttaaaaaggaattaaaaatttttaaaaatttattcatctccctttttgatagaaaaagcatcagagtgcctaaactagcatgtaaataaaatttggtgggtttnagagnattttntgaaaaaaatatttatgaattaattatgnaaaaaanaaataaaaangaaagaatnagattttngaaaatttttttgagnnagntagntnggngntnatttnagtgtaagttagtnntttannggggagtatnnntgnaaagtttggtangnttntggtnaattagnaaaaaatatgagtgatngaattttnantaaaaaagttaagnntaaattttttggnatatttaaaaagnaattaaaaaatttttaaaatttaataattttnntgnanngaaggtantnantnggnntnttngnggnntngtggtgggccttcggtgnaggaaaattattaaattttaaaaatttt

SEQ ID NO: 44169 - DNA, 726 bp, Heterodera glycines
catcgccaatgcttttcagagagaaaataaaaaagaaactcgtaatggctgctgggaaaaaggcagacggagaagttgccgcaaggcaaaaaaagcgaaaacgaaaaatgtccgacgaatcaaacggagacgatgaaagcgacgagaaggactcggcatccgaagcagaggaaggttggtgcgccgaacgagcagatattgggcattcatggagttgacgggtcccgcgttgttgtgcgtcgcccagactcgaatggagaactgtgagcgatttgaatgctttgcggacgatggcgcacaaattgtggggggatccagagcacccatccggagtgggcttgagctcaacgaagtgttcatggactactgcaagaatggaatactttttggaaaatctatgttaatgatatatgatttttaatgatggccagatcctgacctatggtatgggaaagtatgaggcagctggtcttgtgcgagactcgggatgacatcacggattcggtcaccatcccatccgggtgcatgaagtatcgggagcagcgggatcaccacgacgaagaacgggttacgatcatcccactctcgagatacgagatgcgatgaatacagagctccatcgccagcaaatatgtgaaggtgtatcacatttagtgtaattttactttttgtcgactctcagcggcgagccgaagaagaattgcgggagaatgaacgagtcctgcg

SEQ ID NO: 44170 - DNA, 1787 bp, Heterodera glycines
  misc_feature (19)..(19): n is a, c, g, or t
  misc_feature (25)..(25): n is a, c, g, or t
  misc_feature (70)..(70): n is a, c, g, or t
  misc_feature (1597)..(1597): n is a, c, g, or t
  misc_feature (1720)..(1720): n is a, c, g, or t
gggagagggaatttaaagnccgcgnacagaatgggccaaagactgagaaagggaaaacggagcaaacacnaaattaatttcgtacctattaaattttttatttgtattattaataaaactattctgctggaatgaattacaatacaaagagaggtgttcaaaaagaaaggaggaaaatgaagggaaaaaagaaagaaaaacggtgagaagtgacgacaccaaacaaaaccggagatgaacacatggaagaacatggacaattaattgtattagaaacaaatttataacggatgaggaatttgtcaaaaaaatgaaaatgggaagagagagaccaatgtaattccaaaggagaaaaagagggaaaggaaagctcaattcatagtgaaacgatcagttgactagaaaaaggaataaagaggagcaatgctactgattgtgaacggaattgtcaatgggctgaggaaatgttcgatatttggctgatctttttggttgtgtaacggcccatcctcggcccaaaagaaagagtccgttgaatcggcgattggtgccgtccgccagcgaagaatttctgctgttccgatggattgtgccattggtcccgtgccgacggcgaccccacgggattctcgacgcgccggggaatgacaatttttccggaatgaaggtcatgcaaatggtaacaataaccgtcgtccaaagacacacaaccgcgtcgacgatggccgcccactttgaaaatgcgttccgactccaaaccggcatttgaatagacctaaaagggaaacaaaagcactgccaatgagcagaacacggtcgaccaaccggaatgtccttggcactgccgatacgcagcatggatgcaaatgcccatgtccaacaagtgtttgatgtgttgcgtcttctgccgaagaggctccgttgaaagggaaggcgtgaaaaagagcagcccttgggggaagttgtgagtggcgagccatgcgctgactaatcgctgctgcatgtcgggccgcgcggtcaaataaatgatcaaaaagccctgaaaggcaatcgcgttttcgactcctatgggaagcaactccgaatttgactgcacctgctgctgccaaaaacggaccacgtcaactgcgcccgggcgaagacgtgggtcacgaccagtcacagaaacagaggcagtcagagagctgaaaacaaccaaacgggaggcaattggaggatgggtacggacgatacaaccatcggcaaattactcacccgtcgatgctgaacacgaccacgggagtcccggtaggaacgacggcgatattcacactgagataagtatctgaaaaagggaggagataccggcaatgaactgctaagggccagcacttacgatccccctgcacaatcagacgaacattgtgaattccgatgggcaaactccgtcccaagtcaatgcttagcctcccgtttttgtcggtcgtctccacgcccttcagaaaccattcaccgccgctgggcagcacatacaccaaaacattttcatgagacaaaaccaccaaatccatggggccgtagcaaaagcgagcggtgatcagctgctcaaggccttccnaccacgatgaggtcgttgggccctggtggttggcttgcgagattggcaacctaacctttgccagattacaattccaatgccaggatcgccttcccctcgtccgtcctcagtttcccaccttanaccgtgtccttttcctgttccacactgtcagtggcacttggactcaaacggcggctgttcattgagg

SEQ ID NO: 44171 - DNA, 177 bp, Heterodera glycines
ttgctaattgtcccgccgttggcattttcttctcaaaatgagaggggggagggggcggacggttaaaaatatttgaagagccaatggaccatggaggaggggggagggagaaccaacattgcggatttccgtaattgtaaatccacttgcatccagccctgaccggtacgaatccca

SEQ ID NO: 44172 - DNA, 938 bp, Heterodera glycines
gcactcttagtttaatttcatacaaatttgcattatttaaacaaaaaaaaatttaaagttttctggcagcgccagacccctcctccctgtccttctgcccattttcccagaaatttcttttgaaaaaattgcattgaaaaacggaatttcggatttcagacaattttttttgggcgcttccaccagttacgcccctgctggtataaaaagtaagcgttaatgaggaaaaaatgactaaaacaatttaaatagtacagccatattatatggaggacaaaaaaaaacataaaaaattattaaataatttgatggaaaatgaaaattacaatgttcgtccaccaaaaacggcgcccccacaaagtgtccaagccacgaaatgtccaaaagagtaaaaacccacgaaatgtccaaaatttttcaaaatttataaaaacaaaatgagtctaatttaggatttttagggttttcggggtcgctaaataagaatataccctttatattaccccttgcctaaccttaggcccatctgaattataaaaaactcaaattcgagacttggacatttcgtggtcagcgccaaaaacggaacggtgggaggcgaataaaaggtgaaattaatgaattcacatcaagcaaaaatgaggaaagtttggttgattgaatttttactctgattaaatggggaaaaatatgaaattattttatcgaaattttcggaaaatgaccgatttaatcgatggtgtcgaagcagcaaagataaatctgctttccatgatttattagcattataaataaattttttgcattaaaaatctcaaaaagcatttccggcagcgccggacggacacctaatcccccccccccatttttccaaaaatttcgaaaaacagcactgaaaagcggaaaatagctaataaatataatatcgacgaaggaca

SEQ ID NO: 44173 - DNA, 1303 bp, Heterodera glycines
  misc_feature (48)..(48): n is a, c, g, or t
  misc_feature (91)..(91): n is a, c, g, or t
  misc_feature (1211)..(1211): n is a, c, g, or t
  misc_feature (1235)..(1235): n is a, c, g, or t
ccttgcgatgacttaatttatgttaattaaaataaacaatagttattngaaaaattgtaatcaaatcattattaaataattttcaataatntaggatagtttaatcacttgcttttattcaaaaaataaggataagtaatatagtgaagcttgtgattagtttattttttgcaatatcatttttgatgcgttaaaaaaattatttaaatatttcagttaatgttaattttatgcccattaagtgtaatattaacttcttgagtgtcctttatttaataattttgtcaattatcgtattaattttgatttttataatttatctgattgtgtaatatttttgttgtttaattctatggtatttttgaagattttttgtttattaactatatattgccagttttgaaataaaattctatcagtttttagaaaataattatttcaatgaatttatcaacgttttaattttttgttgtataacatttaaactaaaatttaaataatattgcaggttgtttgtcggttatttttctttcaaagttccttgcctccagcttttttgtcccagtcttaatatgtttttcaaaaactaattgttattattcattagcatttttagtattattgtgttcaactatttttaacaaaagcgcatgtgatgctgcaaatctaatggttctgatttctggctgtttactgtttgtaaagtgttattttaagttttttggactttataaaatttaattttgtaattatgtaacgatttttttaatttgattcattttaacactaataaacatcggttggcgcatataactttttattttaattataatctcataaaataattttattctcatttgatagttttttaataggataaatttatatgaatccaatacttttttaaatttcattgaagctataatgcatttcatacaattcaatttatatagcttatgctgtaaatatatttttaattatttttctatcgtatgtaatctctttgaataataaatttagttttatctttttttacaattcaatactttattttaggagtagattaaaaggccgtagttggtattcaagaataacagaaaaaatagataattgttatttcaaaatttgcttagtggataggaacgacatttatattgttttataaaatttatgtagaagtgttttcattataatattttttattctattcngttgatatttttcaatagccttgnaagaaaatagtttttctgtctattttaatttatttttcgcttcaatttaaaaaaaatcaattttccaa

SEQ ID NO: 44174 - DNA, 1485 bp, Heterodera glycines
aaaataaattttttttttttttttggtttattttaatttgtttttcatcctaaaaattttttaattaaactttttcaaacttttcaccttatttattttaaggcgaatttttgccttttttaataaattttcttgggaaaaaggcaaaaaataggctttttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaatgtgttgtaagcttttttccttttttcacttttaaatttatttaaattttcaattttttttttggctttttttcaaaaaattttttgtcttttttttcggcaggcactgcctctgacaatgttttttatttatttaaaaaaataaatttattttgttactttttgattattttaattttatttcatcctgaaattttttaataaacattttcaaactttcaccttattaatttaaggcgaattttgccttttttaataaattctcttgtgaaaaggcaaaaaaataggctcttttaaatatgcctatttaaattactttaatttttttcacttttaaatttatttaaattttcaattttttttggctttttgaaaaaattttgtcttttttttcggcaggcactgcctctgacaatgttttttatttatttagaaaaacaaatttattttgtttcaatttgattattttaattttatttcatcctgaaattttttaataaacattttcaaacttttaccttattaatttaaggcgaattttgccttttttaataaattctcttgtgaaaaggcaaaaaaataggctcttttaaatatgcctatttaaatgactttaattgctgtcctttcgcttacgaccataccacgttgaaatattgtttctttttgattattttaattttatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctggcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaatttttcgtcctgggaatcgaaggtgttgtaagcttttttacttttttcacttttaaatttatttaaattttcaattttttttggcttttttgaaaaaatttttgtctattttttcggcaggcactgcctctgacaatatgttttatttatttagaaaaaataaattttttttttcttttt

SEQ ID NO: 44175 - DNA, 1612 bp, Heterodera glycines
tctgattttttaaacacactcataattttggagttttatggcataatgtcaatattagtcaagaaactttcaagtttacgcaaaatttggtcatttttgggcaaaaaatcttaaaaaattattcaatttaaaaatgcactgcaaaaaatgttaaaaatctgaaaaaaggttaaaaaaccattttgatcacaattacactgttcctccacaacattgttataaatgatggaggtgaaaaatataatatttttatatttttttgattaaataaattgtaaaaaacagctgattaaagcaatttgcaaaatgttcttatttttggctttatgttcttattttgaaatattaatggcaaaataataataaatagggctgggatttttatgtgctaaaaatcctgaaatatgtaataaaatatgtgctaaaaaccaaaaaaaggcctaaatacgtgttaaaaaatgcaaaaatatgtgctaaaaattggaaaaaccaatagtatttttgcataaaaattccaaaaaactcattctttttattttcgcccgcacaattgcaaataaaaaacatttggaggtgtttgggggtaaaattagtccttttttgataaattgtttttaaagataatttttccatcagttgagtaagttccagcaagaaacttcgatatccagtaacgaataaatgaagaattcgattttcggtacacgaaataaataaagaaaattttgaaagagcctataaaaatggcaagaaagttgatttttaggggtgcatttttgaattttttgtgtttttcttagatatttttttcaaaaatgccaaaatatgtgcaaaatatgtgccaaaccccgaaaatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctaataataaacaaacagagaatattgaacaacaccaagaatgcttaatttgtattgataacggatgagaaaatttgttgttatggaaaaaactttttggaaaagtatggtaatttttaataaaaacaattggtaatttttttgcgcgatccgccacaactttttcggttccgcttctcaccccatggctctcttttctccttgaggaggaaatacttttttttgaaaatgccgccaaataaaacgcaacaccaaaaaaatataagtacaattttcatttttttatttaaattttatgtcaaatgattaaggaaaaatggaatatttcagctctttcgttgactcttcagcaatggaaatgcaaattttgagcaaacaaagagagaattatgaagattttttctatttcctggcaaaagttttgagcaaatttggtggaaaattgacaaaaaatgagaatagggaaacaatcgaaattggcatcgatgggggccacaaaatattggaaagtttgaaaaatatgccgataatatgttgataaaaaaggctagaagatggcacccgtactacgagtgccaagcgaagaaaaaattgga

SEQ ID NO: 44176 - DNA, 1114 bp, Heterodera glycines
cgaattaaaatataaccatagttgaaattaaatttagttaaatttgtatttgactacaatgagagcttgaccataatcattttaaaaataaaaaaaataaaatgttaagggttcgaacctacgagtatgagacaagagcactacaactgcaccactgaacaccacaaaaccagtgaaatgtttgttctttttatatactacctaaacaattttggtacgtcaatctcggcgcagatgcttattccgcagcagaaaatttttttgtaacacaactcaggggttgtctacgcacctacaaagtttcatttggaaatcccaacatctcctgaaaactctcctttgtcaggggaattgggtctgctccagcaattttctaatacataaaacggagtaagggttttacgggtttttagtccgtaagtccgttgtccgtatggatgcctagtccgtagtcctggtcctgatccgtattttctcaaaatcacgaactctaatttatattaatttcttgtaaaaaatatttttttaaatgaaaatgtactcataaaaatcttttccaaaaatgtgatgtcaaaaatcactttgtaaaatatttaatagtgattctaagcctattttggtcatttttatggcattttgtgcctatttcactttttacgaagaattttttttctaaaaataatcattaaaattttttatttacatgttttggtacatatttctgggtttttgtacatatttcttagatattttagcattttttatacatattttatttacatatttcgcgatttttcttacataaaaattccatccctacatatagtaaaagtaaaattgcaggtggaagaattttttgcggaacaatatttcaattttaatttgctttcattaaaaatcaaatttcaattaaagaataaaagcatcaaaaggattaaaatgaacaaattgatcaactttagtgtatttcttcctcagagagttgccaaatcgaatttgaaattgggcccaaaattcgcctcaatttggtcaccaaatgaatacattgaaacgaatggatggaaagaatcatcagcataagatttatcaacgaaaaaatcagagaaatctatga

SEQ ID NO: 44177 - DNA, 641 bp, Heterodera glycines
aaattttttgaaattttgcaggctaatagaggattcttagggctatcgaatgatactaagaatgtttaatttggatattcttgaaaaagttatcggacatcgctggcgcccaaccatcgcgcgcccaaacgtgagcgtccaactcgagcggttccgatatacatagattgattttttgtcgctaatttaaaaatataagtagttacctatcgtgtgtttctgagtgttttcggagtcacttatggtaattttgaaaccatttagaccaattaaaaacctaacccgagctcgaataagttgaaaatacaaatttcggattttgacttttatacaattcgggttagtgattcagaatttacgtgtattcgaaatatttattcgattttttttttttttacaaacaggtctacttcatctaatttatttataaatgttaccggatttatctgatcatttacatacagaagaatgtaatttcctcatcaatctttatcatagatgcatgaaggaaacacctttctacagtaagttatttaaatgaaatttaaatggggctttatgttaattcctatccagcaaggtatctctggcgcggatgttcatattggtacactgccatttctcagtgtcttcaccaagag

SEQ ID NO: 44178 - DNA, 942 bp, Heterodera glycines
  misc_feature (867)..(867): n is a, c, g, or t
  misc_feature (892)..(892): n is a, c, g, or t
caaaaaaaaattcttgaccaaaaaaatggctatctcttttttttccatttttttccggcaaaacttggtcccaacagttgccttctcttttctggccctatcaaacaatcttacgatatttgaaacgcaaacaaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttactgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcanacaatcttacgatatttgaaacgcnaacaaaaaaaatcttgaccaaaaatggctatctcttttttctcatttttt

SEQ ID NO: 44179 - DNA, 1399 bp, Heterodera glycines
tccctttcatgctcgagagcatttgtatgtgtataaatttatcaaaaaaagagatagccatttttttgggatagagtataaatttaaaaaatccctcaaaaataaaaggtctattgcgccccggctcccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtttcatacgcaagcgcttttgtgaggtataaaatttctcaaaaaaagagatagccatttttctgggatagactctaaatataaaaatcctctgtgaaataaaatggcgattgtgcacagccctccgtctcatacgcaagcgcttttgtgaggtataaaatttctcaaaaaaagagatagccatttttctgggataacctctaaatataaaaatcctctgtgaaataaaatggcgattgcgcaccgccctcactatcatgctcgagagtatttgtatgtgtataaaatttctaaaaaaagagatagccatttttctgggatagagtataaatttaaaaattccctcaaataaaagatcgattgcgcaccgccctccctatcatgctcgagagcatttgttgtgtataaaatttatcaaaaaaagagatagccatttttctgggatagagtataaatttaaaaattccctcaaaaataaaaggtctattgcgcaccgccctccctatcatgctcgagagcatttgttgtgtataaaatttatcaaaaaaagagatagccatttttctgggatagagtataaatttaaaaattccctcaaaaataaaaggtctattgcgcaccgtcctccctatcatgctcgagagcatttgtatgtgtataaaatttatcaaaaaaagagatagccatttttctgggatagagtataaatttaaaaataccctcaaaaataaaaggtctattgcgcaccgccctccctatcatg

SEQ ID NO: 44180 - DNA, 1125 bp, Heterodera glycines
ctcgtcatcaatcagtgatccgaccagcttggctattgatcagcatcgatctgatcagtctccatcactacgtttttccgttgatcagccgatcaacggaaaaaactctttccaatttttatcaattgttatcaccctctgatcagtgttcttctgatcagaattttttgtgtttctcttctgcttgcctgcaatgtctgctgccacagatcggtccgcgttgtcgtcggtgcgctgccgttcagcggcgtcgatgccatgccggccactccgtccgcgacaagggcatttgtcgcgttgccgccaccgttgtccgcaccgttgccaccctcttgcgaagcggagccgttgaacgccgcgttgctgaacgcaccgctcgcccccgtgttgtggtgatacggcacaccggcgtcgccgccggcgcgccccccgtcatccgacgaaaacattggcacgcggcacacggaataatcacacagactacggcactactaaaatggcaaaaaaagggctatcaattatcagaattagattcactggatatacaaagatcgctctaatcaacatttattgaccccacaatgattaattggacaaatacaaataaaagttgctaccagaaattttagatcgatccgacctcaaaaaagccaaaagcacaatttggacgaggggagggggcagctggtgggagacaagcatcagcagaagataaaagggggcttaaaagaggagagagggagaagaaagagagagagagagagagagagtgaggaagagagagagagagagagagcgagagagagagagcatttggcccaatcgctgcttcttttgtgaagcaagagattggcgagagagtgtgtgtgtaagcaggaaaaagactgagtgggatggagagagtgagagaagatgagcgaatgacattggaatagagagatatgttggccaggatttgggagatccggtgaggtgatagaggtcggaaaggtaagcgagagagcaaaagagaaaacgaagagaaaaagatgtggtagagaagaggaaagaaacgagagcatgggaaagagtgagagataaatgagagggagggacagagagagggaacgagagtgagaacgggga

SEQ ID NO: 44181 - DNA, 758 bp, Heterodera glycines
tcagcgaacgccgatcttttttcggttttaaatcgaacgccaagcggaagtgccaaccaaaacatattcgattttcaattaatctaatctttttcatcattcataatctcgtttctcttctctcagaaaaaaaatcaacaataaaaagacgttcaaattcacaaaatctctcacaagagggaagttaatccaacaattcgatcgataaaaatcttcgtcaaaatcgattacgtgaatttcgtgcgctttatccattctttacggaaatatcgttcgtagaataaaataaatcaatcaaaaaatctcaatttttcaactttaacagccacaaaggcgcaggacaacgtcaatgtttgccccctttttaatgccataatcccccaaagtacggccgtcctcaagttgttttcctgaaacaattttcataaaaaatggaaaaaactactagggttgggcccccgaccccgccccgacccccgacagttttgcccatttttcggggttaaccccgaccccgacgctcccaaccccgacgaaccccgaccccgacccttaaccccgactcggggtcggggttaaatatacacccctaggaatagcatttttgttggggaaaggcaaaaaaaataaacaaaatctgaattttttgttaaccattttgccaaatttttattaaataaagtaatttgcttttgatgtttaatatgtagtagtggtgtagtggttagtgcgttagcactaacacttcttttgtcatg

SEQ ID NO: 44182 - DNA, 1150 bp, Heterodera glycines
ttgctgtcttttgcttcaggtctgcaaaatgtgctctttgtggtgagtcgaactcgtaaatttcggcttgtccacacttgggccggccaatttcacgtaattgccggagccaaagctttgcacgttgaagccacgttttctaatggggggagggggggggggggtacagaaaatgtgcccataaaattgaaatttaataaaatttataaattaaatatagaaatttgtcgcaaattttttgaagagcaggactttgattttgataccgaaattagggtattttcccatttctgggttcgcagaattcatttttatttttttaatcaacaaagttaggacgatagtttacttttgaggaaggaggacttgtggaggagctggacccaggcttggattttccttggctcaaaccaggtttaggtatgaattttttttttttttttgaatagccaattttcaatcccggcccaaaacttaaacaaattgcgaatgatcttttcgatcccagcgacccaaaaccaataaatacttttttggcttaaaaaaacagattggtaccatcgacatattattccaggcaatatttggccacctggactccctgtatttttgtccagaaaacagatctaggccaaataaaatcccatttttttatttcttcgacttacaattaactcgttttttcattattttatgccgaaattcaggggctaaaccaatcaaaaaacacttcccaattttgaatagttttccaagaattcaaaatttgctttttcttcttttaaattttctcactgcaagaaaaagtgtgcctccatgctgcggttcatgtttgacgagcaactgacagcaaaccgaattttgccgttggaccgaatgttcatcatttttaacaaaaaatatttgaagacacgaaagcgaagaaacactccaaaacaacaatcaattagatgaaatgaaaaatgccttttttggtgagggaaagacatacataagagaaattggcaaaatcttttgtctctttgtacagctttaacagtatgaaaatttaaaatttggcaaaaaacattatgccataaaaattcaatccaaattttggagtaaattttttttttgccgttagcccctaaaaattttttcacagctaggt

SEQ ID NO: 44183 - DNA, 1846 bp, Heterodera glycines
  misc_feature (1761)..(1761): n is a, c, g, or t
cgcttttcctctatttcttttttttctctaatttttccacttcctttttctctttttcctccttttctccttttttctctcccgttttcctcctctccttttttctctcactttttcctcttttcccttttttttctccctttctcatccttttttttcctccttttttcctcccttttccactttttctttccctatctgattttttcctcccttttccctattttttcctccttttcccttttctcctttctttccctcgccccgtgagtgcatttccctcccctctttctatccctgtgggtgcattccccttttttcctttctaacccccgtgagtgcattccctcacccctttctcccacacccgcgccatgtgagtgcattttgcacctatttcttccaccacccccgccccttcaccgaatttcattgatttaattccatctttggatggaattaccgaaaccatattaaaacatttatccttttttttggataactgtatcctgggccgaatggttgtggtttgaatttggttcaaagttcggaatcccatgttaacggttaattattttaaataaaagagttggtttttgacgaattaattatttaaatttctcatgggtttggacccctgcccctgggactgggtgattttaaatcatacatagctgacatttatcctttttctgacaacattatccttggcctgatggttgagttctggatttggcatcggggttcgggtccccattgcttgtgggtgaattaattggaattaaatggtatcatgggtttagaccccggcccctgaggctgggtaattttaaattacagatatatgtcatttatcctttttccgtcaacactatccttggcctattggttgtgctctggatttggctcttgggttcggatccccatgtatgttgccgaattaattgaattaaatcctctcatgggtttggacccctgcccctggtacataaaccttgggtggtctcgacattaaaaaacattggtaaaaaatgggtgttttttgggcggggggaggaatttggacgcccgtaaacgtggtcttatactactcttgaattataatgattaattaattttgttatttctcatttaatgaattattttaggcttgaattattttaattaactaactcggttcttttttttattactattttgtatctgaagacgaattaatgaattcgatttgatttttgacattcgaagtaaataaaattttttgaaaatgttttaagaaatatacaagaaagttgatttttaaggggtgaatttttcatttttcttacagatttttctcaaaaatgccaaaatatgtgcaaaatatgtgccaaaaccccgaaataagtgcgatatttttatgtgaaaacgccaacttctttctggttaataattttgtgcattgttttggcaggataaaaatcgtaataaagaaatattatttttcaattttaatgcaaaatatttaaattcgaaatgaaacattaacgcaaatttttgataagaaaataaattactcaaaaaacaatcaaaataaaaattttgtgtttgactcaaaaaaccattaaaattggccacattatcaacttgaaaattatttttgacattgtgaatggaatatacatagcatataaaccataatagtagcgtttgtatggttatgatagtttttttgagtaacgcccaaaactcaaaaatttttattttaaaaataaaatattntctatctttactaaaagaatatgacatgctaaatttattttatttttatttttttatatttatgcaatggaaattttgatattca

SEQ ID NO: 44184 - DNA, 1512 bp, Heterodera glycines
aaaaaaatcgatttattcaagtgtccgtttggggtactcaaacatttatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaatccaaaaaaaaattttttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcaggaatacgtatcggaacactacaaatgcttactaattttccta

SEQ ID NO: 44185 - DNA, 1223 bp, Heterodera glycines
agtccgttttcaaaaaaccagcagaagaattagtggcgaaaacggttctttcgcgtactttttgcgttgaaagacggacatccattaggttcgacattttttaattcgttaaagaacaaatcgctcatttcgtcactcgatttccccggcacttcaagtaaaaaatttgttcatcgaagtgaacggacatcggacggcagaaatcgtacaaaacatttccttagagacaaactcctcgaaaccttttccgatttaattgtgtcgccgtacgccggtgacttccgaaggcgggcaactcgaccacaggggactcgacttcgccttcatcgaacaacgacggcgttttgcctctgagcattagcattccttgtctttatcgtgtggtatcttcggaacggtgaccctttaaactcgcaattctatgaaaagtattggatgtttgcttttgctacttgcgcattgaaaccccaaaatgggatgatttgaaaattcaaaaaactatgccgtaaaattcgtggggagcgataactcatcatttttagcatagattttcaacttttctcattaaatgtgccattttacagagatggtcaattcatctactccgttgagttaactctacttgtatgatgaatccggaagtacatggcctcaccaatgctgttttgccgcacttttccgaaaaaaacagctcattttctcggcatcggaattgacaaaagtgtctgaattgttgaaagttagtgaatgaaattggaatgaattaaattttgaatttcgcagacggactgaagaaaagcagtgatgtggcgaaagcagcagcggtggtccagttcaaaaagtgcattttaattcaatattctctttaacacgctttccatttcagactccgtttcattgggtcgaatttgttctcgacaaattctaaaaattggttcctcgttggaatggcaagcagttggaaaaacggcaaattgacccacgtcagtcgcatgttgagaggtacggaatttagaattgaattaggtgtacctttttttcgggggggggggggagctgctctcgggaggaacatatgccctcatttgtttgcccttccgtcatgtaatatttgtcaatcaaaagaacgccctgtttctgtaaagtttttgataatgatgcatgccaatgttcacacagcctagaagacgagtcgacactgtccgtggccggcgtcctgctcg

SEQ ID NO: 44186 - DNA, 913 bp, Heterodera glycines
cactttcctatcatcgctcgagtgcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaactaaatggcgattgcgcaccgcactttcctatcatcggctcgagagcatttgtaacgtataaaatttctcaaaataagagatagtcatttttcttggatataagaataaatttaaaaattctctgagaaattaaatggcgattgcgcaccgccctccctatcacgctcgagcgcttttgtaacgtataaaatttctcaaaataagagaatagtcatttttcttggagataaagataaatttaaaaattctctgtgaaattaaatggcgattgcgcaccgcacttcctatcatggctcgagagcattttgtaacgtataaaatttctcaaaataagagatagtcattttttcttggatataagataaatttaaaaattctctgagaaattaaatggcgattgcgcaccgccctccctctcacgctcgagcgcttttgtaacgtataaaattttctcaaaagaagagatagtcgattttttcttggaatgaagataaatttaaaaatttctctgtgaaattaagatggcgattgcgcaccgcccttcctatcgtgctcgagagccgtttgtaacgtataaaattttctcaaaatagaagaagaatagtcattttttcttggatgagaaggataaatttaaaaatttctctgagaagattaagatggcgattgcgccacccgc

SEQ ID NO: 44187 - DNA, 1041 bp, Heterodera glycines
aaaaaaatgagaaaaaaaagataaccattttttgttcaggaatttttttgtttgcgtttcaaatttcgtaagattgtttgatagggccagccaagagaaggcaactgtgggttccaagttttcggtaaaaaaatgagaaaaaagagagccattttttggtcaagaattttttttgtttgcgtttcaaatatcgtaagattgtttgatagggccagacaagagaaggcaactgttggtaccaattttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaaaagaaggcaactgttggtaccaagtttgcggtaaaaaaatgagaaaaaagagataacaatttttggagaatttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagacaaaagagatagccattttttggtcaagaattttttttgtttgcgtttcaaatatcgaaaaattgtttgatagggccagaacagaaaaaggcaactgttggtaccaattttgcgtttaaaaaatgagaaaaaaagagatagcccttttt

SEQ ID NO: 44188 - DNA, 1160 bp, Heterodera glycines
gaatatagacgtaaatataaaaaattattatttataatattaaatactttaaaaattaacaaattaaattaataaacaaattaaactcgccttttttccgtctccgtcgcccaccaaaaagtgcacatccgcgtattctcccgtgctcagcatcaactttaggaaagcaatcgccgctttggacatgataatttcaataaaaattttagtcctttaccaatggcaactaaaaaataaatattaaaaggttttagagcttatagactctgattaaaagtgatgaaaaatgaggggccaggccgttttcgtacgaacacatgtttttggactataacttttttctttgccaaccaaatccaacattgttggtatcattcgaaagctctttagatgctctattagcctgcaaaattccaaaaaatttcgtcaagttcaaaaaaagttcgagccaaaaaagttggaaaatttggttttttgaactcttctgaccgtaacttttttgaaccttaacgaaatttttccaaattttaaccaaaaaattgggctcgtacgaaaacgaccccgacccgaaaaatgaacattgggcaaatttatttagaagggcaacaaaataaataatgttgcggcaaaatattgacctaaaaatgaacataaagcagagaaatttgcaaataatgtaaacttttgtttcagggaatttcgaaaagcaaaataaaatcaaaaaacgacattaaaagcactgaaaagacgagaatacgagactttttcgtgaaaattggagtcgggagttgcgccagaaacgggttaactgcgtcccaaaatacataaaggaataaatgcttcccaaaattattattttttgaaaattaattcaaaaatatttaaaaaatcaaggtaacacgataatcagattgaatagtgaataatagggggaaacattcaataaacatgcctaaccgagaccatccaaatatgtcatacttttttgttttattttatcatcaataaaaaaaagtaatcagaagggcgaaaacaatttactctgacgactgtttagaataaatatgtcgtagagagtaagtgacaaaatatatgtatggatgctcaagaaaattgagattcatgttaacctagctttggatgattaacaaaaacccata

SEQ ID NO: 44189 - DNA, 758 bp, Heterodera glycines
ccccccccccaatttttccaaaaaattttttttttgaaaaaaccagcgcccacaaaaaaaaccgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgccaactctcgtgtttttggggactctcgcctctcgccaaactctcgctctcgtctttttggggactttcgcctctcgccaaactctcgctctcgtgtttttggggactctcgcctctcgccaaactctcgctctcgtctttttggggactttcgcctctcgccaaactctcgctctcgtctttttggggactttcgcctctcgccaaactctcgctctcgtcttttctgagacaagacacacccctg

SEQ ID NO: 44190 - DNA, 1188 bp, Heterodera glycines
  misc_feature (117)..(117): n is a, c, g, or t
  misc_feature (1125)..(1125): n is a, c, g, or t
ttttaaattttatcttatattcaagaaaaatgtctatctcttattttgagaaattttatacgttacaaatgctctcgagcatgataggaagtgcggtgcgcaatcgccatttaattncacagagaatttttaaatttatcttatatccaagaaaaatgactatctcttattttgagaaattttatacgttacaaatgctttcgagcatgataggaagtgcggtgcgcaatcgccatttaatttcacagagaatttttaaatttatcttatatccaagaaaaatgactatctcttattttgagaaattttatacgttacaaaagctctcgagcgtgagaggaagtgcggtgcgcaatcgccatttaatttctcagagaatttttaaatttatcttatatccaagaaaaatgactaactcttattttgagaaattttatacgttacaaatgctctcgagcatgataggaagtgcggtgcgcaatcgccatttaatttctcagagaatttttaaatttatcttatatccaagaaaaatgtctatctcttattttgagaaattttatacgttacaaaagcgctcgagcatgagaggaagggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcatgagaggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaattnctcagagaatttttaattttatctatatccaagaaaatgactatctctttatttgagaaattt

SEQ ID NO: 44191 - DNA, 1279 bp, Heterodera glycines
  misc_feature (1250)..(1250): n is a, c, g, or t
agccaattccacgcgctgtgagtcatttcaccatcattccgcacgaaatcggtgaacttaacgcgtgacggtaacgagaaatgggaatgggcactaacatgctctttgacgccggcaacgattccgtgggtcgtcgaaacgcaacggaccaaaacggcaccgacgacgagttgggggaagctcatctcgagcaacggaacgaatcagtgaccaaagcgggagctaatgaatgagacgcgttaccgcaaaacgacaaacgatgtcggcacccgcgccctccccaatcggcaatgcatttgctcagattgaactgctccatcacttgtgaaagtccgtcccccaattgttccatgggaggggaagcttaaaagcagtagtcggcaaataacaaataatgcctttagcattttcaatttttaaacgcactctccgacaaaattttcagcgccgggcgcttgccctggcacagaaacgtggaggaaaacggcacgctgaccgaccagcggagagagcgtcggactgttggcaaggtccacgcaagacaaatacgtcttgccaacgtcatgaacggtgaggaaaacctttgggtgggggacgagatggaagcaatgagtctcaattgagtgattctcgagacaaatgaattgatggcacgaaaagtgccatgagaactgccataactcacaactttgtcgtccaaatgctctaagtttccctgaacgtacacatccaaagtgcacttgcgcgtccctttgaattcgtcagtgaaaattgggtaagagccgacgtcggcaaacggagcgacgatcggattataaaggcattgcttccactgaattaagtcacctaattaggtaattaagccaatatcagttgggaagcaggtggctttaaaagtttaaaccgccaaaagtaacattaaatcaaattttgaaggatatctgttaaaattgcaaacgaattttcacaattttccccttggactaaaagctttatcacctgggctgatcatttattaacaccttacttgaatttccacttgtacgcgttgcaaattgtcttcaaaattcaaatttgacattttgcggaaacgcaatgtaaatgagaaaagaaagaaaagaaaaatggcgaatcgaattggggggatgtttggtattttgtttgtttacataagaagaagaagtagtcaagaatcttgagggggaagagaccgagaatggaattgtttaccacaattttgacctgattanagtccataacaaagagataggaaggaacg

SEQ ID NO: 44192 - DNA, 960 bp, Heterodera glycines
caatataagcctgtttcgtgaatatttacaacaaaatttttttgaccatttctaaaagggaaggaaaacaaattttttggtctcatgttttatgtcatgttgttgaatggcttagactgcttctgatgcggttgaaaaagtttttggcttttcgcgaaaagttttctcagaaaattcagggacaaaaaaattttatggaaaaaagtagagtaacaaaagcctgtttcgtgaataattacagcaaaaatttatagacaatttctaaaagggaaggaaaacaaattttttggtctcatgttttatgtcatgttgttgaatggcttagactgcttctgatgcggttgaaaaagtttttggcttttcgcgaaaagttttcccagaaggcctaatataagttttatataacgtaatccaaatcttagacgatttggatttaattattctaaacaaggaacgcatacgtaaatacgcattccttgttatttggttaacatgaccggaaaattggaatttgttatcaatgtttattcctaaatccctaattgtatccacagcatttattgtatttccatcaaatttgtatgtttcttttgggttttttgaacccaaatataatacaaaagttttttgaattgaaacttttatttgccatttatttgcccattcgaataagttatgcaatgctttatgcataatttctgtgtcagatcttgctttatagcatatatatattttaacatcatcagcatataattttattttcactcctgatggcaaagcatcaggaagatcgttaatataaatcaaaaatagtaaagggccaggacagagccctgggggacgccagaagtaacttttttacttgaggataaggaatccccaattttaactcgaaaagtcctattactcaaaaagccctttatcccccataaaaattttgcccctttataccaatttttt

SEQ ID NO: 44193 - DNA, 1058 bp, Heterodera glycines
ttttcaaaacgttaaaaaatgcagagaacgccaaatttattaaaattagggggataaatgtcctaaattcttggaaaatagcaaattagcgggtccgcatagtaaaagcctcccatcgtcgtgagcgtaacactgacccccacatgacgcgctgcttctccgtctgttggtggagccaactcggccatttgtattcgatcagctgatagtcaaagccgtaatgagaagccatcacgggaagggattcctaaacaatcaaaaaaatgagggtagaaaatatcaacaaaaatttaaaaaatgaacaatataggctccgatcgattcatggaaacaatgtttttcgatgaagattttcgggtagggtcgagaggaattccagtcagaatttgaaacgttgtaaaattgaaaaaattgggtttttattcctttgaaaatgttattctccaaaaattattccggcaatttcgctggggaattagaaccacaatttagtatgaagaaaagtcatggaaagtctttaacgcttaaatggaatgaaagtttgtcaaatttgcggagcgtgactcattaggaaaaaataataattaatgtttcagctggatcaccctgaattggggcgacaggtaattgttgagcagccagaatttgaccgggtgtttggtgttcttcagcacggacagcatcatgatgcgcaggaagcgctcgtagagatggccggaggccagcgagaagatgttaatccgatcgtacgattgaccggtgcccatcaatttgctaaaaatgggagtcgaaagtgatggctatttgtttaaaaaatggttttaaaagatggcgttcaacagggttgattttttgtgatttatccattagaaaatgcaaatatctttggattcccaggcgtaatgaaaaataaaaatttttcagaaaaatttgagtattatttttaaattttactcaatttacttaacgaatttggcccaccaccccgatggtgccaacgacaccacaggatcccaatttcaaaattttgtcttaaaatggtaaaaatttggctaaaa

SEQ ID NO: 44194 - DNA, 1299 bp, Heterodera glycines
atcgtaggaaaaaaactcttctttttcgtattcgcgaacaaaatgtcgggacttttctcttacatcatttttttaaatctcttcggggtttttctcacttcattctatatcgtacatatttttatacatattccggactttttcgcattttttcgtacatatttcgcaatttttcgaggattttttaaggaaattttcagaaacacgcccccaaaaaacccaaaattacacatcgtacatattttcatttttttacacatttttaggatttttcgagaaattatagaaaatttcatatgaaagatttaaaaatttttcgaaaacgctcctaaaaattattttaaaaaaagagatagcaaaacttcgatttttaaatagtaaaagacgcttctaagcctctttaggtcatttttatagctttttcgggcctcttttcactcctttcacgaggaaatttttcctaaaaaataaccattttaaaaaattttattacatcttttagtacatctttagggtttttgtacacttttagcattttttctacatctttcatttatgaatttaatattttaagaatgtttattcaaattttaaagacatgatagttttttataataatcatttgattgatatagtttttaatataattttatttaatttagcttttttatttcatgttgttttctttattttaataattaaacatttgttataaatatttttgctcgtattagttgtaattagagtccggtaaaaaaaaaatttccgggagcgggagcgggatcgggagttcaaaattttccgggagcgggatcgggaatcccgtgaaaatcccgctcccgttaaaaatcccgttcaccgaaaaaagcgggagtcgggagcgggaatcccgtaaaatcccgcgggagtcccgatcccgccggactctagttgtaataacaaatttaaatcgttcatttcacccttttcaatcatgttctcgtaatcgaatactcggatcatcagtttaaatttaattaaaatttaaattaatttgctttttcataaatattaaatttttatgtatgtaaaagactacttgatagtatttatattaatttatttttaatttactaatttactttttaaattttgtttgaaataataatcttcattccctttgttcagcaatgaattttacagatctataattaatttacttgttatttataaattctcatgttcgattctccttttgcctagttccgcatttccaagaacaattttcttagtgcgattgcaaaaataaatcaacatgag

SEQ ID NO: 44195 - DNA, 1206 bp, Heterodera glycines
tacaacagtgatgagaagaggtacaaaagtgattaaaagaggtacaatagtgattaaaagaggaagaacagtgattagaagaggtacaactgtgattgattagaagaggtacaactgtgattagaagagacaacagtgattagatgagtccaacagtgatcagaagaggtacaacaaggtttaaaattaaataaataatgaaaagtttttataaaaatcgaatgcattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaattttaaaaaatttttcacaaaaaaataatttaatttaaattaaaaaattaattaaaaaaaacaaacactcttttaaatgaattaaaaacattaaaaataaccaaaaatgcatagcaaaaagaatgtacaccgcccggattcgaacttcccccccccctcaaaatgatgcctcagaatccccaatcacacagggattctgaggtcttaacgatgtcaaaagtaaaatctgattacttattcgtgatcagcgtcccaaataacccataaagacatgtttttggaagatttttattgaaaaaaatttttcactcaaaaatcctgtccaccccctttggtcccgaatcacaaaatcacttttatttttataacaattcgcaaaaaagagataaaaatataaaataaaatttatattatagagaaaaaaattgcggatttttgtagtattttacttttacagaatgacttttcagaagggagttctgattttttttctgaaaaatctaaaatttccagaatttctggaataactttttttctttagaagatagaaattccaaataaatcccataaaattctcccgattttttgctatttttaaagctttatttgctcaaaattggtcaacccttaggctagatatgaatttttcaatattcgcccaaaatcccgtgggccaaaaaattggaaaatattttcgaatttttaaaaaattccaaaaattttgaaacgaaaaataaacatcatatgcgtgctcagcacatcaaaataccccagaaaaatcgagtgacccccattttcaacccaaaaaaaattttcgaaaattt

SEQ ID NO: 44196 - DNA, 964 bp, Heterodera glycines
aaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaaacgaa

SEQ ID NO: 44197 - DNA, 786 bp, Heterodera glycines
  misc_feature (727)..(727): n is a, c, g, or t
  misc_feature (741)..(741): n is a, c, g, or t
  misc_feature (745)..(745): n is a, c, g, or t
atgaaaaacattacttcatgaaaaatcatagacattacataaaatcatagattaaatgatgtcatatgataaatctgatgtcagattcgtgatcagcgccctagataaccccctagtagttctcagaatcgcaaaaaacgacccttttttccctttttttatgggaccaatgatgtgaacgattaccgaaaaaacttaccaattcatcgtacatttcaaaaaaaacgctgaaaaattttttcaaaatttttcttgaaaattttctaagtttaatttttttttccggcgacgaaattttgtcctgttcccgtgtaaaaataattcattcacccaattcaaattgtatttaattccgttttattataaaataatcactcaataaaatatttctaaaatttagaaaatatattatttaattgctaatatttattcaaatacctattcacaatgtttcttctaattgtcatttttactttgcttttctctgctttcattttttggctttttactgccctctcaaattatcggcgacatttgaaagtgtccgacaatatgatttgatttaggaaatattggaaaattcgatggaactgacaaagggcaatgattacaacttgttcaagcagtggctgggcgagggtttgctgctgagcaccgatgcaaaatggaaaagacagcgacgcattctgacgccaacttttcactttgctaaagtgaagcagtacancgacattttcacgncaangcacgtgaatttgtgcaaaggtcacaaaaaagcgctttttg

SEQ ID NO: 44198 - DNA, 1136 bp, Heterodera glycines
aaattctctacaaaaatgttctaaggcactttttggcttttaccaactcctgacgagttatgggcccgggactcaaatgtcccgctcaggccaaaatttttttctatttccgggaaaaaatcgaaattttcctgaaaaaaataccagtcgatagagctcaaaaaactatgttttggaagtggtctccgtttttctgggaaaattcgttaaaaaatcctaaaattcaaaaaccaaaaaaccgttttttaggcctagctcgaaaaattttgaaaattttagaaattttaaaatctggaaaaatcgagctcaccgagctctacaataagtctgctggcaaccctgcgctcagctcaaggcctaatgagttattcaacggggactgaactgggcaaagttggtactgaaaagttgccaatttctgcagcccttccaagtataggtagaggcctggaattttttttgaaaattagaaaacacttcaacttagtttcctaccagcaagcattttttgatcagagttttagaaaaaaagttacgggccttcaaacgcaagcaaaagtgagaaattagccgccgggactcagttggccaccggagcggaatgccgatagttttcctgaatgcgcctcaaaaagttgtaagacccttccaccactttcagacccctcccgacagccgttcgactcaaattagtttttaagacgaaaccccctttttctctatatatatataaactagcggggtgtgcttacgtgtttctggggtgcttaaagcgcttcgcgctttcggagcttcgctacctagattagctctggttgtggagatttggaatttttaaaaaattatctgggacttttaggccgcttcgcgccctcgatcggacgctttgcgcccgttttttaaattttgttggcctcatacgggcgcttcgcgcccgtttctaaatttgttgggctattaaggcagcttcgaggcctcagacgggcgcttcgcgcccgtttctaaatttgttgggctattaaggccgcttcgcggcctcagacgggcgcttcgcgcccgtttctaaatttgttgggctattaaggcagcttcgaggcctcagacgggcgcttcgcgcccgtttctaaatttgttgg

SEQ ID NO: 44199 - DNA, 1115 bp, Heterodera glycines
aaagggttaaagtatgcgcataaaggccttaattaaacacttgaacatattcacatattttgtgtaattctatctcggactccctcctgctcaaaataatgagtttaatgcaaaatagatttgactagcggatactacgaagatagtttaaaattttcatctcttaattattttcatttaaaagtagttatactttttctgtctgcagctgtttgactttgaatactgcggagtaaaaaaaggaatttttcttttcactaattcaagacaatttttgtcctttcttgattagctaataattttgaaaattactcaccaattaaaatatacttgcatttttcaaaagaggtattcataattttaaaataagcacatatttatagtgagactgttttcaactcgcttctattattaaagggttaaaggatgcgcataaaggccttaattaaacacaagaacatattcacatattttgtgtaattctatatcggactccctcctgctcaaaataatgagtttaatgcaaaaaagatttgagtagcagatactacgaagatattttaaaattttcatctcttaaaattattttcatttaaaagtagttatactttttctgtctgcagctgtttgactttgaatactgctgagtaaaaataggaattttttcttttcactaatagaggacaatttttggcctttcttgattagctaataattttgaaaattactcaccaattaaaatatacttgcatttttcaaaagaggtattcataattttaaaataatcacatatttatagtgagactgttttcaactcgcttctattattaaagggttaaagtatgcgcataaaggccttaattaaacacaagaacatattcacatattttgtgtaattctatctcggactccctcctgctcaaaataatgagtttaatgcaaaatagatttgactagcggatactacgaagatagtttaaaattttcatctcttaattattttcatttaaaagtagttatactttttctgtctgcagctgtttgactttgatactgcggagtaaaaaaaagatttttcttttcactaattcagacaatttttgtcttttcttgat

SEQ ID NO: 44200 - DNA, 1417 bp, Heterodera glycines
  misc_feature (1267)..(1267): n is a, c, g, or t
  misc_feature (1300)..(1300): n is a, c, g, or t
  misc_feature (1360)..(1360): n is a, c, g, or t
  misc_feature (1368)..(1368): n is a, c, g, or t
atggccatgccaaattcgctgacaatttcactgccctgcgaatgggatgaactgtaggccaagtcgaccagtgccaagtacagctgcacattgtcctggaaacgaatccaaaaaatatattaaaaacattgggccgattgtgcgttatccgaaggatttatccgaaaatcggccaattttaggggattttttcagtaaactttaatgagcgatgggaagccgacgccaaattttgttaatgctcgtacaattcttgcctctccccttttaaatcatgattaaatttcgagaaaaatattttttagtgttatgaaaaatttcatggcattcaacttttgtgatttcttaaaaattcccgaataaaaactggcgggaacctttaaaaatatttcttcaaaatacattcctgagaatgggcttttttcgagaatagctgctgctggtgctgcttatggcttcttttttccaccatttgccttttcctaatggtttattttatccgcaccattcatgaggcatatcctatcacttgctgattgttgttactgctggcattggtctactgatttctctcattgttgttatcacctcgccattttcaggctttacgaaaaattaaactaaaaatacacacctaagatatgacccgaaaattttcagaaattacattacaaataaatgaaaaactttcaaaattcatcccctaacatttattctattttatttgtttatttatgttttttctgacttttcgcgatttttatgagaatatttgttgttgcaattttgtggaaataaaataatgaattaattacatgaaatgtgtgaattcaattctttttttgcaatgggactccaaatctgtgcgttttgaacaaacaaaatgttattcacctgaaagggcaaaagagacgagcagcggctcaactgaacaaataaaatttacttcccgaatcgaccatttaaaatgaattaactaacaaaaatattcaatgagaatcattggcattgcttaaaaagaaaatggagggcagagaaggtcaaaaaccagggaaaacagtacataggaaaggaaagggaaaattgaaaagacgtgataaagtggagggggaacagagtggtcaaagatcactaagagtggtcagtcaacagagaagacagtgaaaattgagaaatagttgtacaatttgtacaattccctgaccctcctccaccaatttataaaacatacaaaaattgcaaattctcaccgcatatgaaaaccccngttttaccacagttctttggctctgcccatcantggataagatcattcaatggatcccgtccgtgattatcgcaatttttgacagagctaagnaaatgtgncgtgaggcgtcgcgccaggccaggtaccgagaatcggtccctgcgctga

SEQ ID NO: 44201 - DNA, 846 bp, Heterodera glycines
agggtgtgcgtgcctgggagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaaatatagacgcgcacgaatggatcaacgagattcccactgtccttatgtgctatctagcaaatcctctgacaaaggaacgtgcttgacaaatttatcgggtaatgaagaacccgggggcgaaggcccaccacgaggccgcgaagagaaaagagtgagtaccttcggtgcaggaaaattattaaattttaaaaattttttaattgctttttaaatatgccaaaaaaaatgtag

SEQ ID NO: 44202 - DNA, 1380 bp, Heterodera glycines
  misc_feature (1347)..(1347): n is a, c, g, or t
atcggctgtccgccttggtgatgtgttgtttcgcccgttgcaccgcgatggtccgatcggcgtttttgcactgcctcgggcgtccttcacgcggagaaggcgccacatccgctttttatcgctttccttcccctcattcacgtgctcgcctgctgccgtccctcccttcgccccctttttgtcctcccttcccttcatcatttcccgtttgccctatttttcccatctttccatccatttatcactccttgttcgcaacttcattcactcctccccgtcctcctcatttgtccgctcaacggacattcgcggctgtcgttcagccgcgacataatttatacaaaatttgagcataactctattttaatgtacataaaaaaagttaataattttaaaaatgaataacagttataaaagtaaaaataaaattgctaaattggataaacaacctgtaactaatctgtgttctttgccgatgcatacaacaagggaatattaatgaaaaaataaaaagaaaatataaacatttattcaaaattaagaaatttaataaataaaaattcaacattaataattatatatttttatattgaaaaaatgattaatgatttttttccattttttaagtttttgtattttttaaatctaattttttgcattttttccatatgaattgccgcaataaattgacgaatatcgctgaacgttttgcgttttgcatactcctcatttaataaatgagaaaattgaattattgttatggaatcataattttagtatactttattagtgaatttaatggctaattatttaataatatttatttaattttataattaattgagtaaattatgtctgattaatgcttattttctatttattttcacaataggtaaagaaattttttaaatcaaacatatcatatattattattcaaagttaaataatatacaatggcaaaaatgtatgaaaatacaaaagaaaacgcaaagagtgaaaagtcaaaaatggaaaaagcaattgaaaatgcgccaaataaaaatgaattgattactttatttttttttaaaagagcgactctaaaaaacatttattgttatttatcatggagaaataaatatttttcatttaaatatctaaatattaaaaaaaatatgaattaaattattttataatcaaatactgagaattcaaaataaataaaataataaattatcttaaaagtctaaatggaaatgaagaagttaacattaattaatcagaacacaaactcaaaaacacaacaattgcataacgagaaatttttattaatgaaatctgtgcaaataaaataacaattcattgaanaacatatttatacaaatactaaaaataaaataa

SEQ ID NO: 44203 - DNA, 1578 bp, Heterodera glycines
  misc_feature (939)..(939): n is a, c, g, or t
  misc_feature (1571)..(1571): n is a, c, g, or t
gaggccgatgagcaaaaaaggctgtaactcgggggtaagggctcgctcatatctcaccctcgacaactttttaaaaattttcaaccttagaaaatttcaaaaaaattcaaaaaaagatgaaaaatttttagggaatgtttggtacacccacgcccttgcggttatactataataattacttcggacgtgacgaaatcgtcaatgtgaaaaagatttgatccggcatgaaaaatgtgaaagaatttgcgcgtgtaatccttctcaaccacttgcgagaccaaacggacagtcacggaacatgggcatgaccaggtcgagtaatccctttccgaatgcatcggtgtgctgctgaccaacacctcgtcatttgggttcttatgataacgagcggtgaggaatttttagtgacacaaaatctcaaaataattgtctaaatagcgccaaaaaatgccaaaatagtatctaaaataatgacaaaaagttccgaaataatgatgaaaagtgacaaaattttcagccaaaaattgagcaaaaattctttatccactggttgctaatgagattatccttcctttaacattttttaaaccaaaaattaaagaatgctttttgtgtcatcaaaataatgcagcagaaaaaatagttaaaaaattaaaaatcctcgccctaataataactagagtaggctgggtccaggtatttgggcaaaaaacgggtccgggtccgggtagtgaaaaaaccgggtatccgggtctgggacccggtcgggtacccggaacccgcgccctttccccctaatttattgtggaatttaaaaatgacaaaattaatatttcattagtcaaaaaattctgaaaaactaggttagtatgcttttgatgctgatcaaatctttacaccaactagatcagatccctggtgatctgggcacccaaaacnccactgaaaacgtggaaatttttgaaaaaaattcgtaaagggttggaaaatttttccggaaaaaattatcaggctcattgttaagaacacaaaatactataaaaaaagtccgcaaaattgttttaattgaaattaaatattaattaaaaatcgaactgatggctggaaaagccgggaatttcccggtcccggtcaaaactggtcaaaaccgggaccttggtactcagttgtccgtgttttggtcccggtcccgtcctaccctagtataaaatattgggaatttcttttttaccaatagtgttgttattgcagtagaatgcgtttttctttatttgcattttatctgtttgggattattactttttgctaaattgccttttcaattactttttgttagtaaaatgcgagaacaacttaattaaaatgagcctcatgaaaaataatttaagataattgtcgttattttttttatctctagttcatattaataattgtaaattaataataaataaattatttttaattttatttcacaaaatagtttaaaataattttctattaaccattttgatgcttaatgatttgttcttttaaagaataataattcaaaattttcttttaatgtttttcanatttaaa

SEQ ID NO: 44204 - DNA, 1273 bp, Heterodera glycines
aggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaacaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaaaattttcagaattctgagtctcctattattttatttttttttcaaaatttgaagggaggcggggggggaaagtataatttaaatagtataccaatgctcgtgcaaaatattatttcgattatattttgttgaaatattcaaaaaatacaaatatagaaaaaaaaaataaaattgaaaaaccaaaaatttaaggataacctatcgactatttgaattaaaaaaacaaaaaaaaatatgttaatttaatatttggctatattaaaatatttattaaatgttaaaaaaaatcttaagataatttttcattcataaaatttttttgaatataaaaataactaattcatcaattcagatatctttacgggttagtccaagttatcatatttatctacttttctaatttttattattaatttttttttgggtttttggcccaaaatctaactataaaataatttaatctttttttcatttttattcaaaaattaatgaatttttaaatattataaaaataaaagaaatgccttcagagtgtttgcctgtgcttcaatcagttgttcattgcctttcaattcgaccattaaacgatgttttgttatatccaaaaaatccaacattttcttatcaattcgctccgatacaaattccaac

SEQ ID NO: 44205 - DNA, 1057 bp, Heterodera glycines
  misc_feature (6)..(6): n is a, c, g, or t
atatantttccgcatcccaaacatgggatggaaaataggcaccttctcgacaaatattttcaagttttgccatgctatttatctttcgggactcaatttatgacgaaaatatcgggctccaattattttttattttctactaacacttttctagtggatcaatttatagattcaggaaattcatcgcatgaattgaaaagtatttatttttattaaaatttgctcgcttattttccgtaagaaagtttttgggaggaatttcacaaccttgccataggaaaaactcatatctgactcgtataaaacataactcgaacagtaggtatatttgttgtgcaattttatagtccagccatcgctagggctctcaccgcggtgtattttaggtgtgtctttgatgtatcaaaatttctctcggccgcgttgttgactgaaaaataaaaagaacttaaattattgcaatattgtttatacgaagtcttttaatattattctgacgacttccatgataataaatacttatacaaagtttatctttttatatatttccgcatcccaaacatggatggaaaataggcaataaatcgacaaatattttcaagttttgccatgctatttatctttcgggactcaatttatgacgaaaatatgggctccaattattttttattttctactaacgcttttctagtggatcaatttatagattcaagaaattccttgcatgaattgaaaagtatttatttttattaaaatttgctgcttattttccgtaagaaagtttttgggaggaatttgacaaccttgccatagaaaaaactcatatctgactcgtaaaaacataatccaaacatggatggaaaataggcaataaatcgacaaatattttcaagttttgccatgctatttatctttcgggactcaatttatgacgaaaatatgggctccaattattttttattttctactaacacttttctagtggatcaatttatagattcaggaaattcattgcgtgaattgaaaagtatttatttttattaaaatttgctgctta

SEQ ID NO: 44206 - DNA, 1041 bp, Heterodera glycines
  misc_feature (27)..(27): n is a, c, g, or t
  misc_feature (941)..(941): n is a, c, g, or t
  misc_feature (949)..(949): n is a, c, g, or t
  misc_feature (980)..(980): n is a, c, g, or t
aattacgctcaaaaagcttttcaaacnaatttagcgcttccaattccttctacaatcgcctttatacatcccattatgagcgctaaaattatcagagtgccgaaaatcgcatgtgatctacgcctagcaaaaaatggtgtaagtaaaaatcgtaattacgctcaaaaagctcctcaaacaattttagcgcttccaattacttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacattccattatgagcgctaaaattatcagagtgccgaaaaccgcatgtgatctaagcctagcaaaaaatggtgtaagtaaaaatcgtaattacgcttaaaaagcttctcaaacaattttagcgcttccaattccttctacaaacgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttttcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcnaacaattntagcgcatccaattcctttctacatcgcctntatacatcccattatgagcgctaaaattatcagagtgcccgaaatcgcatgtgatctaagc

SEQ ID NO: 44207 - DNA, 909 bp, Heterodera glycines
gtgattaataataaaatagtaaaaaatgatttcttaaaaaaagacttttggaatttctgctaaaatcttcccccatttcggttcattcgttgctgggacacattaaaatagaaattcataatttttgttaatttattttgaataaatttgttaacgaaattttactcaaccataatttttcggaaaactaatcgttttattgagaataagcttgaattatgttcggtattataggtttttggatataaaataattttggtatttttcaaaaatttggcttcgaattcgtctgtaaaaaatccctctaaatgtgtgccttcaaaatcgaaagtgttgctcgagtctctgaaaattggttggaactcgagaatcggcaccgtactttgaccaccaaatgtgcccctttgaacctctaattttgagttgctaatgagctgtttttgttgccaaagacaacatggaaaatatttttaattaaattgttaagaaatgattaattgtaagaatttgaaaaatttggacaaataaaaatattgcaaaaaaaaaaaaggaaattgtacctgaaaagtgtatatgtagtcaagcatttttaacaattatgatttttggtacatatttatttcaattagccttttcactcctgcgccgtggttgggaaaagtctgagccgcgatttccgaaggaacagacagaagtctccggaaaaaattaattgaaatgaggagaattttgggtgccgataggcgccgcggaaaatttcactttccatgtttttcaagattttagctgagattttcacgaaataagaaccatttaaatgtattttgtggaaaataattaattagcaaaatgaacaaaaatgtcgggtcggactctcaactttatatgtggctatatgccgagtgttgc

SEQ ID NO: 44208 - DNA, 958 bp, Heterodera glycines
ttgttaatgctaatgcttacacacctggagtaggcgaatctccttgcaccgacgtaattttattaaataaataagtaaattctcttaggctagaacaaaaaggatttttactttggcactttttttgggaaagataattaattcaatattttctttctcgttttcccgtgaattcagcaaattttaatctcataaaaattcaaacacctaaaaatagcaagattttacggttttgagccaatgctttgagaaaatgcgggttttgaaggcaccgccgatgaaaaaagaaataactcaatttcataaaattatttaatttttgtataaaattgccgaaatatggttttgttgaaatatttaaatttttgactttacgaaatcgcctctctcttattccatcgtcttttttctcaatagcctctgacgctgttctaccaaaaatgggcgggagagccatcgaaaaactgtacgttgccgaacactgaggaaaactcgacaacgccggaaccaacgcctgaaccaacgccggaaccaacgcctgaaccaacgctggaactaacgccggaatcaaaaccagagccggaaccaacgccgcaaaccaagaagccaatgacggctcaaatgttaaacgggttgctttacgtgagcgtggtcgtcgctttccgattgttcttgcgacttttgtgcccacgaattcggtcatggtgagaatgacaacagtttctttccccacgcttatcaattccgcttggcttataactcatcctgtcgaaggttactaaaataaaaacaacaattttgcctaaataattatacataatccaattattctgacaaaataggcaaatggcgccgggacataacttcgccgcaaaactttttttcaaatttcaagaaaatttcgactttatcttttttgaaaacctaacaagagaacattcccagccgtatgtcagaa

SEQ ID NO: 44209 - DNA, 1686 bp, Heterodera glycines
  misc_feature (608)..(608): n is a, c, g, or t
gaccatgtacagcatgggtgggagtaccgcccgaaaagcattggtttactaaaaaaaaagattaaaacgtgaaacgaaaaaacggtctcagatatccggccgttttctcagagccgaaccggtcgcgaaattgagaaaattaaaaaaaaaggaaatttcagtttttaaaatttacgaaatccaattttgtaaacaattacgaaataggaaaagtgaatgaattttgtaagtgctttttcgtttaacgctgaaaattttacaaaattggctcggacccctgtataatcaaaacccaccggttgctgttggtgctgttgcgtgccgaccacaacactgcctccacaggtgctgcttgccatcatcgtcattttggccattgtcgccgggccgccgttgttcgggaaaaacgccgccggcacatgggcaggcgaaatttgggcggacgttggcgcactgctcgtcaccgctgctgaagttggcgaagcatttgcggaaatgatgccggcaccggcagtggttgtggacgtctgttgtgccatcgcttggtgatgctgggccgacggtaacatgacggcgtacggagagacggctaaaaatggggggggggngaaggaggatgaaaatccattgaacccgtacataaattcggattcggcacggttttagggagtcttaatggtcccgaatggtccagctatcgaacaagacgcgaaaaaccaaaatattcgggattttcgaacccgaaatttcgcgctcccaagccctggtggtccccaaggccaattgaatctggcgccctcctacatttcttggcataatttaccataggcaaaaagtgttgttggccatcgacgttccgccgaccatgtgcccatccatcatggccatcattgtgtgaattgcggggtcacttcgtgctcttaaaaaaatcgtagaaaatttacaaaattcacacaggcaaaatgcatttaatttccttagatttttcaaaatcttacacaaaaacactgaaaactggttattttggatacaaaaaactatcaacaatagccataaaatgctattttggcttctaacgacgtcttattttgcgtttggaatgaaaggtgtccgatttcgccaaaaatgttttttggaaccgtgacaattttcttcccgagtaaatgccaatttgcgccctccaaaatgccaatttgtgccctccaaaatgccaatttgtgccctcttctggcgcccactttggccatgccgcgtccggcagttggagatgcgccgccgctgccgccatgccaccgccgccgtgcgacatgcgctggtggtggtaacgctgctgcagcgattgttgttgctgttgctgctgtagctgttgctggtggttgtgttgttgttgttcgtgcctcgtcgccacgcccgggccaccgttggcgccgccgccaatggtcgccgcgttgggcgacccgccgccgttgcgacagtacgggtggaaatggtgcggcgacgcgccgggcgaccgcgtccgggccatcatttgctaaacataaaaatgaattggatttgaagaaagcaatttttcggcacaattttctgatttatggccaaccaaaattgcaattcattatcgataataaaatagaaattttaaaaaaaagataaattttttgggtattaaaaaaccatgttacactc

SEQ ID NO: 44210 - DNA, 971 bp, Heterodera glycines
  misc_feature (10)..(10): n is a, c, g, or t
cacaaaattntcggttaaatatcaaatttaatcaattgacagaattgctagagaccaaccaacccctttcgataaataaatataatgaactttttgagcaatatattttataaattttataattcttagagtattaacggtttttgacaattaaaaaatgaaatggaacttttgagtgccagcggtgccggtaggcgccgccgggaaaatttttttaaatttgagtgtaatttgttaacagatttacaccaaaaaatgaccaaattttgcaactttgagctacttttttaaataaaataaatttttagggtccggtggtgtcgatgggcgccgccggtgaaaaactttaaatttttagtcattttgttaacagatttaatccaaaaataaaaacatttttcgatttgaattgttaaatttatattgaatttccgtcgaaaataggaataactttgaaaaattgaagaaaaacaactactttgatgagaactgatccaaaggaaacataatgaaaaatgccaagagcactcactaccaatcgaccatgcatgcgaataaacaaaagaaagcaaaaagttaatatatatatatatataattactcccgcggaatctcgtcccgcataaaaattgagttccaatcccgcagcgagacccgcaaattttcaattttttgtgcgccgcgcattgcatttttttgtcaaacgtaatcccaaaatattttctattactaaatttaaataaattgatattaaattgagcaaacgacaacaacaatgaacgttatgaagactggagaagaacatgacatcaccaatttcaaacttgggaaaactcaaaaggtatgcatttgtctttggtccgaagggaaaaacttgttaaaaaataaagtcaaccttttaattaagtcttccggtatgggattgaaaaaatctgtggactgccacgctgacagtcattgcttgatggcgt

SEQ ID NO: 44211 - DNA, 650 bp, Heterodera glycines
caccaacatttcaatctacgggactcaatccaccagcatttcaatcattgggactcaatccaccaacatttcaatcaatgggactcaacccaccagcatttcaatcatcgggactcaatccgccagcattcaatcaatgggactcaattctccagcatttcaattactgggactcaattctcctgcatttcaatcacggggactcaaccctcaagcatttcaatcgcagggactcaaaccaccaacattccgatcaacgggactcaatccaccagcatttcaatcactgggactcaacccaccaacattccaatcaacgggactcaatccaccagcatttcaatcactgggactcaatccaccaacatttcaatcactgggactcaacccaccagcatttcaatcaacgggactcaatccaccagcattcaatcactgggactcaattcatcagcatttcaattactgggactcaattcaccgacatttcaatcactgggactcaacccaccaacattccaatcaacgggactcaatccaccaacatttcaatcactgggactcaacccaccagcatttcaatcaacgggactcaatccaccagcattcaatcactgggactcaattcttctgcatttcaattactggga

SEQ ID NO: 44212 - DNA, 538 bp, Heterodera glycines
cattgcgggattggaactcaaatttttttgtgggacgggatcccgcgtggattcatcccgcaacttttggattgcggactgggatcccgcgaaatcccatcccgcgtggggtcccagtttctaaccagagtagacgtgaacttgccttctttttcgtctcgagatttttgctatatacttctgtgagactcgaaaaaagtcaaattttttgttgttgtttcgagtcagtctcgagttttttcatgttttcaatgtcaattttttttttgagattccagaaaactgggtgctttaattctcaagtcttgggacagcggagataactcaattgtttgaaattgtttgccgttttttaaatcgaaggaacttttcgcgaaaattttaaactgacagggattactaggaatacgattttttaaagtttttacttattcaaaaagcaagaaaaaaaatgttttttttgtagttgttaagctagttttcgagttattagcaactattttctagttttttattttttagcacctaaaaacttaaa

SEQ ID NO: 44213 - DNA, 1634 bp, Heterodera glycines
  misc_feature (19)..(19): n is a, c, g, or t
  misc_feature (46)..(46): n is a, c, g, or t
  misc_feature (1503)..(1503): n is a, c, g, or t
  misc_feature (1517)..(1517): n is a, c, g, or t
  misc_feature (1540)..(1540): n is a, c, g, or t
taaaattataaaaaatacnttgaaagcattcatcgaatgtgaatantttcgtctaaacaaaaacataaataaacaattgtcattttcgcccttttctcaatgcctttttccgttgcgtatggcctaagtcgacaaaggtcctaacaaaaatatttattattttttggcattttcccatttccccgttggcattctctcccccccctttcccccctagcgttgtgccatcactcacattggtcctaccgcttcacctgaatggtgcagtctttgcctgcgcaaatgatcacgtccagcagttcgcgcagcgacgcaaggcggcggccctcggcgaattcggcgcccaattcggtgacaaaggcatcgtggaaaatgcgaagggcgtcggcaccgccacgcgcatactccgcgggcaaaagacagtccatttttccggtactttggagcaaaggcgatggcacacgtcgaagggggcgaaaggtgaaaaagtgcctggattgccaagccgaaggaaattcgcactgacaattatttaatgacccctcggggaaaatccccaccccccccgccaatcattcatcatttgtttcccattcttcaccatcttccttttttggcgtggcgttcatttcctcgccatttttcagctcgtcgtcgtccgggcaacccccgccctttttggcgatgctttacaataacatcaaaagatgaacggtgatttttggcaatttgttgttgaatttgcgtacaattcgtagggcaaaagtctattggaagaaaagaaaaaaggacaaacggacgaatgagagaagcgaagaacggattatcagattatgcaacatttgaaaatggtaaaaaaacaattgaaaaaagtgataaacggagaaagggaagaaaagcagcggataattgggcggcttttgcctttaaagcggctgatcagtgattaattcgatttgttaatttgccattgtgcctatgctatttaatctcgttttgtgctccttttcatctcttattcctcggcctccatctttgttcgcgtcatttcacctccactttcccacttccttctcatttccccttcaaaagtcgtctcaaatttcggaatgcccccgggggataaaagggcaaaaaacagacggacaaagtgagcagctgttgccgatcaccgaatgatgatgggtcagtcgccttttgttcttcctttttcacttttgtttttctttttacttttctcattttgaataaatttaatggaagtcctttttttttgattttccgtttcacttttcaaatagaaaaacaaacagtgaattggccacatttgtctaatgggtggcgtcggtgcgattggccgaggcattgcccccggggaggggcccatctggcacattgtttttctgccctccgcttcataaatttggtccaaattaccaccattttctcactttgtgtggccctttggccgctctgtcatttattttccaaaaattccattanatgtgccaatgccncgcgaatgagtgaatttggatgngtcaccccaggggggggcgggtggccccttttattaaaaaacttgccaagttgtaggaaaataaaaaaatgtaagacatataaaattcgtatct

SEQ ID NO: 44214 - DNA, 667 bp, Heterodera glycines
tatttctaatatttatattcaaaaattaatttaaatatattttttttaattacaaattaaaataaagcgtcaaaaatacttgcgcaatggattagagcccttttcagaccaaaataacgagttcgaacaaaatgtcgaaaagtcgaacattgttcgaactctacaaaaatgatcaggaagacatttccagacagggggttactccaaggggggtcgaaatgttgttatttttgctcaaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaaggtcgaaaagtcgaacattgttcgaactctaccaaaatgatcaggaagacatttccagacagggggttactccaaggggggtcgaaatgttgttatttttgatctctgtcaaataaaacccgtaataactttactaaaagctatcatacagacttgtgttatagtacatgcaatagcggatattctctaaaacaatccttcatgaacatattttttttttacgatatattttaaaaattacgttctttctttgtgagaggagcaaaactcattttttt

SEQ ID NO: 44215 - DNA, 1219 bp, Heterodera glycines
  misc_feature (1187)..(1187): n is a, c, g, or t
tgtgtttcatatttttgcctgaaatatgaattttttattttggtaagaatgggagtgaagtctgagaaaaaattatttggaaactgtgagaaagtaaaaattttattgaaaaaaattaatctatcccttttaagttttgttaatttttatgcaaaacaaattaatttcgctgatgatcaattttaatgtgttttcttaaagtttctgttaagacaataatttaatgcttgtttgttatgctttacaatttaatatttaaatattttagaaattatttcaatttcatttttttcattatttattatttgttattttattctaatttattaagtattttactcatgttgatgcagctgcattttttattcagagcttgccaatagttaggtttgataaaaattaattaattaattttcgtagtaatttatataaattttatttttcttgaattatgcaaatattttatttttataattaaatagtgccaatttataaacaattaatgaaatattataatataactaaatttttatgagggttttattgttactttatttgcaatttgaatgatttctagataaagatacccattcttgggcttttaattaattttaagtgaatttttgttttttttatttaaataaaagtgagtttactttactgaagtattatttattaatcatacttttagtggtaaatataaataaatctgttaattagagaatttaattaaaagcataaagacagtcagaggcaggggaaatggcacataattagaaaagaaaaataatatagagagccaaattatcccccatttaacacacttatttattagacattttttatagaatattcaaaaatttaaaaaatgagttgttaataatagagagtgaaatattttcttatttttggtttggaatttgtgtaaaattttataaattaattcaaccttatattaatattattattttaggatggttaaatgtgtcgacatttttaaagataaatttattatacactttcgtaattcttgatccgaagtgatatattttgtattttaattgaatttcaaaacaaaatttttaagcagattaaaaaaaaaagttgtttgaattattaatgccttcaacacattttttataattccaatttatatgaaatattatttatatttactcgagatgcanataattacttaataaaaattttatacattgaa

SEQ ID NO: 44216 - DNA, 1252 bp, Heterodera glycines
catccacgggtacaatgggcgagcttcacataggcatcaggggtgacagtgcacacttcgctccattcccgtggtttgcacattgacaaaaagttgggccgaatgcgaccgatcaagcatttaaaagcgtcgatggccaaagtcatcagccagaaagcgatgcagtagttcaaatactcgagagtggaacggttgatgacctctaaagcgtatttgaaatttagtattatacaataagaaagaaagcataaatcttaactacaaaagtaaaagaaaagtaagggaattattcagccgtcaaaatgaaaaggatttaaattatgcaacagttaaaatgaaaatctaaaagtaaaggcaatgtttaaacaggtggccaaacccacgagttatattcctcctgcgaggcctcgtagtacgcatcaaatcggcaagaaaaatgaagaagaacggtgcgcccaaagtgattgcgataagaagggacgttgaaacagtgttggggactaagggctctctgatgctttgatcattgcaataaaaacctaaatcaaaaagaatccaaaaaagaattaattagaattaacaacctcgttcaaagggagtgaagaaagtccaaaccaacagtttgtagctcagaaatgtcaatgcaacccaaatgacaatgtccaaagccatataaattaagcatttgagcaagaatagcaatgtggtcgctctgccttcaccaacgtcgaacagccggcccgtgaatgtgatttgtctccacggaacatactgaaaaccgaaaaagaatttaaaacgtacaaataaatgattaaaacctgaagcattattgtgagacttctttcctaattataagtacaacaaccacgttacaaacgaataacaaccttaattgtctgatttaatgaaactgaataccacaaataagtactttttaaaaataattaggcccaaagcccacaaagagaaaatgactgacaatgaatgaggaatggtcatgtggcttatcttgtgctcgtttctttggcaaaagaacttgttccccaaaaaataataaaatttaaatcatataaaaaaaattttaatacctaaatgcaataaaaagaataaaatggttgctggctttggcttatatgttttggtagggataaagggataagacaatgcttcggtgtgcctaccactaccactgtcggtgaatgggaatgtctgattgataaaacagtgcaaggacaaacatacatacaactat

SEQ ID NO: 44217 - DNA, 1372 bp, Heterodera glycines
  misc_feature (1307)..(1307): n is a, c, g, or t
  misc_feature (1318)..(1318): n is a, c, g, or t
tatgagtgatagtcaattctgaagaaagaagaagtaatgtgtttttgaaaagaaaaagagaacgcgaaagattgagaagagcaaacgagtcacaagaccaaagaattatgcgcttagaacagatgagaaatagaaataatagtcaatgatctgaagaaagtgtgttagagcgacagctacgcttagaacagatgatttgaaagcctgagaattgagtctcagagattgaaatgctggtgggttgagtcccaagattggaatgccggagatttgagtcccacagattgaaatgctggtgggttgagtccccgtgtttggaatgccggagatttgagtcccacagattgaaatgctggtgggttgagtcccagtgattggaaagcctgacaattgagtctcagagattgaaatgctggtggattgagtcccagagattggaatgtcattgaaagttggtgggttgagtcccagtgtttggaatgcgggagatttgagtcccattgtttggaatgccggagaattgagtctcagagattgaaatgctggtggattgagtcccagagattggaatgtcattgaaagttggtgggttgagtcccagtgtttggaatgccggagatttgagtcccagagattgaaatgccggagaattgagtcccagagattgaaatgctggtgggttgagtcccagtgtttggaatgccggagatttgagtcccattgtttggaatgccggagaattgagtcccagtgattggaaagcctgagaattgagtctcagagattgaaatgctggtgggttgagtcccagagattggaatgtcattgaaagttggtgggttggtcccaatgtttagaatgccgcagatttgagttccagtgtttggaatgccggaggtttgagtcccagagattggaatgccggagatttgagtcccagtgattgaaatgctggtgggttgagtccccgtgtttggaaagcctgacaattgagtcccagagattgaaatgctggtgggttgagtcccagtatttggaatgccggagatttgagtcccacagattgaaatgctggtgggttgagtccccgtgtttggaatgccggagatttgagtcccacagattgaaatgctggtgggttgagtcccagtgataagaaagcctgagaattgagtctcagagattgaaatgctggtgggttgagtcccagagattggaatgccggagatttgagtcccacagattgaaatgctggtgggttgagtccccgtgtttggaatgccggagatttgagtcccacagattgnaatgctggtgngttgagtccccgtgtttggaaatgccgagatttgagtcccacagattgaaatgc

SEQ ID NO: 44218 - DNA, 844 bp, Heterodera glycines
aagacaaagtgctgaaaaaattcgggattctggacgaaaagccgaaaattgtccgttcaaaatcagctccggaaactggcattgttaaagtgccaatcaatgaattggttgtggtcgaacgggcgattgttggatcaaagcgcggtaagtgtgaaatactaattcacaataaaagttgcgaacggatttgcctagaaccgaatatgaaggtggcacaagccgaattaattgagagagtgttcgatccttttccgaactaatgcccaaaagttttgatcaattgcttcttccacacattttcataagaaacctttccaaaattgattcaaaaaacagaatcaatgatcttttttctattctcgatccgaaaacaggcccactttccgagtacgaacaggaacaaatgcacaatctttggagtgaatttaatgaaattttggcattggatgagtcggaattaacccaaaccgatcttataagccacaacataaacaccggaaactcaaatccaattaaaagtgctccaaggccgattccctttggcgtaagagcaaaagttaccgaaatgatcaaggattacctggacaggggaattattcggcaatcatcttccccgtgggcatccccaatagttttggtcacgaaaaaggatggaagtgttagattttgtgtggattacaggaaattgaatgcggtaacagtgaaagattcttacccactcccaaacattgagcaaattcttatgtatttggggaaccgaaaatttttctcggttttggacttaatctcaggcttttggcaagtaaaagttaatgcggaggacgaacccaaaacggcatttact

SEQ ID NO: 44219 - DNA, 1016 bp, Heterodera glycines
aggaagatagcaatattcttgctccccggtgtcgggctttctacttatgcgccgcttgcggtgcagcacaaatgccccagcatctggcccgatgtgcgtgcttaattgctcgcacattgccaaagccgtagcactcgtgtgccatggtggaacgtcggggctttgcttttttttccatttatttcaatcggctagtgctttaaggttttgtgttttgactttgcttttttttccatttatttcaatcggctagtgctttaaggttttgtctttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgctttttttccatttattccaatcgaccacgttaattcattctctatacatttagtgtcttatgtcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgattttgctttttttccattttatttcaatcggctagtgctttaaagggttttgcttttgactttgcttttttttccatttatttcaattcgggctaagggctttaagggttttgcttttgactttgcttttttggccattt

SEQ ID NO: 44220 - DNA, 855 bp, Heterodera glycines
attttggtttttatttctcaacttagcgagaagtgcacgctgttctcaaccggacgcgtgcaaatccatcctgcgcgggtgctcagcagaaacaatacgaccaaaggcaacggcgtgggtcttgaataagaaaaaataattgtcagtggcgttccgagtgcgtattatattccagagaattagattcttttaatttgtacaggcccaaagtcaggaaaaaaagttctcaaatgtggtgaatacgtatttttttaggccgaaagttcataaaaaaaacttatctcataagatattctgagaatttgatatttctggccaaaaactgctcactaacgtctaatacctttcagaggctaacaagtctatttgtggagttgtacggaaatgagagaataaagcgtttacggattagtacttcataaatagcgcatattggaataccataattatggatatgttcgtcgctgaatatttaaaatccatttttgtctaccagagttggtattgatttgtaatagaatatagtaattatcagtcagctctctaggtctccaagcagttcttcctcccattcggtgtgcgatggcgccaccgcttcaacaagcaatattggagcgtgaacgctattcgcattttcaccctcataggattggacagtgcgtcagccctgctaactcctatccttcaatgggccccctacagctgtagcggactccatatcatcgagagtccgtactacacactcgtggatccccccccccccctagtgggccccttcacccataccccccccccttttaacatcacgtatacaacatttactcttttttcttcaacgactagtggccgaatggt

SEQ ID NO: 44221 - DNA, 964 bp, Heterodera glycines
  misc_feature (117)..(117): n is a, c, g, or t
aagagctgcggaaaatgtgaaattaattctcagaaaaatggctatctctttttaggacaatattctatctcgtaaccccgatgctaatccgttccgcagagcctcttcaaaattttntccattaccgcaagagctgcggaaattgtgaattaattctcagaaaaatggctatctctttttaggacaattttctatctcgtaaccccgatgctaatccgttccgcagagcctcttcaaaattttttccattaccctaagagctgcggaaattgtgaattaattctcagaaaaatggctatctctttttaggacaattttctatctcgtaaccccgatgctaatccgttccgcagagcctcttcaaaattttttccattaccccaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaaatgtgaattaattctcagaaaaatggctatctctttttaggacaattttctatctcgtaa

SEQ ID NO: 44222 - DNA, 1029 bp, Heterodera glycines
ttccctcgagggcgcctccttcactttttgccttccttttgccaaattgaattttcgttcgttcggcacaaattatgagtgatgatggaatggcgcggcacacacaatgttattaccatcacaagcagcagaagcgaggcgagcaaagctttctgactttttgtcctcctcaatttttgaggacccaaaatccattgaaatgccattcaaatttgctgtcccccccccattacaaccaccgacaattcacaaaatgtgccattatttgtgcccttttaccggaatggaaatgccgtgggcaatttagcataaataaaagcgttttttttggcatttggaaatatttaacagccttaggcaattttgaccggtgcatttaactgtgcctttttacttaatattccaaagaataattaatttaaaaagcaataaaaccaaatcaattttatatgaattaatcattttctattaaattttaaattaatgaaaaatggcactgcaaaaattgcgctatttttttctgttgttttgttgcaaaatccaattttccacgtcggcctggcaacacaaatcggctgaactgttggaccagttcatggagcagcagcagcagacgaaccagtgtgatcaggaggcggagaaggaagttagacactgcctgcaggtgggcagaattggatttgataaattttaaaatttgtgggttttctcaataattagtcgcttgtcaaagaaattaatggatgaaaataaattatgcaaaaaaataatctgaagcttttttaagcaaatagtaaatgattaaaaacattaacaaaagttctacctaattatcgtgaaaaagtgagaatttttgtgatttcttcagaaattttggttttgattcgtttatttgacttgatttttaatggttaatagtagagatcgacattttgaaaaaagcctggacctggatttggattccatgttggacctggacctagatccgggaaaaatccaggcctggatccaggtccaggtcgatctcta

SEQ ID NO: 44223 - DNA, 1027 bp, Heterodera glycines
  misc_feature (95)..(95): n is a, c, g, or t
  misc_feature (123)..(123): n is a, c, g, or t
  misc_feature (268)..(268): n is a, c, g, or t
ttgctgcatgttctttgacacttcttcaaaaataacctatgccctttatcgttcaaaacagcatctttgttgttcgcttgagattgacaagcccngatgataaatagctcgagcgcaaaacgncgtgcatgtttggaaagtatcgttcataccaataattgagggtttatttttaaatgaaattttatgataaaccttattatctcagaagctatttaattgattcggatgtttttatcgcggttaattagagcaccgaaaactggtnttgaatcgtgaagtttatcatttctaactcacttctcaaaattgttgataaattgcaaatatatttttccaaaagtctgttgacactttctgaaaataaattctatactcaggtattttccacttattagattttgcaggcttattgctgcatgttctttgacacttcttcaaaataacctatgccctttattcgttcaaaacaccatctttgttgtttcgctttagattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaactggtttgaatcgtgaagttttctaactcacttctcaaaattgttgataaattgcaaatatatattccaaaagtctgttgacactttttgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttataaaagaatgaaattttatgataaaccttattatctcagaagct

SEQ ID NO: 44224 - DNA, 1157 bp, Heterodera glycines
agtgatttttctgggattaggccggagaaataaaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggacaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaaataaaaattaccagctatttgaaatgcagtgggcaagcacagcgagtcgcttaaatgcacaccctttgacccctaaaattattccaaaaaaagagatagtgattttttctggattaagccggagaaataaaaaattaccacctatttcgaaatgcaatggggaagcaacagcgaggtcggcttaaaatggcaccccctttgacccctaaaaaattcccaaaaaaatagaaaaggggattttttctgg

SEQ ID NO: 44225 - DNA, 1162 bp, Heterodera glycines
tgaaaattcaaataaatatataagaaattttaaaacatattgcggatatatgaaataaaacttttgcttcaataattttgaatgcatgtgcaaaatatattttggcgaaaagcaacaaaaattatattcccccccccccaaaaattttcaggcgtagggcgattccatgggtctcattttggctttaaaggaaatatcccgcaatggctataactaatcattgatgcgcctcggtctataatgcaagaatccgaatttttgtggagaatatgcactctgggtcgagttattaacccagaactaaagtgaccaaatgctttatggactgaactgtccagtacatcaaaacagacaaaagttaataaaattaatatcaaatcgattccttatccttaataaaataacatcggaaaaccaatcccggcttcataactctgtgcgccccccacaaaacctttcggattattgcagtacataacgagaaatgtcgaaataggtatatattttttcatcaatttaccaaaatataggtatctcaacattacaagtgcccgaaattagtcccatcaaatttgaaaatagtattttaacctttttaattggattcaaagctatccttgatttttttgctttgtgaaaattatttctaagggtaggggaatttgatacgctaagcgcgaatgttccgcacccctcagatggtaattgtaagtttgtccccccccccttttttcgaaaaattttttaatgtttccaaaagtcatgaaaacaggtttccagggctttccggtggttcgttcatacaggtcttcggctgtccttccacctgccaatttttgttgtctgtcgttagcgtaacacgtggggcaacctttaagcatttttttttgttcggttgaaaagggcgaccttttttttttaccatgataaaagcaacccatgtattcaatggcaaggttgcgttgagggggttcacgtgtgactaatccatcaaggcggtagccagtgtcttcgacgttagcctcaccaattgaccattgggcagaccgaacatgtactcccggatgtgtcatttcataataacgaatgtatcgtgccgattcagcagatgctcgccgcccccttaggtagccaccttctggcgcattaacaagcttgttca

SEQ ID NO: 44226 - DNA, 1163 bp, Heterodera glycines
aatatgaatgaattttactgatccgacaatttgcgcttcgtcccttttttctcctcttccacagtgatgtcaacggccaatgtcactttgtccccgtctttgtcataaaatcctctgcttgggtccattaattgcttaattatgctcatttattaaatgagggtttacgaatggaaaaagctcaccgcaaaagtgatgaaagtggggaatcccaaattgttcaatttattgttgaaaatacggccattgaattgcccaattaaattctccgccccgcccttttgtgagacaatttgaattgtggccgaacatttgcaactccaattttcaccttaattgccaatttgatttaatgggataaattcccattttgtgccattttttgagccggcacacaaaaggtaaaatgccaaacacttttcactgcttttattattctgattgattaacagtgccaatatcttccacgaaagtccctttatttgtttgatttcgctgctccgttcactcaaacaaatctctcgcgaaaattccgccaatttgccaatttccatcacaattttcccgtttgttttgtttggatttgaataatccaatttatccgcattttcttccttcacaataacatcgatggccaatgtcactttgtccccgtctttgtcataaaatcctctgctcgggtccatcaattccttaattatacttaactataaaaaaatacatcacttaattgcttcttatataaaaggaaatactatttcataaaaccaatatgtaataatttgttgcatatttatggaagaaaatccaaataaaacccataaaattctcctgatttttctctattttaaaggttttattcctcgaaaattgttcaacccttaggctagatatgaatttttgaatatgcgaccaaatttctgagggccaataaattgcaaaatattttcgaattcttaaaaaattctaacaattatgatacgaaaaacaaaggtcatattcgtattcagcatttcaaaataccacagaaaaaaaattcttcaccccccttttttaacccaaaaaaaaatttcttaaattttctaggttgcctatctcgaaaacccttgaaaattttccaatatgtattacaccattctataccatttaaaaagccctacaat

SEQ ID NO: 44227 - DNA, 1484 bp, Heterodera glycines
  misc_feature (156)..(156): n is a, c, g, or t
  misc_feature (167)..(167): n is a, c, g, or t
gatggttttttgagtaacgacccgggctccctaaaaactgcaaataaataaataaaaaaatgtaatttgtgatttttcgccagttatttattcaacattttaaatttatatgctttgaaaaatatgtattattattaaatgatttcattccttctncaattcgttcncaaattgttttttccctttaaaaatggtcgatttatcaattttcaaaatttttgcaggggatccaagaaattaattttacattaatttacaataacaaaaatatgaatataaaattcatatccacaggacaaacgtgaaaaatcaagacatacaaaactagtttattcgcttttaaaggtaattttgtggattttaggaaaaatttagtgaaatttttaaggaatttgtgagttagttagatcttggaggtgctaggtcgaaccggaaattgtctcagtttcaataaaaataattaaatttaattatattaaagcaatatttttaaaatttaatattaataataattaaaaaattttcaaataacaataatataatttaattcaagttttcttcaatattttttcttcaaagattccgctcgaatatttggcataaggcaaggcaagattaaaaaaataattgcaaaaaattaataaaaaaatttctaaaaataaaaatatgcttatcaaactttggttattaaaccgttgattattttaatgaatttttaattacatacttattttatcgatcaaaaggtgtgcggttgttgacttcattttaatgatttccggccatttgctgaatgaatccaccactaccagatatttgttaccatctgcacatggaccagcgaaatccatgtgaagcctttcatagacttgagtggatgcaggccaaggttgaagcggcactttgggtggcgctttggatgctaaggcacactcttcacaatttctaacccacccatcaacgtcgagatcaattttgggccagtacacaaattgtttggccaaatttttcattcggacaattccaggatgggtgaaatgtagtgtggtgaggatgcgctgtcgtagtttggctgggatcacgactcggtcgcccatgagcaagcagcctttgatttcgctgagtctgttgcggtgagtgaaatatgcggccaaagttgacgaatgtgcggttttgggccaatgtgtgcgacactgatgaagcacttgctgcaattcgtcatcttcttgcgtccgtggagcaacctcttcggcagtgatcggcagttgatcaagtgttgtttggaacacataatcgacggctgccacttcgagttcactgctttcttccatgtccattttggcgatgactttgtcctcattttgctgtgactcgcggtgttggctgatcaaacgaaaaagtacatctacctgaccaaaatttttcgtggaaatgtatttgatattaaaatcataattcgatagagtcaacgcccatctttgcaa

SEQ ID NO: 44228 - DNA, 1150 bp, Heterodera glycines
catttcaggggcccacagatttcctggcgcggcttttccccccgccgaggtgccattcgctgtccatttctcgtcggtcctcaaaagtaccaatggattcacaatcgttccccattttatttcattgcttcacctccaattttgatggctatttcgccgacttttctcgccgtttgttcggcatttgctgctcggccggtcgcattttggcgaatgccaccggccggtcgatgggcaaccatcgccccggggatttggggttaaaaggcacaacgaaacaaaaaatggctgaattatctgtaggatggcattaataaaattattgataaagaaggcttaaaatagaaccatattaaataaaataccaatatcaatcagttgcccattaaaaatacaaagaaagtgacactatcgaacaataaatgccaccgcagtcgcttaataattatcgctaattgccctttccaatcaataatttatgaatgggaatgaatgaatggattaattggattaatggctttgatcgcccccctttttccatttcattcattcttttcaatccgttcttcgtccgccccttctgctgctctggtcagatcactcataataaaagaaacattgcccaatgtgttgtcttatcgcgcgaaaagaaaaacgaacgaatgaatgggcgacaatcgttgcgcgacggagtcggaaaagaatggaaaacagcgaatgatcaaaagcggaggagagattggtgaaagatggcacaaaaagcggaataatacagaagaagaagaagaaaaaagaagcaaaaggaagacgaaaaggagaggaagggaaagaaggaagaaaagagaaaaaggagagcaaaagataaggggaggaagagaagagagaaagacagaaaaggaaaagaaaatgagagaaagaaaagaaaaatagggagaaaagaagaagcacagcagcagcagaacggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatctatgcacaaaaaaatcagagcaaaaaaagttcgaatt

SEQ ID NO: 44229 - DNA, 1033 bp, Heterodera glycines
aaaatgtgcgcgaatttacagcttttttttctcattaaaaaatgtattataaatgaatgaaaattgcttattatttattctaatacaaaaatatttatttcaaatgattattttattaattttctttttgtattttcttgccattcccagcaaatgcttataacacatatgatgggtaatgttataaccattattataaaaataatagaaattttataatattttcacagacaaaaaaacaaattattttaaaatatccaaatttattattcaaattttataataattaacaaaatctaaaatcattttttaattatgctaaccatgagatcaaatataaattttgagattacaaaaatatttttttgttttaatgaaattcacgcattgatgataaattggataaatataatttttccaaaaacataacactcgcgaaaaatagaattctgtggccaaaaataattaaatttaaaaaaacaattcaaccgataattttgcattttcaatttgagtccggcggagcctcggataatttggggaattggcttgatttgttgttaacagttcacctgaaattgccaatttcttcagggatttttgcttaaaattttgaaattttcaaggaatttgtgaagagggctgggttgagtgagggtcggcactctattaaaaaacgaaaatttttacgcctaaatttttttctcagttataaagtgattcgcgcaatcccaacgaatgacagccaagtgttggcattgcgtcatttcgcaaatttgatggagtcgtcaaacagtcgcaaaggcactgtccaattctggcaacatgcgtacacgttgcattcaaatgcggacatttttgccgattctgacagtgccaaaaaggtgagtgccgaaagagtcataaccaaatgaatcaaaagttttcgttccctcccttattaaaattcccgaactttaaggaacataaatttaattagatatactattaaaatatatattgaatttaaattttaatcagaaatttggttata

SEQ ID NO: 44230 - DNA, 1752 bp, Heterodera glycines
  misc_feature (90)..(90): n is a, c, g, or t
  misc_feature (117)..(117): n is a, c, g, or t
aaaataaatcagttttttaaacgaatattgaaaactaaaaattataaagtctaaaattcaaaaagatcaactaataaaataggaaatttnttcttaaatttaataaaatagttatgnaaagaaaatgagcaaaatttaaataataatcaacaaatatataataaaaattttcttaaacattttaaaatcaagatagcttttacattcagctaaatttatttatgtttgtcagctaaaaaattttgactaggagttacttgacgtctacaatcatgcaaatgtaccagaggaccttacaagggatattgcgaatcgaaaaataaaatgcgaaataagaaacacgaaaaatacgaaactcaaataaaatacgaaacactaaagatgaaacacgaaatttttttactgaaaaaaatatcatacaattaataataaaaaatcaaaattagaatagaagaatatttgtaaaagtttatttatccgcattttaaaacaatttaaaattgggcatattttgctttacaataacaattattatggggtttaataaattatctcaaaaattctctacaattgaatttttggtcatatctgttaatcaattcgtaaaatctaaaaaatttcccacccgcgcaaaaaatattattagcaatttataatattcaattaagaaaattaggcattaaaatacatgaaagattgctggaattttaaatgttaattttcatagaaagccttaaaaattaatcgaatttcgatttagttaactatacgcgtttggtaattgaaaaatttttgatcaaaaacgaaatagttgatatgaaaaagacatttataatccataaaattgatacgtataaagtcgtgttatgaaatcatcgagacactttaatcgaaatgttcaaatatatttaaaaataattaagtttcaaacaaataatatggggacgtgaacatttgattggtttctgaagtaaattgaaatctaatgaatttatataaaaaaaattatttaaatttttttttaaatatttcttaattttctattaatatactcacatttttaaattgtattatgctgatttatcatcattttatgtttttcatgttaagtataaatgttaaaaatacccaaattttcaaaggcaaaaaagccaaaaatttacaattgcaaacgaaattctctacacaaattaaaattgcaatagaagatcatttataccatttttagatcctcattaacgaataatattatattgtcatagaaattaaatttatttagcaaatgttttttattttattgtcgttttgtaagcaattattattttgtcattaaacaaatttaggtttcaattttcattttattttttatcctttttttttgtattttatttttttgttaaattaaaaaaagataataatacaatgttgtcacgaagtcttaatgtttttattttttattgtttaataattaatattttgatcaaaaataactcttaatatttcatcaaaattctatttttttaattttgattttttgttctttttatgatttcattaaatttcttttttttacattatttctccaaaaataaatattctattaatttaccatacattaaatctgtttaagaataaattattaaacttttttaacattaatttaattttttttataaatcaacagcttattattttgtatattataaagatagtgatcactattactctattaccaacactaaatttttgaaa

SEQ ID NO: 44231 - DNA, 268 bp, Heterodera glycines
ttaagttatataaaatcacgccgttatagatacgattagccgagggcgtattcatatatattacaaaattccgccctttatattatatttttccacatatttttcagtttttttttttggctgaaaaattcttattttcgaaaactttgtaaatttagtctggatttactaacagatttatacaaaaatgactgattttttgatgaatttgattaaattttgaaaaaattatcaatttgattttggttgtcgaagaaatctttaaaaa

SEQ ID NO: 44232 - DNA, 958 bp, Heterodera glycines
ttcacagaggatttttatatttagagttatcccagaaaaatggatatctctttttttgataaattttatacacatacaaatgctctcgagcatgatagggagggcggtgcgcaatagaccttttatttttgagggaatttttaaatttatactctatcccagaaaaatgtctatctctttttttgataaattttatacacatacaaatgctctcgagtatgatagggagggcggtgcacaatagcccttttatttcacagaggatttttatatttataggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgcgcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatac

SEQ ID NO: 44233 - DNA, 1403 bp, Heterodera glycines
ttcggttttttacggggggggcggggtccgctctaattttaaaatcgtgggtttatcatgtttcgccatcctacttatacatctccccccccccctagggaccagacagccggaatcggtggtatcccgaccgaatcccggtcccgataatcccgaagaatttcgaaaagcgatccggacagataataactcgggatcccgatcgaatcccgataccgatctatcccgtagatttttgaaaagcaaccgggacagatacccgggatcccgaccgaatcccgatcaatcccaaatattttttcgggatcacacgggatttgctttgaaactcatttttttctataaaggccagtttttgggattttgagccatatggcgacgacctttttaccgcttttggcgatccttttccaagaacatttggggaacaacacatgggagtccggcagcgccgataggccccgtctggaaaattttagtaatttttaatgcaatctgattttgcccaaaaatttataagaaaaaattttcaaaaaaattttacttataatttttgaaaaattttaaaaaaatttcgcgggggggggacgacctgctctgtcgtgcagcatgagaactcgaaatgatcggcacaacatgggaccgtgcacatgtggcgacattgccggccttcttttgcgtcaattgccaatccgcatttcatgcaaagcagttcattaaatcttatgccaaaaggaaagtttatcacatgttaaaacccttgaatgtagacttcgttttatttattgttcaccatttgtcactaataaactcattaaccatgaatacttgatcaacgcatttttgatcagtgacactattggcatatacataccaggtttccgatacattcatcaagttgttgatccgtacaagtcgaagattattattccatttttggcattccagtgaactatttctgaatatttttaaacatttatttattatattattctatgcattttattattttcataaacacgaatgtgttgggatggaaaagtgggatggaattagtgggccatcggtggaatggaaaatgaatcacatcgcaaagaccgagtcggactggcttattgttaattatgtaaaaaaaaaattgagaataagaaataatcaaaaaaaaaaagtaaattaaatatgttaggataattatccgacctttcggggtgagaaaaacgaattgttaatttattaaactaagtgaaggacttttaagtcaatgtgatcagattactgaaatgtttcatctttgtccgaccaacttttctttttgacttcattttattattcaaaaaattctttctttaatttcaaatttaaatagtaaaatttgaaattgattgtacagaaatagtttttgg

SEQ ID NO: 44234 - DNA, 919 bp, Heterodera glycines
tcgggggcaaaacggagacgggtgggtttcggactccatctcttctctcatctaaatctaaatcatcctctcactccaggtaatcattcaaacaattcatagttatcaactcaaacgccgagatctttcatcttcaaaagtaccgtttcgatcggcgtaattcgctctcaggcgtatctactctcccccccccccccccccaccgcaacgctttccccttgaaataattctaatttttttgctataaatagactctctcttaaaaaacctaaaaacttcatttaaaaaaaacttgactataaaattttctttgaaacttgttaaaaaatttgaaaaaaaatactttttcaaatttttattgttttttgtttggaagaacctctaacaaaaaataaaaataaaacttaacggaggcgtggaaccaattcatgtgggggagaataagctacttttaaattcggttttccctttttaagttgactgatcagttcctctccttcatttcgcttgaagatgacctcttcatgctcagccgttacacaaaaagcagcccattctctttttacggttcataaatcaaattctttacaattattattcacagtgccggtttttatagcaattaatgacccgtcgataaccgccgatcaaattgacgcgttggtcgccgacattgccaatggactgttcgccgtctgtgtgacgcttggtgttgtgccggtgatcaaatgtccgaaaaacaacgcggcggagagagtggccgaagttggcacggcacgggaaatccctcctcttttccattttttaatatttttttttctactaattcttttcaaaaagacactttttgttgacaaatcttggaaacactttgaatttggtacattaaattggattacacatttgatttttatatgat

SEQ ID NO: 44235 - DNA, 973 bp, Heterodera glycines
gtggtgtaagaagaagagaaggactaataacacagagaacatgtaattaaataacaatgatatcatataagtacatggaaaacgagaactgaatcgacagacaatgaaataacagataacagaacggatcaacacaacaacaaaaagagcagagaattgtaattgtatcatgatcaaacatcattcaaaaatacactggcaaaaatattaacaacacactcaatttttcacctttacgtactgaaaataaagacactaagatccaaatacaatttagaggatctcaaaaaacacgaactaagaatttttgagaataagattcttcccaatccaaatttatagggcggcaaaaaggccccccccccgaggccgcgaaagaggccgaagtgaagtactcttcggtgccgaggaaaaattattaaattttaaaaattttttaattgctttttaaatatgcccaaaaaatgtaggcttaacttttttagtgaaaaatttcgatcactcatattttttgctaattgaggagaaagcgtaccaaactttgcggggaatactccccggtaaaggactaacttacactgaaaatgagcgccgagctagctggcacgaaaaaaattttcgaaaatctgagtctttcgtttttatttattttttgcgataattaatttcttaaatattttttcggaaagggtttctgaaacgccaccgaaattttatttacgtgtctagtttaggcgctctgatgcttttctatcgaaagaggggagaatgaagaaaatttttaaaaatttttaattccattttaaacgggccgaaaagtttaggcttaacatttttttcggaaactgatcggagagcgctcccaaacattgggggattactgaaaaggaaagagaaaataactctattttaaaatattatcgtagtcagttcctatttaaaataatttttatcctaaaaaaatgaccctgca

SEQ ID NO: 44236 - DNA, 767 bp, Heterodera glycines
taaaccgaccgaccgattctcgtttcgaatcctctcgcgcgaggccccgagatttttcttcacatcttaaaaataaaaaacgccaaaaaaaagttttcggggtcgtcggtcgcaaatccgacatcctccatcttcgacctctttcggacccccgacccaaattcgaacaaaagtgaaattcgttgtccttttcggctcgagttgtcctcagtaggggcgcaatttatagttgctaaaaactcgccaaaatagataaatttttcgggaaaatttttcaattcataggggtgtttttttcgttgaaatttttcggggttgattcttaggtgtgtatttttcttttatattgcaattttgttaatacttttggacaaaacgccaaatagctagctcaccacgataagcttttcaaaaaatttttaggctctaaaaataaaaacctaactcgaaaagtagcttaacaaaagccgaaaaaattgattttcgtgcgtttcaggccatagcgagctgaggaaaaaaggctaaaacctaaaagttgtatatgtacctagtcctcacagtttactaataacaattttctatatttttgacttttaaacaaaaaagggtgccgatggatttcgcgacaagttggcgccggcagtgcgcaattgtttcaacacactaaaagcatatgttcaagacccgaagaatcattgagaaaaggcaaggatttgtgggaggaagtggcttataataatataaataaataataataaaattaagca

SEQ ID NO: 44237 - DNA, 955 bp, Heterodera glycines
gcccggaacggtgccggcgatttccgacgaacgacaccaaatccccaattcgctcccgacagacgggccacggacatctggcaaatcgtcaaggctaaccaaacggcaccattcgcgtggaccgactcgccgaacggtctcgcttccgtcctttaaacggctttttatttttcaaataatcctttagccctttttcagatgttaaattggaatgggagtcgggcgatgctgaaaattcggatgaattgttgcgcaaccgcgacatttcttatctgccagccaacaatgatggttaccattattgtgtgccctttttggacgggcgccagcgcgttttgctcgtaatcatttttaatatttacgataattccttatttctttttgtttagttcactgctgacgaaaaagtttctttcattgctcaccaagcgtatgaagtgagtggacagaggggcagaaccatttatcttgttttcacattccatcggtttttcaatcattaaaatttcacagatggaacagccggacatcgaattggagctgcacttgcacgggctgggcatctccctggtcaacaacttgaaaagcattgaagtcctttacatggtcattgattcattcactagtacatatttaattcaatatcaaaatttaggccatttctgcaggaaaacagaagaaaagtgacgaagagtcgctcaaaatggccaccggtttctggtgtcaatatcgtcagaccactcatcagcagacgcttcacgtgaaattgcacaatttccaaatggacaaccaattgcccgcctccaccttcccctcattgctcgccatggtaccacagccgaaatcagtggtcaaaaatggttgcttttttatttagaactaaaatgtccatttctttccgtgtccaatttttaaattgtgaacagagtcattttctttttaatttccccattta

SEQ ID NO: 44238 - DNA, 642 bp, Heterodera glycines
cttacacatgcctaaagagtcaatttcaccccggggcagtgaggggcggggggggggggaccacttaccgagtcggccttcgccccaagcaacccccgagagggaaggcattacaattttgcttgttatttttccaatggcacaaacactacgcatttaacgaaataaacacatatgcacacctttttgctgtatcgcaagtcccacttcctttaagaggaaaagaagaatgccagtgccatccccgctttctcccaatccccgcctccccgaattgtcgcccaattattcgtccatccataagcagaagcaccgaagggtgtgcccttcggcctgctcttccgcgactttcctattgcttttacccttcccccgccttttccgattttttcacccctttctttggctagtgccagccgcagtctgtccgccgcccatcctcttacttccaaccggcttctcttctgtgttgcctccgccgccgtcgtcattcgttgcccatttgcccccccccccgggtccttccccaagggcacaatccattccggcatcctctcttcccctctttccccggccagccctttcctcgtttccgcttttccccccggctcggttggcgccactcgcctccccccgggggat

SEQ ID NO: 44239 - DNA, 744 bp, Heterodera glycines
acgacgggtaacggaggaaagggttcgacttccggagatggggcccgagaaaacggccactccgtctaaggacggcagcaggcgcgcaaattcacccactctcaacgcgaggaggtagtgacgagaaataacgagaccgatctcttctcgaggccggtcatcggaacgggtacaatttaaaccctttaacgagtatctatgagagggcaagtctcggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactaacagcgaaagcatttggcaagaatgtcttcattaatcaagaacgaaagtcaaaggttcgaaggcgatcagataccgccctaattctgaccgtaaacgattgcaactaacgatccgccggcggatttttcgccctggtggggagcttcccggaa

SEQ ID NO: 44240 - DNA, 999 bp, Heterodera glycines
aaaatttaggctttctttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaaaacctattttaaatattatctagtcagttcatttaaataatttttatccaaaaaatttttttttgggttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgttttgagtaccccaaacggacacttgaaaaaatcgatttttttggttttcggggcagtccccc

SEQ ID NO: 44241 - DNA, 1000 bp, Heterodera glycines
tcccttctcccaggggtatttattttgtaagtcttttttttaaataaacttttcaaaccccatttttcgcaccgtgaatgttatttttattgaactctgaaccgttttgagtagattagactagaaaacattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactataaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaaattttgaaatcatgttttcccactcccttctcccaggggtattaatttttgaaagtcttttttt

SEQ ID NO: 44242 - DNA, 1538 bp, Heterodera glycines
  misc_feature (1379)..(1379): n is a, c, g, or t
  misc_feature (1487)..(1487): n is a, c, g, or t
aacttttattacattttttgtacaatacatatttaggaattcaacttctgttattggtgttttaatgctaattatttttgagtaaacaattagagtgtttgactatcacaaattaattacatttagtgttgagttctttattaaatttgagaaattctgtaaattagatgagtatttaagaaaaaagtcatatactggcctgatgtcctttaaaattcttaaatttcagaaattctgtaaattagatgggtaatttaacaaaacgacctgctgtcctttaaacaataaatttaattaccattttctcccttataatttttttcacattaaatttaattatacgtttattacattttttttatttgttcacattaagaaagtctggcttctgttgctgatgttttcatgcttttttattttcaatgtaattaatttttaggtacgttcaaagaattaaattttattatttttttataaaagctataatatttcagaaatccatcattacggggaagaatttaaatcagttggatagggagcgattatgcgatgaggcaatcaaatcgacattttaaaactgtttttttatgtttgtcgttgctttatttttataatttggtgcgccaaatgttttttattacgcttgatgatttgctttctaattagtctatttattcttttgcatatagctctcgacaaagaaaacacaaaaaagtttttgttcaaaaacatgggctggcgccgacacgactctttccccgttgaaacagttaagaaaatctaggttgctaaaaaatagcctagacatggacctagatccaagaaaaatcaaggcctgggttcaggtccaggtcgagctctaattaaaataattgatattggagcattgttgaaatttaatttccacatctttaatataaacataaaaagcattgaacttcccgtaaaactttatgcgaatgaataaataatataaataaagaaacataacagtgaaagaattaataaaaattacaaaaaaaaaaagacagaaaaacaaaatataaaaaatctaaccaaaataaccaaagttagaaaaaaaagaaagacagagaaatgtgtataagagagaatggacaaaatgaaaagtcgataagaattgttgtataaaaaaggcttaaaaatgccgaaaaatttagtatgattcttgttttttatagagaaatttaaaaactaaatttggcaaaaatcattagtaacacttaaaagaacccgctcaaatttgcctaaatatgggattttttttttttgcaaagtgcttagcattaaatttttatgctaaatttggcattttgatatttagccaaaagcaaaatttcttttttatttctgttttttanatgtacttttctctgtgatcatttgttcttagcattttcgcgtttttttttaccatttttacgcttagttaaatgcttaattatcatttcggttttttatattttaanaaaaatcccggtcccctgtcaatatatcaaaaatgctcgaaaaattgtgcc

SEQ ID NO: 44243 - DNA, 1262 bp, Heterodera glycines
gaaattcgatgaatgaactttcgatcaacgaagacctccccagaaaagtgaactattaattttacaaaattaattatttatatttaattaaaaattcaaccaattaagaaaggctcatcaacttcagcttcacatccctctgatttgtccaccaatttgacaattcatgttgatgaacagtcacaaatgcttatgattcatccaatgactgaaccatcggttgacggttaatgaatgctttaatttttttattattaaaaaattaaaaataaatctgacacaatttaaaaaataaaattcatttttaatattgaaatctttttcatatggatgggataaaaaaactcagagtcgtccgaaaattttgaaaaaactagaccatgaccatatttagagttggatccgggtcaggatttcggattaaagttaccctgacccaaatacattttttttcataaacctatgtttaaaaagcatatgaaaatttattatatagttgctcaaaatttaagcccaaatccacttaaacataaatattaaaattcctttttaaatactaccgtcttcttcgacaccaaatcttttggaattttcgaattaccaattttgttggctttaaatgtaaatcattttaaaattaacattaaaaatcattgctaaaaagcattaatttttatttatttgtaggcaaaagtcaacaaaaaagtacggcttcagcaccagcggaatttcagcgtgccaaatgtttagctgaaagtgaagtgattaaggaaaagccgagcattcgaactcggctcattgtttgtgtggtatgtggtgcgatcattgcgttctgtttgatcaaacttttcatatggaaatgattattttgttcaaaaaatgaagaaaaaaaaataaatatttaattttaagaataaatttaaaattttgaattatttatttatttattcaaaaataaaaataaccaaaagaagggcattgctgccgcttacaattgaggtgggaagacgggtcaaataggtagtagtgatagaagacaaataacatttggtaatgacgaagtgaggtcaatgggtagttgtgatagagtttgaatttaaagaagcagaagagtcagaggcctccagcaaagggaaatttggtttttataggaatttgagaaaaattttggggagcatttggatgagaaatttgtagtagaaatatatttttttgaatatgttggaggtgtgcagaactatttatcgaagcactgggggaat

SEQ ID NO: 44244 - DNA, 713 bp, Heterodera glycines
gagagagagagaaagagagagagagaagagagagagaagagagagagagagagaaagagagagagagagaaagagagagagagaaagagagagagagaagagagagaagagagagagagagagaaagagagagagagagagagagcgagagagagagagagagagcagagagagagagagagaaaaaaagaaagagagagagagaagagagatagagagaaaaagaaagagagagagagaagagagagagaagagagagagagagagagaaagagagagagaatagagagaaagagagagagaagagagagagagagaaaaagagagagagaagagagagagagaaaaagaaagagagagcgacgtgcgattgacggaacggagaaagaaaaggcaggtcacggcatttgttgaaaacaattaaacaaaaaaagagcaattaaaatcagtcgatggatcaaacgattgaagctaaagaatggacagacactgtagaagagacgaacgaactgatcagacagacaggggaacgaacatctcaaactgcgagtgccctaatcgagttctaacatcgatttgctattgtttatacactccgtaacatgagtagtgatatggtcgagaccgaattctcccgagaattaaaatatccatttaaactgtctataaaataaaaaacaatttgtgggggctttctctaacaatttattttt

SEQ ID NO: 44245 - DNA, 621 bp, Heterodera glycines
aaaattttgtttttctcttcttatttatgggataatttttgttacgtgcactattggagggatagaattattttaaaaataatttattttaaagaattttgaaaaagtggtaaattggctcaaaaaattaccaccaattgattattgagaaaaataattttatagaggtctttttagttaattctttgttattttcataaaattatttttctctctaaaattttttttgtcgagttttgactacctttgtaaaaagtggttttaaaaatacttaacattaagatatattttttattttggtatcagatgaaagagcacacttcaattaataagaaacttatttttgtttatttttatctcacaattttccgtgtcaaaaggctcatggtaaatattgcaaccatgggtatgatggtggtagcttttctaaccaccaactcccgtgaaatgaccacgaactaccttcttattctgcgggttaaaaagagggtcatggtcatggttaaatgaccaccaacttcatggtcatttgcccaaagttcgtggtagctcttattctgcgggttttaccaccaacttcgtggtcatttaaccataaccacgttcttattctacgggccc

SEQ ID NO: 44246 - DNA, 856 bp, Heterodera glycines
tagggtgtttgactcacttcaaaaaataattccatacccaaaagtttttacaaccacatattgccaatctaatttcttgcagatttaaagctatccattgcctgccggtctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtatttgactcacttcaaaaaataattctatacccaaaagttttttacaaccacatattgccaatctaatttcttgcagattgaaagccatccattgcctgccggttctcggcacagcaaagcactaatagggtgtttgattcacttcaaaaaataattccttacacaagttttttacaaccacttattgccaatttaatttcttgcagatttaaagccgatccgttgcctgccggttctcggcacgccaaagcactaagagggtgtttgactcacttcgaaaaataattcacatacacgaaagtattttacaaccacatattgcc

SEQ ID NO: 44247 - DNA, 904 bp, Heterodera glycines
aattattatcagttatttatctttctattatcatctcatgtccagtacagaatcttgttcttgtaaatacttcctctgtacattttaaatatttattggtaattaatattttttaaatataaattagatttaatattttcctcattattattgattggctacttaaatttttaaagagagttgaccttatttaattggaaatgtttttagattcttaatattttttcttcatttcatgtatacaatacgcgtttttggtgcgtttctcgtttttctatttctgttaaattttgtaaaatgagatctaataaaaagaaaaaaaatatttcgacaacacaggcatttgtatgaaacactgaaggcatttaaaaaattaacaaaattatttaataaatctcttgttcaaaagtgaaatgacaattaattatattttatatttattaaattatatttttgaaaaaaataattatttataataaatattatatatacagttagtttgtaattgtttttttttaattatatttaatttactgctcaattaagatgtggaaaatggtagatctttaaatttttagataaattttaaaatcattattaagaataactttgtttttaaacttttatctataatggtaatcatttttaaatattcacgcaaacattttatattttattatttttttaaattttaacttcatgagctctgagcaatttttattagaagattatggtttcctctataaattatttgtcaactcttataattttgtcttttttttctttctgttattattatttcacgttacaaaacaagcattagttgaaattaaaaaatttaataagaaactttttaatttttcgaatacatttagctattattatgagctgtcataaactgaaa

SEQ ID NO: 44248 - DNA, 936 bp, Heterodera glycines
tcaattattcaataattattttatttttaatgccaattttttttttaacagacaacttcggtttcatattaaaattgtcggaattcactttgacacatttcgacatttataaattgcttgaaacaattttgaatgaatcaccatcatcaaacaaaaaagacacaaaaagtgccaaaaacaaaaacaaaactgcttccgcgccatcgccaccgaaaatttacacatttttgatggacaattttatcgcttcatcacattataaaaaacatttggaaacgagcaaaaaaattgacaaatttgtgaaatgtgcttttgtcaattttggccaacttttgcttttgcgcgggaaattcaatttcccggaattcaaaaaatttgctgatgaaagagaaaaggaatgtggcaaattgccatttaaagatgacattgacatcgataatacacctttatcagggtaggaaatctgtaaataccaccggacctcaaacttttttaaaaattcatcgaaatttgccgcgtttaaataaaagctatacaaaattgaaaaatttcattattttcaccaccaccacaaatgcaatacttaacaattttcagatgcaaacaatttgcgttgcaattgtttaatgatgaacctttgtggaattatgctagagcaattaaaattgagcaaaatgaatgcaaaagtaaaatgaactgattgcctaattaattattaattaatgcctaactttttaatccttttaggcgtgttacaatttgctgatgccttatgtacaattgttgaaatggtcaaaaatgatcagaaacattcaaacacaaacattagaaaagtgaatgagtacaaatttttgaaacaaatcttggaaagaattggtgacacagaaaattatgaacaattaaaatttgtttcgcataaatttggtaaagaaatgc

SEQ ID NO: 44249 - DNA, 848 bp, Heterodera glycines
  misc_feature (840)..(840): n is a, c, g, or t
atcttttcttccccaccccgcatcttttttcttaaatacttattttatatcttcgggatctatctttaaatatcaaatctttcgccctagtcattaacgtcgtcctctccggcttaaatcaaaatttaattttattaaaaactaaagaacgcattctcatctatcaagcagggctcgggcgtaactcgggatttcgattacgaaaatcgcatcaaccactcgggccaaattacgccataattaaaatcgaatttttcgcaattttttattccaattttctttatcttttttcccttttatttttcgctctaaaaaagtgaatttgatgaaaaaaggagatggcaacaaaaaatgaaaattaaataataaaatggagttcatttctcgcataatgagacgaacacgtaaagaagcacataaaaatcctgaaaattttttgggatttctaaaaaatctcttgcttacatagcacgccttcaacacagaaattgcccaaatttgaagaggaatttgcgaggcaaatgcgccgagctaaaaatgttcacattccgaccattaaatattgtgaataattaccaacaacacattttcccacgaccacttctcagggccctccgaatttaaggcgaacagaaagaggaaaaaaacgatggcattgaatccgagggcgaaaaagtcgaagcgccaatgcattttaacaaatattcttttaaaagaataaatgccatagaagaggcagaaagacatgaacaaagtgatcaggtcgaaaaggccgagcaaatacagcgaaaaccgatgagtgatctgacaaatgagggacgggagattgggggggggggnggggggag

SEQ ID NO: 44250 - DNA, 766 bp, Heterodera glycines
atttaaaattttgagtttttgttcgaatttgggttcggggttcggaattttgcaaattaaaggtcatattcgtgttcagcgccacaatttaccctagaaaaattatttataatgtcttttgggtgctttttatagtgcggtcacttgagtcccagctgagttaggcactccattttcggcacttttcatcctggaaaagggcaagcgcgcccctaattctatttttccaacccatttcaaacctttttacatcgattctgaccgtttttaagcatttttgagtttggggcctatgatcaatatttaccaaatttttttttgactttttcgcccaatttcctttgtcacattaaatggcaacggtcttgctcatacgcagaacgtagaatcaatgtggaagaaattgaaacggaatttcaagcaacaatttggaaataagaccgacacatatgatacttactttccagagatagtgtggcgtcagcgctttggagaacgcgagaatgtgtttttcaatttttggtcgcatgtatctgagatttacccatgccaataaaatgttgctgacgcaaaaaactcaaaatttttattgaaaattagaaatttaaaaaatggtcaaattcgggttcggggctcgaaattgggcggaatggatgtcacaatcgtgatcagcgacctcgaaaacacctagaaacctgttttgaacgaattataaattttgacaattgccgccaaaaaatggggggctaccatcttatctattacc

SEQ ID NO: 44251 - DNA, 798 bp, Heterodera glycines
cggggcagtccccctgaaccgatgcgcccagatttatggggagaccgaatccttcgggaatagcttccctatagcctgtactttaattctgcgttggatttttgctccccataattgtttgagtaccccaaacagacacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaacgatgcgcccagatttatggggagaccgaatccttcgggagtagctttcctatagcctgtactttaattctgcgttggatttttgctccccataattgtttgagtaccccaaacggacacttg

SEQ ID NO: 44252 - DNA, 1489 bp, Heterodera glycines
  misc_feature (68)..(68): n is a, c, g, or t
tttgagcacacttcagttagccaagcgtgcaggccagggggtggctctaataaaaaaataaaaaatanccagcatgtagaggacagttgtggggagtgccctcacagcgggcactttttgatccgagttttagaaaaaagttacgggccctaaactgcaagaaaaagtgagaaatcggtccccgggactcagtcgtccgcgcagaatttttctctataattttcccagatgcgcctcaaaaagttgtaagacccttcccactactttcagggcgctcccggccttcggccgggagattttgtttttgcaaacgaaactccttgtcaatataacgtatatagtaactagcgggtgcgtgaaccgtcggctatttagctgggaaaaagcgcttcgcgctttgggagcttcgctacctagattagctatcgggttgtgaaaagatttggaatttttaaaaaattatcagcgatttttaggccgcttcgcggcctcagacgggcgcttcgcgcccgtttctaattttgttgtgcttttcggccgcttcgtggccgttttttaaattgtgttgagtcggacgggcgcttcgcgcccgttattaaatttgatggactcagacgggtgcttcgcgcccgtttctaatttttgttgtgcttttcggccgcttcgcggccgtttttaaaattgtgttagtcggacgggcgcttcgcgcccgttattaaattttgatggactcagacgggcgattcgtgccctttttatggcctttttaggccgatttgcggcctcgaacggccgcttcgcgccgttttttaaattttagaacagatacaaaagtgattagaagaggtagaactgtgattagaagaggtacaaaatgagatgagaagaggtacaacagtgatttgaagaggtacaacagtgattagcagaggtacaacagtgaaaaagtgatagaaaagtgattagaagaggtgcaaccacagaagggaaaggcacaacagtgatttgaagaggtacaacagtgattagaagaggtgcaacagtgattagaagaggtgcaaccacggaagggaaaggcacaacagtgatttgaagaggtacaacagggattagaagagattatctgggacttttaggccgcttcgctgcctcgaacgggcgcttcgcgcccgttttttaaattttgttgggcttatacgggcgcttcgcgcccgtttctaaatttgttgggctattaaggcagcttcgagacctcagacgggcgcttcgcgcacgtttctaaatttgttgggccgcttcacggcctcagtcgggcgcttcgcgccggtttttcaatttttgttggccttgaacgggcgcttcgcgcccgttttttaaatccgttgaactcatacgggcgcttcgcgcctgttttttagcttgttaggccgcttcgcggcctcagtcgggcgcttcgcgcccgtttttcaatttttgttggccttggacg

SEQ ID NO: 44253 - DNA, 1084 bp, Heterodera glycines
  misc_feature (1007)..(1007): n is a, c, g, or t
  misc_feature (1049)..(1049): n is a, c, g, or t
agatagaatattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaattttcgcagctcttgccggaatggaaaaaattttgaagaggctctgcgggacagattagcatncggggtacgagatagaaaattgtcctaaaacgagataggcantttttctgagaataaattcacaatttccgcagctc

SEQ ID NO: 44254 - DNA, 1185 bp, Heterodera glycines
tttgtagacgtgaggtggatggaggagggcggagaccggcttatcagtgcttggggtaggcggcggctgaggagaggtcgcttttgatgtttttacagtttcgttttgcgtttctacctaacgaggcggcgaatccgcaatcacaccttcataatcttcattgtatgatgagggaaagacaattgttacagtctcgtttccttcataatgacgcggggactcagaaattatcccttcctcctcctcatcctctttatctccattgtaagacgggggagagccatactcgttcccactctcacctcaaactggaggtgactcatctcttataaaagcgctcagccggagagggagggcggagagcaatcgcccttaacttctcagagaattttaaatttatctgatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttatttttagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctctt

SEQ ID NO: 44255 - DNA, 859 bp, Heterodera glycines
ggccaatgcttttacacggataaagcgcctttatcaattataaaatgcccgtatttactttaatagtgcccctgcgggctctattttcaaccccccccccctccaaaatgcattcaaatttctggccaaaaaaattttttgcgtgaacgtaaaaccactgctgtgaccgagacctgagactgaaaggtggtggcgcttaatttccctcatcgctcttatctcggcgccaaacaatttgtgtcacaactgatcagagaggtgagaatgattgattgatcagttttggcagagagcagccccacttttcgccactctgttctctgtgttgtgatgggccaatattaggagaagcagcggcaagaaaaagcacaaagatcactccactcactcacccatcgctccgctggtctgatcagatcagctcagcccattagggctactatcattttcaattgggattgtattacataatgggcggggactttttgtcgcccccccccgtccccgcatttttaaggaggattaagcgatgggccatcccaacaaattttccttctgtcatccaagccattcattcattcatccatccaatccatcaacaatccgccgaaaatgttgcaaaatgaatttttttggggaatttgtctcggctttagccaccttaatttagggctttccatcatttatagacccaatttccagttcacacctatgtatttttgcctgttttttatataagtaattaaatttttttttcaaatttctgttagaaatatatttttgaatttttttttaccgtctattttggcatttttcaaaatttcttcatgaaaattcagtaaaaaatccaaatatatcc

SEQ ID NO: 44256 - DNA, 667 bp, Heterodera glycines
ccccccatctctctctcatttccttcccccccctcccttctctctctctcaatttcttatcgctctctctaatcatttctctctctcttttcctttctctctttctctctcatcacttcactctctctcgcttcctctcctttctctcctcattatctctcttcccccatctctctctcatttcctttccccctcccttctctctctctcaatttcttatcgctctcttttcatttctctctctctctcttcctttctctccctctccctcctttttctccctcttcttcttttctctctctctctcaatttcttctctctctctatcatcacttcactctctctcgtttccttcttttctctctctctctccacccttattctctctctcgattcctctcttttctcctcctttctctttctctcacacacacacaaaacaaaaacgaaaaacagaaatgaatagatattttgaaatatgcatgctgtgaagcaaaaaaaatatatatttgtttttcattataattaagtctgactcttcttctttttctttttcttgtgttcttttttattttcacttctttttattaaaagaacgaatcgccataaaagaacgccaatttaactcaaccaaaaaaggggcggagcttcctctcgcttattatat

SEQ ID NO: 44257 - DNA, 1347 bp, Heterodera glycines
ttcgccttgttcgttcttggcgtcaaaacggaacattgcctcaaatacgtcggaagccaacttcaaaatgggtttatgagctgagagaaccttaagattgtagacgtaaaaaataattatttaaaaaattaatacttttgaattaagtggagatcggtattttgcgaaaatactgatcaggactaaggactaggcacccatacggattacggactaaaaatccggaaactccgggcttcgtaaaaattcgttttatccaggaaaaatacggatgcgtataaggataaggatttttttaatttttttcttttttgattaaaatctgcccaaaaaaactacggattacggactacggatccgtaaaaatccgtatacggatagatccgtacccgatttctagaattaacaaatgaaatgaaattaataaacaaattactcgcctttttcccgtctccgtcccccaccaaaaagtgcacatccgcgtactctcccgtgctcagcatcaaatttaggaaagcaattcccgctttagacatgacaatttcaatgaaaaattttcgtcctttaccaatggcaagtaaaaagcaaattttaataatttttagagttaataggctccgattaaaagtgattaaaaatgaacattggggcaaatttatttggaagggcaataaaataatatatatatatatatatgatgttgaggcaaaataatgacctaaaaatgaacagaaagcaaagaaactttgcaatgtaacattttgtttcagggaattgcgaaaagcaaaataaaatcaaaaaacgacaagaaaagcactgaaacgacgagaatatgagatataaaatttattaataaaattttgaaacaagtccgggcccggcgggcgcccagacaaaattttggaccgtgtccgggccgcccgtttaaacgagcttttttgaccgggcggcccgggcccggccaattgtcgaagcccgagcccggtcccggcattttcaaaattccggtctcaaagcacaatatcattgccattgacactatttgtgccacaatattactgcatttacaccagcagatcggaacggaatgtcaaaagtaatgccaaaggcggaagataataggtagaaaaaatatgggattatgaaggttccgattttgcccaaattccctgtcctgcttgattaattttacgtgaaaaccaaattagcttttgaattaggtttccgcccccccccacctaccaaaaatgacaaaatattttataagatgatcaaaaagggacacaaaaaatttatgatgtcttaatagagtgaaatttaattagaaattctgctgctgaagcttca

SEQ ID NO: 44258 - DNA, 935 bp, Heterodera glycines
tgtgaccaaaaatgtctgaaaacctggttccttggtcctcttaggccataattttgttcaaactcgacgaaatttgtcctaaatttagatgagcttgtagcgaattctatataaaaacatagtagtccaaaaaagtagttattggaatttgtatgatttcacatacatctaaatgaaaaagaaatatccgagaaggaaatttgccttttttgaaatggacatttactcgcaatgattttttgtcaagaggtgatttttttgctaatttaaaaatggcaaaagctttttccatgacaatgagaatgatcatctgatgattcccacagttaaagtgggcttaaatgattgagcgttaatggcatttaaatgataaaaggcaccacatcacctgttggtttttagttattcccttaagggaattgtaagtaatttaaggtgaaataacggcttttggctttgaagttttattagtgctgatatcatttcgtaaaacacttttttaattattattgagtaaatgagtcataataaatgaaaaatatttgggaaatgagcgatgcattaaagaagcaatcacttcaatgatttaatgtcagccgaactgatttaatgatgggatcgagttgatccttttataatgagaagataattaggaaataaaaatctatttaacaatgaataaaaattaaatatcacaagccttcattcttttttggttttatttcagcttattctcgaatttccaataatcattgaatttttacaataaattttataagggattttcgatagaaccgctttaattgagcccattttgccccccccccccgcccgccgcccttcccatcgcccaattgtccccggcgtggaacggttggccaaataagcaaacagaaaatatttttgggctttttaggcttttgcccccccccccg

SEQ ID NO: 44259 - DNA, 1045 bp, Heterodera glycines
  misc_feature (1021)..(1021): n is a, c, g, or t
  misc_feature (1040)..(1041): n is a, c, g, or t
aaaaagagataccctttttccaaaatttcccgttcaaatgcgctgagaaaaaatttccagaccaattagttcggcgtcattatgctgagaatgcggtggaatttcccttgactgtaggacagaaaaagagatagccatttttccaaatttttcacgatcaaatgcgctgagaaaaaaattccagaacaattagtatcggcgtcattatgctgagaatgcggttggaattcccttgactgtagaccagaaaaagagatagccatttttccaaatttttcacgatcaaatgcgctgagaaaaaaattccagaacaattagtatcggcgtcattatgctgagaatgcggttggaattcccttgactgtagaccagaaaaagagatagccatttttccaaatttttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaataattccagaacaattagtatcggcgtcattatgctgagaatgcggttggaattcccttgactgtagaccagaaaaagagatagccattttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaanaattttcacgatcaaatgnncgct

SEQ ID NO: 44260 - DNA, 1170 bp, Heterodera glycines
  misc_feature (1057)..(1057): n is a, c, g, or t
  misc_feature (1065)..(1065): n is a, c, g, or t
ggagtgatctgataatgagtaaagcaaaataaaattttgttataaacatatgaccaccgaaaaatggagtataatggtcctaccaatgtcacttcagtgtcaaagaatattttcgtcaatgagtgatactattagaaagcccacaaaaaaaatgctacaaacaaatgccaaaatattttagtcatccttaaacgtttaaccttttatcgattgaaatttcaaaaaattaaaagtggttataaacatatgacatgactgtataccttgttaagatgtttctaatttaatattatcaaatttgctttctttaattaataaatttggttttcgattgcactaaaaacaatgggaaaaatgcaatttttgtaattttatttatttttttaaagcttttcattaaagtgactgtaagtcatcttttattaaaaaaaaattccactcatggagttctttgattgtttggcgatattgtaggtgcagtttcgtccgtttcacaacttgtttattcttaaaattataaattattataaatcgtagttataatctagtttataaattatttaaattttatgctcatatattatatttttgatcccaaatgcgattaggtgaattccgtagacttcgtcattcttatcttttatagtaagcttaagaaaaaattttaaaaaaactgtctaacaataagcttaattattccattgtgggttgtactcctcatcttaatttttaataaatcttttttataatttttaatccaactcgtgtcccagattcttccaaaatcattatggtctttgtgtgtatattataatatattattttataaaacaataatgctaatgaaattttctatatcattttaatttagttttattgtattatgttcttttgttttaatttcaaatgaaagatggaatataaagggtaaatttaaatagatttgtttaatttaatataaattaaatttggcaaaggtttaagtgcagtttgatggtgtcgaacgagcttaacagataattttattatacaagataatcttcaaattactgcctanattttganagcttattagaatataattttcatattttatttattttccataatttttttagatttagttaaatcagcaaaactaaaacaacttccaaattattattgaggcag

SEQ ID NO: 44261 - DNA, 1051 bp, Heterodera glycines
ctttaattttgcgtgggattttgctcccccatattggttgagtaccccaaacggacccttgaaaaaatcgtttatttttgttttcgggcagtccccccgaaccgatgcgcccagatttagggggagaccgaatctttcggggatagcttccctatagcctgtactttaattctgcgttggatttttgctccccataattgtttgagtaccccaaacggacacttgaaaaaatcgatttatttttgttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcggtggatttttgctccccataattgtttgagtaccccaaacggacacttgaa

SEQ ID NO: 44262 - DNA, 1146 bp, Heterodera glycines
ccttttttgaaaatcaaaatttttacaacatattttagggtttgaattcgctgatcacgaatcagcacacattatggaccatgacaatcaggctgtataagccaattttaaattaaaaagcaaataaattttgttttaaatttttatttttcagcaggggaagggttaagaaagtacaaattttttgtttttgtaatgtttatgtgaaataaatttcttttgcttcttcatggggacgcatttgcgtttctgcttttgaagaattgatggatctgttcctcgttcaagtgccaaccgtcgcttgcctccaaatgctcggccaggtctttcacttcgtcctgaaatcatttgcaccattcacaatttaatgttttattatactcaatttaacctttttgttattcactaatttctccactcgtgccacacattcattcaatttccggtccacaaatttgtccaatttgtttttcagtgccggtcctggtggggcaacctcaaaaaggaattgttttaagacatagagaagtaacatttttacagtaaattcgcgcaggcccaattcgtcgtaaaacattccgctgtttaccatgtctaatatcatctaaaaaataattattcagacggtgaacaggattcgtgtgttttcgaatgaaaaaaaacaaaatcaaatatccccttgatccattgaaaaacattttttcttaccctcgttgccttgcgaagatcatcggttgaaccgtcatgttttttaccaaacataattttttcgccaattgtcgccgaaattcggaaatctatctcgaagatcatctgttctttggtcttgaccgaagggcacaagaatcgccgttttgtctgaattaggtaattacgattattattataataggtatgcgtgtttaatgacttaatttgaaaatgatgtaacagtggtcccataaaaaggaaaaaatgccgaaattccgaccccaaaacgtttaaaatcatatttctttatttgctcgacaaaattaatctgatttcttcattaatcttttttttgtttgcgctgtcaataggcaccgcttggtattttttgaaaataccagtgcaaatttttaacagaatttgtacaaattttgaaaaaaaattttcaaccatatc

SEQ ID NO: 44263 - DNA, 1618 bp, Heterodera glycines
  misc_feature (42)..(42): n is a, c, g, or t
ggcaagtctgtgccagcagcgcgggtaattccagctctcaanatgcatagaattatgctgcggtaaaaagctcgtagttggatctgtgctagccgtccggtgcacactttgtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacaattgcaattattgtccgagaacgaagaattccttgtaggggcgagtcatcaactcgctctgaatacatccctgccctttgtacacaccgcccgtggctgcccgggactgacccatttcgagaaattcagggacggatagagtaccggcttcggacggtatgcatactgtaacctatttaatcgcagtggtttgaaccgagcagaagacgaaaccaagtaactgtaagtgaacctgctgctgtatcattaccctagtgattcctattcaccacctacctgctgacctgttgcgctagcgatggcaccaccaaatgcccccgaccgctgatgagcacaggtcgtacgagatgacttgtggacgctgcccaacattacgggatagctgcctcacaagacatggttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactga

SEQ ID NO: 44264 - DNA, 627 bp, Heterodera glycines
cttttcgagttttaaaccagtttaattgcttctgatcaccttctttcacccctagaccgatttctctcatcgttactttcaattgaagaaacggaactgcttccatttcagtgcgctgtttacacaattacggaggcgcagctgaaagcgtatctgaagatgaacttcactgaggcggtgatgctggcgagggaaaggccgccgtatttggtgcaaaggtgcaaacagtgggaatatgacagaagcataatgaaaggcaagcgaaggggagacaaatggacacggacaaacgaacaaatgggcacacagacaaacggacaatccaccaattgaattttaagactcagtggtcacacaatgggacagagtgtgcgacgacaattggagcagaggtgagcacgaatagagtaaattatgcctgggaatcaagggcgtatctagggggggggggtggaaatgaagtcagagttgcttgactctgaacccaggcgttgaatgttatgagctacaggtgggccatttttggtaagcagaactggcgatgtgggatgaaccaaacgagcagttaaggtgccaaagtgcccgctcattagaccccataagaggtgttggatgatatagacagca

SEQ ID NO: 44265 - DNA, 568 bp, Heterodera glycines
ccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggattaaaaatttttaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaat

SEQ ID NO: 44266 - DNA, 917 bp, Heterodera glycines
aagttttttacaaccacttattgccaatttaatttcttgcagattgaaagccatccattgcctgccggttctcggcacagtaaagcactaatagggtgtttgattcacttcaaaaaataattccttacacaagttttttacaaccacttattgccaatttaatttcttgcagatttaaagccatccattgcctgccggttctcggcacagtaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagtcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacacaaaagttttttacaaccacatattgccaatctaatttcttgcagattgaaagccatccattgcataccggttctcggcacagcaaagcactaatagggtgtttgactcacttcaaaaaataattcattacccaaaagttttttacaaccacttattgccaatctaatttcttgcagatttaaagctatcca

SEQ ID NO: 44267 - DNA, 992 bp, Heterodera glycines
attaggtgctgggacaaatgctgcttcttggggacccgcaagtggaagcaatatgatgatgtggactttacaaaattcattcaaaatgaggtaggatggtaatattatgatccatccctagatgggataactaaaaataaatatctggctgacacggcagcaaaaccagatcttgaactaatgagcagatgatgaaaaataattatgaaattcggacagcagtaaaaatggaaacctaaattaaactcttataaaattagaatgagcaatttgtaattaaagcaaaaaatataattgaatgctctaattcttcaaaatcttttttggtccaattttattagccgccccaaaaacgtttcgattggtgggctctgccgaagggaactgctccgttggatagtgctcgtctgtttgccaaagataaaaaatgcattggcaaaatggtaagacgacgcattcatcgtgagcaggatcttgctgaaaatgagttggatatgtcctgcaaggcaatttgtagccgagatcgattttggcacggtgccaaggatgaacaacaaggggagcaggatgagaaggagcatgacaattgcccaatggcacaaatacgaacagtgtacaaggcgggatatggccgaaacgagcggcgccgaaacgagggtgtcccttaaaaagaggacctttttgaaaattttttcactttttttgtctaattttttttgtttaaaaagtcctgaagccaagtacccgggagttttagaggtcgctgatcacgaatatgacaattatttgggcctattaatcaaatttggcgctagttataaagtctcagaatttgaacaaaagggggacccttttgttttgcaaaaattttttgagataaaaaatcgtgaatatactttttattcaccataattgtgcttaatgctcatcattatatgtaaataaacaaaaaaaaaaaattttttcaaaaaaaattgaaaaaattttcaaaa

SEQ ID NO: 44268 - DNA, 770 bp, Heterodera glycines
agatataatttattacaaaaaatagaaattttatttcccttaaaaatccgctcgggtatgggggcgcgcgctaacattctcatttcggagatggtccctttattagatgacaaaggaaaagagaaaaataacccgaaaatttttgaaatttgaagaaaaagaaaataaaaaattataattataattataaataattgtttaaatattttttatgagaatgtgaaaaaaagaatattcaaaattgtttgagttttgagaaaattattcattttgcctcccgttataatttagttcttgtcgacttttttcgacacccctcccataataaaatcgaaaagttttctgaaatgaatctcaccaataaaatacttatccacctaaattgaattagagtgcccacgtgcatcgtgaggtggtaaagagtagcaaattagcacacgcattgtcggctcacaatcagttgctttttcaaacacttcccaactaccggaaagtgaaaagagtgagtaaaatatttcagtaaataaaaataacaaaaatttgaaaatggaaaaaatcgatgactaattgacaaactgccatcgcgcaaatttggttgcaaaaacaaatatatttcagttttaaatcagactgataaaaatgttttgtggtaaggtaaataaaatgagttacaaaaaaaagaaaactcagggatttttaggggattgttgagttcactgtaaaaaagtttttcttttgcattcaaaattcaaagttcgcgccttttttga

SEQ ID NO: 44269 - DNA, 861 bp, Heterodera glycines
attgacaacaaatttaaaaaagtgaaatttctattaaatcgctaaaaatttaactaaattctatattcttaaaatagtattaggtatattaattgtatttatattttaatgtgatttacataaaccagaccctctgtttcttgaaaaaaaaattaagatttttcaaagcatctttcgcttaaaatatttttccgatttttctttcagtttttaaggaaaaaatttaaaaaatttggaaaaaccactaaaaaattataaaaatttatatttgtagatacaaatttggacatcccattgcatttggtggacaattcgtttgaggacaatttggcgcttggccatggtcaccaatacatggaacgattcggttaccatgacggcaatgaacgcgacgaatttttgacaaaacgtccgaaacgacaggcggtgataataataaaaacaactaattattccttttattatttttaaataatcatttataaacattttcacataataatttcttgtaaagcaaatttgattataatttcgcttcataccaaccatggacggtcccaggatttcggcttggggggggcggagtaggacaaaacgtcgtcggacgaatttttggaccataacttttttcttacttaaccaaattagacaatcttggtaatatttgaaagcttttgaaaaatgctattagcctgcaaatttccaaaattttttatccatacacaaaaaaatcagagagaaaaaaaagttcgaaatactaggtttttgagttccttctggccataacttttttgctaacgaaaatttttgaaattttgcaaataaataataaacacacagagctgtcgaaccacaccaaca

SEQ ID NO: 44270 - DNA, 889 bp, Heterodera glycines
cttgcctaattcaacgtaaaaaaattctaattataataaggaacgatttccacctccatggcataagtaatatgcgagggaacaagagacaatagacaatcgagaatctaagactgaaccgagaatagaaagtaggtgcgaaatgcagctgactgacagtatgagacgagaaagggcagataagggctaaatgtatgcgacaagcacgtctagtaataggaataaatagaaatcatatgaagatatggtagtgcaccatcggatcaaggacaattaataatgggtgtaagagaaagagatagagagctcaagaatgtaggagaagagagtcaaaattccatagtgagaagataatacgagttagtaagacaaacagtaggtaatgtatagggaagagaatagttagataaagaacacgaataccaacacttggaagataacgcttgtgagaactaagcatagacttggaagaaaagatactgaataatagcaaacggatatagctcaccctcccaatatgtagtatctatctcaatacgcaatctccgttacctttctcccttacctttgaatctctccctccccttctcttttctctttctccacccccttctctcttctctttctcccttccctttctatctctccctccccttctctcttccctttctccctcccctttctatctctccctccccttctctcttctctttctctttctcactttctcccttccctttctcccttccctttctatctctccctccccttctcttttctctttctccctccccttctctcttctctttctctcttccctttctccctccccgttcgatatgtgccctcagccttctccctccccttctctcttgtctttctcccttga

SEQ ID NO: 44271 - DNA, 993 bp, Heterodera glycines
atatatcaaaggaattgataatcagcataaaatgggcatttggtcatccatttggccacaaattattttgccaggaattttcgcattggtctccgttttgttcaatttttcgttaattttggtcacttttacgaaaatgtgagatttaaattttaaatttaattcatttttgatttttaagaaaggatcacaaggtgtgcaattggctgttggccttcgattcgttttgccaattgtttttcgtcgctcctttccttgtcaattttttggcccagattttacagtacaccacagttgattaccgtatttgtactggtagtcttatggcatcaactgtggcatcgtatgcctcttttttggcactttttttgatctctgccgaacgtttattaattgttttgttcccaatcaagtaaatattttttaaacaaatttaattatcttgtatatatttttttagaatgaattggatcaaagaacaaacaattcgacgattttctttgttttttctttattttctatcctttttggcgttatgatgatggtctacatattgtatgaattgactattatcactgtgccctttgaaaggcatacaattttttattttaaattttacagtaataattaaattaattacaaattcgttattaaatttttttattcattttaagatttgttttctgcaactctggtctttattcggacgtattgaatacaacaatttcaaaaatcattctttcgctgtgtgttctcaattatgttggcatttctttcaaaattttatggcgttatgtcaaacttcaactaaaaaagaccaataatttagcgacaattgttccaagtaaaatattagaaaacaaataattcatgtaaatatacaaccattctaagcatctgatcattcaatgcgcagaatgttacggtcagttttttttgttgtcttttgtcattttgatcggttggctaattgcgacggtttttcgtaatcaa

SEQ ID NO: 44272 - DNA, 933 bp, Heterodera glycines
tgtcaagtttaaatgcgtcaggatttctcacctccgtttgggcgtggcctccaaatggcatcagttttaagcatttccaacaatttgtcctgcttggaatatttctggacctgaatttgaaccattgatttagaaattaaaatgtcgccttacttcaatgaattgttggtcaatcgtttcgacggccgagttgagtttgccgaccgttatgaaaatgtaattgttgcgaaggaaattgctggcggtgttttgcacggtgatgtcgaaagtggcactgaacatcagaacacggtgacttggattctaaaacagagagaggagaaggataagggaaaaggttggaaatgtacacaccaaacagcccaaaaaacagggggggggggggagtggcggttattttgtttttaccaaccccaatttggtaaatggcattaataaatgtccctttttccgaatacgggtcgaaatgactcacaatggtcggactgcccttgagttgcgcaatgcattggttgaaatgatcacactaaaagcaatcaattgccccttttcaacaattcatcttcaaatcgcacagtgagcagtttgtccgcttcgtccaaaaccaaaaaacgcaaattttccaattttatggtgccctccatgacaaaatgcaaaagacggccgcaggtgacagcgcaaatgtcacagcccgacgcgatcagtcttcggctttctctcattggcatgtcaccttcaaaacgcaaaagaatgaatttattactctttcaacaataagcaatgaataaattaaaaaaataatggccaaaacatacaaaattgaacctcagttttccaagaaaacaattctcaaagaaacactacttttgataaatttaataaatatgcaaaaatttaatgaaatttcttgactttgtgtttttactttgaaaa

SEQ ID NO: 44273 - DNA, 1537 bp, Heterodera glycines
  misc_feature (1000)..(1000): n is a, c, g, or t
  misc_feature (1525)..(1526): n is a, c, g, or t
aatgttgggctccaagtacaattaagttggatttttcatcttagtggtctgtgagttagtcatcaaaagagggtctcaggttaaaatcctccttgtgtttgtgtataaatttcaattttttaaagcaaataaataaatatacctaatcaattacagaacgccaaaataaaataaaaatacaaaaataaaagatagcactatgttttaccaatgattttataaatttttttagtttatatcttggtaaatactagaccaaataaaaccattttatgctcattttgaagggaaaattctgaagaatattataaatagggcttttagttttttaactatttttctgcggctttatttcgacgagaaatgcacgaaaaacacatttttagctcggaaattcttcgttttaacgccactattcatcactaggaatcactattttggagctttgccactaaaaaaaattattttggaagttggccactaaaataattttttgccactattttgacattttttggaaaatttcccaaaaatgcaataaaaatgaaaaatataccccaagaatcgacctaaaaaattcaaaaaatacaccccaaagaatcgaactaaaaattttcaaaattacacccctaaaaattggaaaattttctcaaaaattcgtccccccttttttttcttgctcaatatttgctaagaaaatgttttgtaactgtaatcagtgaataaatttgtttgccttaattttatattattttcaaatttaaaaaatagcaatttaaaaaattacacccccaaatttagaaattttcgccactatttttgccactattttgccattttttttgtcagtatttagttaattattttggggttttttgccactaaaaatcccagccctaattataagttagtcaaaagtttaaaaaaaaattgtctattggcaaataaatgattcatgtgttattttatatgttagtgacagggaaatagtacgccaaantgagagaaaaaaattctgtccagttgaaaaattaaaaccgataatgggaggtgaaaaatacaaaatttgatactatacttaattgcttaaattgttacactagccgatttaaagcaattttgcaaaatgttaagattttcgaccccaaaatctggttttttaacagttttttattttgaaaattacattggattacttaatgaaatttgaacaaaagaatgcgatgaagataaacatagaacctcagctgtttttacatatttaaagaaaaatacaccaatggttaattaatttgattttttacttaattagtttttttactatttattccctaaaaacaacgaaactgaaagattaacaaatgaaatgaacttcttgattctttaacagatttcttctatgataaaatataatagcaaatttctttttattaatattgcatataaatttttttattaactcttttatataacaaaaacacacaaccaattaatattggttatactttccccactggaaaggaannatgccttcctt

SEQ ID NO: 44274 - DNA, 878 bp, Heterodera glycines
ttcttcgagcataaatttctataaaaaaaaatagtgccatagttggacagagaatatttgttattcagtatttacaaatatacaataatatacatatatggtatgtacaaatcacaacaaaattcacacaaaatcgtatggcattttaacttcgttttgctcatttttctcctccgtccgtccgttcctttctttttccgtcgccgttcgtcacttacagcagcagcagttaatgcatttgaccaaacaaatcacgaggcgaacaaccaggcaaaaggcgagaagcgacaccagcacaatgaaccacgtgttcagtctgaggcaacaatctgaaaaatgttgggaacggcattcgaaaatggcacttttatattcaaaataacggcacttttccattcagaatggcacttttcatttcaaaatggcacttttccattcaaaatggcacttttcatttcaaaatggcacttttccattcgaaaatggcacttttcatttcaaaatggcacttttcatttcaaaatggcacttttcatttcaaaatggcacttttccattcaaaatggcacttttccattcaaaatggcacttttccattcaaaatggcacttttcatttcaaaatggcacttttccattcaaaatggcacttttcatttcaaaatggcacttttccattcgaaatggcacttttcatttcaaaatggcacttttcatttcaaaatggcacttttcatttcaaaatggcacttttcatttcaaaatggcacttttccattcaaaatggcacttttccattcaaaatggcacttttcatttcaaaatggcacttttccattcaaaatggcacttttcatttcaaaatggcacttttccatt

SEQ ID NO: 44275 - DNA, 989 bp, Heterodera glycines
  misc_feature (871)..(871): n is a, c, g, or t
  misc_feature (968)..(968): n is a, c, g, or t
ccagaaaattttagacaagaaaaaggtcgagagtaaggagaattttaaccccgagggaatcaattcacattcgaaactgaattatgagccagaatttgactctaaaaattttttaagagccgtaatttggaaatccgaaatttttttgggtctccaattcagcgcctgtttcacaaaaataactcatgaaaaagagttgatgtcgttcatctgccgggatcaagaatttccctcataatccgaaacaaaagagagaatagtctgtcccaaaaggcaaagaataggcatggaaatgtgagaccaaatttccccatttcttgccttgtacactgttcgaatttgtgccattgggtaattggcatgctccttctcatcctgctccccttgttggtcatccttggcaccgtgccaaaatcggtttcggcttcgaattgccttgcaggacatatccaactcattttcagcaggatcctgctcacgatgaatgcgtcgtcttaccattttgccaatgtattttttatctttggcaaacagacgagcacaatccaacggagcagttcccttcggcagagcccaccaatcgaaacgtttttggggcggctaataaaattggaccaaaaaagattttgaagaattagagcattcaattatattttttgctttaattacaaattgctcattctaattttataagagtttaatttaggtttccatttttactgctgtccgaatttcataattatttttcatcatctgctcattagttcaagatctggttttgctgccgtgtcagccagatatttatttttaattatcccattagggatggatcataatattacatctacctcattttgaatgaattttgtanagtcaacatcatcatattgcttcacttgcgggtcccccagaagcagcatttgtccaagcacctaatgagggatttcaaattaatgatttataatccngcaaatatgatggctcatttt

SEQ ID NO: 44276 - DNA, 1149 bp, Heterodera glycines
ctttgacttcgtgatgggccccagcgcccttggcctcttatttcacaatgggccccagcgcccttggcctttgacttcgtgatgggccccagcgcccttggcctttgacttcacaatgggccccagcgcccttggcctttgacttcgtgatgggccccagcgcccttggcctttgacttcacaatgggccccagcgcccttggcctttgacttcacaatgggccccagcgcccttggcctttgacttcacaactgtccgatcatcggacagtcgcggctgaattcgagccgcgacattcccacgcttgaccaacgtgaaggcgaggcgcggaaggcgaggcgcctcgggtcacaaaagacccaaggggccgtatggcgcgcagagggaggcacctcggattacgaaaaacccgaggggccggacgcgcaaggcgccacgggttacaaaaaacccgtggggccctactcccccttccctaccaaatctccaaaaaccccaccaaagtttgtcctgccagggtcgccacttgttgcggctcggcccacaagccgcaacgggacagttcgtcgtccatggttcggggtgggggtaggagaggaaggagcgggggaggggctaccgaatacccaattgctgggtttttttctctttattcggtgtacgatcggagccactgaaatgaacaattcatggggcttaaatacgatcacatttgggttgggcctacatacaaaacatacaaagcaattaattagagaaatgggctgatcaaatgggctgtctttttctcttccttctcttctttcttcgctgtgacttccttcatttgcggcagaacattcacatgcattgcttgatgttgtctcccttcacgtgcactttttgtccccatcggaccatgtttgggcggggagggccggtttctgctgtcgggttggctgtgacagctgtttttcatcgcagcttactgttcattcatgtgcgccgcttggtcgattgagctgttattctctctccaaattgccacttttttgcccattttccatcgtttcatcgcccactgattatttttccccttttttgctctttcgctcattgctctctttccaatcattaactgtccgttccacggacagtcgcggctgaat

SEQ ID NO: 44277 - DNA, 999 bp, Heterodera glycines
caagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttgggcaagaatttttttcgttagcatttcaaatatcgtgtgagtgtttggtagagccagact

SEQ ID NO: 44278 - DNA, 365 bp, Heterodera glycines
  misc_feature (24)..(24): n is a, c, g, or t
gagcatagtaatctcactttttgntttgcccttcactttcctcttcctctcgaattccctcggaaattcccaaaatttcccctctttggtcggaaattctcaaatctccccgtattatttccaaaattcccattccaagtccgaagctcagctatttgttgtttcaattgatccattaatcttcctctcggggaagcttcttcttctctatctcaaggctattgagcatccaggaaaaaaacatgtatttacataaaaaaggaagccctataaatttgtataaaaaaggttaaatgaaaatgtactttatgaaattgttttgtatgattaaacataccaacatgaataagttcataataaatttt

SEQ ID NO: 44279 - DNA, 1469 bp, Heterodera glycines
ttaagttgtaaataaaatttggtgcgctttagagctctttctgaaaaaaatatttatgaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatattgaaagcatctgagtgcctaaaataacttgtaaataaaatttgatgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgataagtttataaaaaaaagttaagcctaaaatttttcgcatatttaaaaagcaattaaaaatttttagattttttattcatctccctttttgatattgaaagcatctgagtgcctaaaataacttgtaattaaaatttgatgcgtttcagagaagtttctgaaaaaatatttatgaattaattttgctaaaaa

SEQ ID NO: 44280 - DNA, 923 bp, Heterodera glycines
aattaaattccatcctttggctactgaccggcattaaccacgggcagttcctgcaacccaattgcggacgcgcggacgaacggagacatcagacccaacttgacaccatgcttcttcgtgaacgcctcttggtactgcttgcgcatccgtaccacgttgtacagatcgacctgaaaagagcaaggaataaaaatgtttaaaaagataattattctatcattcgatttgtttttttattagaatttttgttttgttttttgtgatgcaaacggacaaatcaatttattaagatttttaaaaatagcaagctgtataaatgtgtgactcgctacaaacattcactcatgtcacccgcctcccccccatttgtgttgacctcgttgaacgtggtcagcatggcgctggtgttctgcgcctccttcagccgctccgctattctcagtctcatccggttcatcttcactcgcgtttcgctgcgttgtccagtgatggcggtggagtcgccggcgggagcgtgcggtggctgctgctggaacttgggcacttttatttcggagacgggctttgagctgatcggctcctttggcagtggcggcattttcgactgcatgggaggagctgagaatggaagcactctttaaaaaacaaacgaaaaaagtattggcaataaatcatcatccaattaggccaatgggtcccatttaattttgagtattttctaaattcctcgaaatcttttcaaccattggcattagagatcggataagggccgggcccgtatacgggttttacgggcccctaacccgtatttttttcggccgatacgggtttttacgggttaagggtttttagcccgtaacccgtatcgatgtcaagcccgtaacccttacccttacccgtacaatctgaaaattccgatctct

SEQ ID NO: 44281 - DNA, 1561 bp, Heterodera glycines
  misc_feature (1438)..(1438): n is a, c, g, or t
  misc_feature (1528)..(1528): n is a, c, g, or t
  misc_feature (1544)..(1544): n is a, c, g, or t
ctgaacaatacgattcatttctttctactaatagcacttgataagaagcgagaaaatacaaattgaattaattaattatttcctgtttgttgaaattgaattgaattaatcagtaatgatcagttggcaagtttaaatattcatttcttatctactctaattgcgtaacaaacaattaggttttgattgtgtattccaaacagtcgatcaaaatcaaaagaatgaaaatgtgatcaaacaaaaaaaaaattgctcctggcccttatcagcgagtgacgttacgccaaaaaaacgaaaattttgttttttcttgagttggtttggtttggttgaattgtatttgttcgtcaataaaacgtcaacgaaaaaacaaagcctcaaagaatgacaccgttgtgagaaatttcatgtgacgttgaaatttgaaacttcaatcaacttcttattttaaattaaaaaaaataaatcctctttcatttagggaattttttgtgtgtagataaacactaattactagggccgcaacttttagtgacgaaaaatctcgaaatagttaactaaaatagtgagtaaaaatcccaaaatagtgaagaaacagtgacaaaaagtccgaaatagtgacgatagtgacataattttcagccaaaaattgagcaaaaataatttttattcactgattgcagttgcaaatgagtaggactgggatttttaagaccaaaaacccaaaatagttacctaaaaattttttaaaattaaaaatttttgccaagtaaatttttgagaaaatttttttcatttcataggagttttgaaaaattttagctcgattcttaggggtgtatttttttgaaatttttttacgtagatttttaggggtgtattttttggttttattgcatttttgttaaggaatttttcaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaatgcagaaatgcgttttttgagctcctttcttcaaaacaattgagcaaaaaaaagttttttcactaaaagttgcggccctagatatcattcagaaaaggactttcgaataataattaaattttcaaccggcatcctcagtagttaaataccggtggctctttcactactcatcctcgttaccgtacccctattatgagtcaaatactttttctttttattttcctgagacaaaaatatttaatataaaaatgtaataatatattttaaaattattaaataatcataaataatcaatatttctgctatattgattttcatatcaataaaacattgtcatgactgaattcattcaaagctttcaaacatattttattgaaaatgcctattgngtatgtattttctaatatccatctattattattataaaaaatgggaaatttttatttgcttttagcgataaaatgattcgcttgtattanttattccattttctgntcatttgtctgacttct

SEQ ID NO: 44282 - DNA, 937 bp, Heterodera glycines
  misc_feature (703)..(703): n is a, c, g, or t
  misc_feature (920)..(920): n is a, c, g, or t
aataggcacctaaaaaggcattaaaaaatcgcaaaacactcattaaataggcactaaaataggcaaaaaaaatttttattaacgctttttaggtagcaaaacacaaaaattaatcaaaaaaaatattttgcttatatttcaattgttttaaagtttttttgttacaaataatttttttaaaccaaaaatttttatgaagaaaaaataattaatttttggggaagaatttttgtaaaatttttttcaattcttaggggtgtatcttctgaaaaattttcaagtcgattcttagggggtgtatttttcatttttattgcatttttgttaacgaattttccggaaatcctgaaaaattcgtcaaaaatggcgaaataggcacaaaaataggcaaataggcattaagcacaaaaagtccaaaagtgcgcaaaaattttaggcatttgcctaaaaatcgcatccctagtgatagttttatctgtgtgcttattcgatcccattaaatctttgttgccgattttaattaatcttgccaatctttttattgacgatgatataattcaatttaaaaaataatgactataattttacaccaagattactgtaaaatgcactgaatcacttgacttttgattattttcatttgtttgtttaaattaaattgaatattgaattaattaattaacttatttaaatattttattanaaagagtatacagaattaaaataaatcaaaaaattttttaaatttatttatttttattttctctctctctttttattattacctttttttacttgttgaacattcagcatttgcatgttgagttgcgaggatagctcctctctttattattatacgagacaatttaaaatattaaactagtttaattattttgtatatttactcatttacaaataangtattttctactaatct

SEQ ID NO: 44283 - DNA, 595 bp, Heterodera glycines
aggcaagccaactcgttcatttgtatgtttgtggccctaaagagggccgtttgggatatgaagattggggggggggaagtcgccgtcgccgcgcccgctcagaagttcggaagcgttgggtggggaccacggtacatgtaccgcacctggttgtgcacctgggtgttgcgcatggtcctgaatgagcaaagcatcataaagagagaaagggtaaaagcaaagaacacttaccgccctccggcgccgcgttccggatcgctgctgctcttcgcagacccaacagcgaacccattccttccatctctgccacgaggcgccgcagcagcacctgctcgccgggggtccagcgagtccgcccgtgaattttaggggtgtatttttgcttttttgaaaactagaattagggggtgtatttttacaaaattttcgccaaaaaattattattttttccattttggcctaaattgggggtccggcggtgccgataggcgcgccgggaaaatttttaagtattttaatgcaaatttgttcagaaaattgcttaaaatttcaaaaaatttactgaaaatttttcattttttgggtttcggggggg

SEQ ID NO: 44284 - DNA, 1321 bp, Heterodera glycines
caaaaaaccatttttaattcgttcaaattaaacaacgaactaacaaattaaagagcaattggaatttaaagaagaaatatggaggggatcaaaaacaaagtgactgtgaaacatttgttagacaatatttttgtagaaaaaatattggcaaaatttgaagcaatttcaatcaaaaatcgatgggagtgacgaaatgatcggccaccaaaaaaaaattagttttttgtgtgtcactcaaaatcttggcaaaatgagcaaacatattcaaaattttcttttttgcttcctttttttacctttttcacttttaagacgaatttgaattttagcgaaaaaaaattccgaaaaataagtcaataatattagagagcgataaaaatatttatgccaaaaaatattgaaatgattagcaattatgctaacgaaatggataagaatttctgagaaattcatggcaaaatttggaaaattttggcctttttatggtttttagcaaatattttgggggttttagtagcttaacaaccaccaaaaaacatgcttctttaaaaattcaaggaataaaatttttaataattgcacccctaattttcatgtttttttttgtgcatattttgcgattttgtgcatatttatgcgtatattttggccgccattgttcgtgcatatttttgacagccctgatcattaagtatatgtacataaaacaatcgcaaattaatattttattaggcgtcccaatgtttttttatggaaatttgaacactaatacttatttatgaagttgataaaacggcgaaatatgggaaaatatggaaaacatttgaagctaatgatgggtgggtgagtgattcacagattcatcggagagaattttgttcattttccattcaatcagtcaaatcaaaaagttttaaaatggaattatttttcacattttacattttccaattgtatattctagagttgtaataaattgataagcatttatagggttttcagcagttcccctgcaaaattgggttagctttcgatcaatctacaacgttgggtgataaaatgaaaaaaataatttaaaaaaataatgctggtgcgctaaggtgaagaactttgttcctccaggcaaaattctaagaaaatttataagcatttgtagggttctcagcagattccctgcaaaatttggtgagcttccgatcagtctagaatgttgggtgataaaatgaaaaaaataattgtcgaaaaataatgctgtactggtaagagtgaagaactgtgttcctccaggcaaaaaatttatgaaaatttatatgcatttgta

SEQ ID NO: 44285 - DNA, 1644 bp, Heterodera glycines
  misc_feature (16)..(16): n is a, c, g, or t
  misc_feature (29)..(29): n is a, c, g, or t
  misc_feature (58)..(58): n is a, c, g, or t
ccaaaaatgatcaagnaattcatggaccnaccaccaaccaatttatttatcgagtatntaatgttgttaggcacaataatacaaaacatatgtacaatcagagcagcagcaaatatcgagcgtgacaagcaaaatatcaaaatatacatggcgataaaacatacatatgtagtacgtatccatacatggaaaatgatcgaatataaaatcacatccgtccgattgtttgtgagccgcaattccctctcatcattgtcagtgccgtgtccatctgctgctgctgttggtctgtcgttttgcaatatgaaaatgaattttcttttttttcatttaatcagtcagtgaaaatttttaaaatgtcattttcacccttcaacgttccgccgcctccgttcgttcggctgtcgtggtagtgcgaaaaatgtccatcatttcggcaagtcctccttcttcggccaagtcctgtgcccgtttgccttaaaaatggaggggaaattgtgtacataatcaacaaaagaatgaagttgtttgtgcccaccgtcgggggttacttgggccgctgatcacgaatatggcatccatttcgaccaattcctaaaacaggacccgatttcgaacaaagaatcgaaagttaaattttagaaatttgggttaatgtctcgaaaacgacttaaatgcatgaaaacaaactgaaagtcatctttcctgtaataaaagatcatataagcattttttagacgaaaaattcgaaattcgttgaaatgcgaagttccgattttttgttcgaattctggtccgagtttagaaactggtcgaaatggatgtcatattcatgagcgctttcggtttggttcctttttttatttttgcttccgatttatctttcccagcgaccccgatatgtccataaaagatttttataactataatttaaaaaatgaaaaattactttttgaaaaatcttattagacttgatgaaaaatcacggattagatgaagtcacatgacagatctgatgtcatattcgtgatcagcggcccaagtaacccccgagtgggacaaacaatcgtaaaaaaccgcctgatttattccttttttatgggaccagtaaaagtaaccattaccgaaaatatgcatatagaaacacgggtcgatagcagttcgtaaaatggctgttgcggacgatttggaatgggaatgcacgtaactgatttgcactgctgatgtgcggcgaccacgggatcgacaacatttccgacacagcaatgtgcccccggtgttaaacattcttgatcagggaaccgatctgtacggtgatctttttcggatggtaatcgatccggaagggattaacggaggcagcggcggtggtgcgcaagtcataacatcagacgaggaggaatacggacgatgatagcagcagctggattttgttttttttactcttgattcactggggattctgtttttggcatttataaattgcaaaattggcactttattggtgccaatgcatttaaaaatttgaaattaattaaagaatatttaaaaaatagtttcgaaattttgccaaaaaggaattcctgatcatcctttaattgattgtcttttctcaaaatgattaagatttattaaaattcccat

SEQ ID NO: 44286 - DNA, 1030 bp, Heterodera glycines
ttttgatcaatttagtggaataaagtttgaaaaatagcaaaaaattaggagaattttatgagattcatttggaattgctatcttccaaaataaataagttattccagaatttctggaaaaattcgatttttcagaaaaaaattcagaactctgttctgaaaaagtattttataaaaataataaactcaaaaaatccgcaattttttgctctattttataaattttattttagttttttatcacttttttgaaaaaagttatagaattaaaagtgattttgtaatttgggaccacagtggtgtgaccatgatttttgagtggaaaatttttttcaccaaaaatcttccaaaaatatgattttaggggttatttgggccgctgatcacgaatatgtaatcagattttactttagacatggttaagacctcagaatccccgtgttattggggattctgaggggtgggagcgcccgtcctgaggccgcgaagcggccgaatatcccccaaaaaattagcggccgaatgttccccacaaaattaaaaaacgggcgcgaagcgcccgtcctgaggcagcgaagcgtccgaatgttccccaaaaaattaaaaaacgggcgcgaagctcccgtcctgaggccgcgaagcggccgaatgttccccacaaaattaaaaaacgggcgcgaagcgcccgtccttaggcagcgaagcgtccgaatgttccccacaaaattaaaaaacgggcgcgaagcgcccgtcctgaggccgcgaagcggccgaatgttctcaacaaaattaaaaacgggcgcgaagcgcccgtcctgaggccgcgaagcggccgaatgtttcccacacaattaaaaaaaggacgcgaagcgcccgtcctgaggccgcgaagcggccaaatgtccccaacaaaattaaaagacgggcgcgaatcgcccgtcctgaggccgcgaagcgggcgaatgttctcaacaaaattaaaaacgggcgccaagcgcccgtacctgaggccgctaattggccgaatgtcc

SEQ ID NO: 44287 - DNA, 972 bp, Heterodera glycines
  misc_feature (72)..(72): n is a, c, g, or t
attcggtctcccataaatctggggcgcatcggtcggggggactgccccgaaaacaaaaaaatcgatttttcnaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcactttctgaaaaaaaagttaagcctaaactttttggcctgtttaaaaagcaattaaaaaattttaaaaattttattcatctcccttattgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaatttttttgagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatt

SEQ ID NO: 44288 - DNA, 981 bp, Heterodera glycines
caccccaccaaaagcaaaacgatataaccaaaatataaggaaaaattttttaaaaaattttttctccatcttcctttttgatactaaagcatcggaaggctaaaattaagttgtaaataaaatctgggcgctttaggccttcggggaaaaataccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattatagtacaggctatagggaagctattcccgaaggattcggtctccccataaatctgtgcgcatcggttcagggggactgccccgaaa

SEQ ID NO: 44289 - DNA, 1399 bp, Heterodera glycines
cagcccgtgccgaattagactcaatggatttaccccctgtctctttggatgctgctctagggcatttacagagcagattcgaaaatgagaacacaaagagtatagcgagacaaaacctcgcgatttgcagacaatacccgggagaaaaagtttttgattttgccactcgtttaagtgaggcagttaggactgctttggccggggaaacggagggaaacattaggaaaagactgttggaagaatttttggatcggttaatccccgagctacaatacgaagtgaaatcggagaggccaacggactatagcagggcttacgaattagctcaacattatgagcttctccaggcgtcgcgcaagtcgacttcaaatgtggccatgaatgaacttattgaaaaagtcgaggcgttggccatgcaaaatgtgagacatgccccaaatttttctgatcagcgcgatcaccgggtttgtttttattgtaaaaaagcggggcatgtgataagagattgtgcggcgagaagaagggaagcaaacaatgggccaaattggcgaagagatgaaaacagccgtagaacggaacgcaatgggaattattctcggccattcgggcagggatatgaaaggaaccgagagacgtggagaagcggaaatagccaacaaaatagtcggccaaatcagaactatcggcgatacagagaccaaagtggtactagacgggaatgcgatcaagaaaatcgtttcccaagaacacccacaccaagagtaaaccctaggggaggcagaatagcaggtgcccgagtggcaagcccctactttttggcaataatcgctattttcggcagtgttctctccaacctcaatccttgcaaatgttccaaaacggcagccgatgatctgtttaccggacgctccgtcgagtttatcggaaattcgccagaggagccaatctcgccccacgtggcaaccgactgaaagtccgatcccgatcggaattaacgatttaccggccaaataacacttccaatataaaacaccggctcactgcatggtaaatgtgttaaatccaaaattcaccgcagagtcggagtttttcggagccccattaaaggaggtggaaactgagaatttggatatccctcacctcaacttcgccacagaatgagggatttaaaccatttccccagcgggagagctccagtaaaaatggaacccttccggtccaccattactcatggaagtcggatggcgagtatggcccgtaagaaggttttggcacttgacggaagtcttaaattgttatacctatgatacggttgttttaccaggtacggagttgaaggagtcagtactccttaaataatttgccagggtgtcagtacaaatccggtgcatgtcgttgc

SEQ ID NO: 44290 - DNA, 947 bp, Heterodera glycines
ccccaatctttcagtgttactaaaggcctaattttccctttgatttttttaccctcaccccccccccccccctggttacgtccggccttagagatttcacccctgttttctggttttaaattggtgacttacagcagcatggcacttggcagattttgtgaagcgctggagggggttggatgatgatgggcggttgggggcagcagctaaaatgaattaaatgattgcaatggccaaatgaatttaaaaaaataaattattcgttaattattttaattttttaccagcatttacagcagcatgggcagcagcaacaacttgaatatttaaattttgaatttatttaaaataaattttaaattgtttatattttttttctcaccatgaagcatctgccaacttttcgctgccatagttgatcagcagggccagtgccagtgtgataaatattttaaaaagcattttctttttaaatttatttaactgccttttaaattgcaaaaaaatttaatttaatttttaatcggaattgttaattattaaaatataaatgaatatttgcctcaaatgaatgatgatttgtcaatgaaaattgcaatatttataccattaaatgatttttttgaacaaacaattaattcattaattatccattgtccataaaagagaaaatttcggggaagacagacagacagagagtccattcaaaaaatgcgcaccccccacaatttttcgtcaacaaatttccataaatattttcctctgtttattggacacattctgctgtatttgtatttggtaaccacagaaaagaggaaatgacaacttcttttttttatttgtttgtccattttaacacaaaagattgaagcgaaagcagcagcagtatcagcgacaaaatggacaaaaaactgcaatgaaaattttggaccattaattatgatgag

SEQ ID NO: 44291 - DNA, 872 bp, Heterodera glycines
cccgttcgaggccgcgaagcggccgaaaagcacaacaaaaattagaaacgggcgcaaagcgccgttcgaggacgcgaagggcgcgaagagcccatcttgagcctcgatgtggactaaaaacccataataattttttaaaaattcaaaaaaaaatctccaaccaattcgatcaatttgaatcgcttcacagtctaggtagcgaagctcccaaagcgcgaagcgcttttgcccagctaaatagccgacggttcacgcacccgctagttactatatacgttatattgacaaggagtttcgttgctaaaaccattttctcccggccgaaggccgggagcgccctgaaagtggtggaagggtcttacaactttttgaggagcatccgggaaaaatataggttttccggtccaagggccaactgagtaccagggactgatttctcattttttcgtgcgtttgacggctcgtaactttttttctgaaactctaatcaaaaaatgtccgctgagagggggctaagttgaagtgttgtctaaaagtcaaaaaaaattccaggcctctacctatagtaggaagggctgcagaaaataggagaaattcagtaccaactttgtccacttcagtcccaggtgaataccgtgtcagcgtttgatctgagcgagggggctccagcggacttattgtagagttcaatgagctggatttttccagtttttaaaattttgaaaattttcaaatattttcgagttaggcctaaaaaacggttttcgggtttttgaattttaggaatttttaacgatttttctgggaaaaacggagaccacttccaaaacatcatttttcgagttctatcgactggtaatttttttggaaaa

SEQ ID NO: 44292 - DNA, 1132 bp, Heterodera glycines
aaatcctctgtgaaataaaatggcgattgtgcacagccctcccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagactataaatataaaaatcctctctgaaataaaatggctattgcgcacagccctccctctcatactcgagcgcttttgtgagtgtataaaatttctcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttttcaaaaaaagagatagccatttttctgggataacctctaaatataaaaatcctctgtgaaataaaatggcgattgtgcacagccctccgtctcatacgcaagcgcttttgtgaggtataaaatttctcaaaaaagagatagacattttttctgggatagagtat

SEQ ID NO: 44293 - DNA, 971 bp, Heterodera glycines
gagagagggtatcggagagaatggagagagggaagagagaggggatcggagagaatggagagaggggagagggaggggatcggagagaatggagagaggggagagggaggggatcggagagaatggagagaggggagagggaggggatcggagagaatggagagaggggagagggaggcactaaaaattcttccaatttttcccaatccccccttcattttttttctcttaaaattgacttttcagctcaatgttagcattccatgcgaggatgggtcgaaaactgtgcagattccgtccgccacaaattgcagctgtttcgactgttcccgcaagcgccggaggcgataattagaaaaagaggagagaaagaaaggaatacccagcagaaaaaggccaaatgcttctccttttcgtctgtttgtgtacaatcgtaaaaatggccaaacgatggccataaaatgataaataatgtatatttctcattaccacccaaacacatcaaaaatagtgaatgatggaaccaaaggcacacttcttttgcaaatgtttaggcactgatcggcgggggggattgagagaagatcaggaaacattcccttctgatcagtcccctcctcttttatccatgccatgtgatcagtttctcttttctctctctcccattttctgtttttcctctactttagcagtctccaatttaaatccaaagaatttttattttatttaaaaatcgctgatagcatttgaaagtgcgctcgaaattttcggagatttgtttcccactgttccgtcattgcctccgccacttgcgaggtcggaaaacctgaaaataaattctgaaaaacccaaggaaaaattcccatggtgaagtacaaataatcgtccacaatggcggagaagcggctttggtcgagttgtccggtgggcgagtcgccgagcaattcgcggaaaaacaactcagccaattc

SEQ ID NO: 44294 - DNA, 985 bp, Heterodera glycines
ctacaataaacttaccgctcttcccttttcagtggcgttgcctttactgttcggtggggtaataaatgtaagcctttccccggaaaaaagcctccctcaggcgatgggtgggtttaatcctcgaatcctccagaacgggccgtggctttgagaatttctcgccttagtccgtcattacttttgcccatcactctatccaaccccattttgaattacaaattgccccccccccaaatgcatttgtatgcccccaattgtcctcccctttgctgctgctttccaattaactaaattattcatctctctttcctgccgaagttgcctctttctgcgcttctctcccctcttccgctcgttcgcttattgtccgcttttcccatttccctccattcatttgctttccacccaaaggtgatgaatgaatgtcccctctccaaccaatcggccgtcgactgtctccgcagcggtgcttacttttacgatgcttgcacgggtcattgtgagcgtgagatgaggggacaattggtaagttagaatggggtctggatagagagatgggcaaaagtaatttccgcctaagagcaaaattttcaaatccaccacttgttctaggggaatggatgttttaccttccctcccccccccccaattttctttgtaaattgcgtctctttcagcttttccccgtgctagcagtgatggtcgttgctcccaatgtggtggtcgcgttggtcctctcccaacggcccatcctttactcggcaaatttagtgctaaaatacaccccccccccccccctctctttttttcccttccatttttcttttctctccattctcctccctttggtgcccttcccatttgcttattctcttatattttgggtatgtagcagaagatgacgaaagataagattaagcaaaatagagctgggaatggattcggaaaaggcggagggggggaagaaggaacagggggatggaag

SEQ ID NO: 44295 - DNA, 313 bp, Heterodera glycines
ctaacctgtaccattactctaaaaaatttaaattatgaaaatccgcaaagtaatcgccttacaattagcagtttttgaaaatttaatctcccttttccaactccatagaattgctcacattggccgccggcggtgtgccgtcgtcgtcggtgtcggattgtgccgcggcggcagcacgtgcgggcagcagcagtagcggttcgtccgcctcgagcagtattctgaaggagattcggcaacactttcggcggttgggtcgcaaattgtcgctgctttcctcgcgacggcacacgcagcagcagcagcagtacca

SEQ ID NO: 44296 - DNA, 770 bp, Heterodera glycines
cccccccccccccgatggtttatttaagccaacactgcttctcctcccttcccgttccatccgctgcaattccaaattcgcaaattaatcctccccccctttttccccctcgtcatcgttggtcccccctttttggtcccccgtccctccccttttggctgtttgttgttcagctgcttttccatttgtccatctgctcccccccccctcgcccgcttcattcttcaatattatatcagtgcaacaattggtccgtctttcttcccccaaatgtccgcttcatccccatcccccgccgtctttctcccatcgatgccctcctcctcctcgtcgttttggtggacatccgccgttggcaccgcctgttaccatgagccgaaggtgcacgactacgagctgtacttccaactgagcaggtccatctgaacagcggttattccgaattcaggggaaaatgaccaaaatacgaatgaatgcgaattgaaatgattgccacgaacttaaggatttctcttttgtgagctgcttccgcttgcactgctcggagttctggcaacacttgcgacattgatttgtctgagcactccgaccaaaatttcgtccggagagatcatttatctgagggcattgctcgtgctggaccattgccatattatacggctcaatggccaacactttgatccctgaattttgcgagtcacaccgttccccggaagatatcgcttatgagtccgattccatattccgatgaccgacttagtgaaataaag

SEQ ID NO: 44297 - DNA, 1102 bp, Heterodera glycines
tggcggtctgtacattcatcatctgctcggtgtcgccattcacgagagccatttcgggaaaataccggagaaggaatcgtcgcgacgtttcgggtgggaatcgcgggtttttcgcgacggaaatagtacgaaatttcgaaaaatctaaaaaattaattaaattttcgttttttaaataaaattagagagcccgggactcgaaaaaatcatccgaccaccaccctcccccaaagaaacgaatacaattaggaaatggaagaaaacgttcagcacacgcacgcaaaaattttgatggtggtgacacccaaaaacggaaaagggtttttttggggtggtgatggtggtggaggagggagggggacactgcaactccaaagatcaaagaatgttagggcgccaagcaaaaaaaaattgttggcaaaatgccaacaatttttattgggagggtcgggcagaaatttagtgggagcaatgaacaaaaattggggaggggcaagaaaccccaaaaaatggggtgggcggaggaaggaaatgaacgaatgtggaacaattgcatcatctttgtactggccggggggacattttcatatttcaaaaccattggaattcattctttgctgtgcaaaaatgatcaaaaaaatggcagctcggcgctaatgaggattaattagggtcattagaggtggtgaccctaatggactaatgagggagattcgtaaagcaatgccccctccacttaagacaaatctatcaagcaaattaattcatatgtgctaataggaattataaaatgtgatcaacgccaggacgtgattgttttatgctgatcaatagaatggttcaggagggcaatgtaaaaatttgatcccaaaatcatgctaatttcttaaatacgagcaaaattgttgtccctaaattctcctccattactgatcgggattggtttattttgataaaagtaaatttctgatcaaaagattgatctcgatttaacgtgcgtaaacttacagagcagattcacaattactataaattttttgatcattacacagaaacaaaatggtgtccccctgcctatttctaagcgttgctattaataaat

SEQ ID NO: 44298 - DNA, 1194 bp, Heterodera glycines
  misc_feature (1094)..(1095): n is a, c, g, or t
ccaaaaaaatttcccaaatttttaaaaattgtataaaaatttaaaaaatgagaattcatgcgaggatttttggaaaataagcttaaatagggccttagttaaactgtaaaaaaaaattgggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggtttgatgaagttttggtaagccaaaaaaaatccaaacatttaaaaatctataaaaaatttaaaaatgagaattcatgcgagattttctggaaataagcttaatagggcatagttaagctgtaaaaaaatttggggcgatttgaatgagaatagaaagagccaggttcgatgaagttttggtaagccaaaaaaaaatccaaacatttaaaaatctataaaaaatttaaaaatgagaattcatacgagattttcaggaaataagcttaatagggcatagttaagctgtaaaaaaaatttggagcgatttgaatgagaatagaaagagccaggttcgatgaagttttggtaagccaaaaaaatatccaaatatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcatagttaagctgtaaaaaaaatttggagcgatttgaatgagaatagaaagagccaggttcgatgaagttttggtaagccaaaaaaatatgcaaatatttaaaaatctataaaaaatttaaaaatgagaattcatgcgagattttctgggaataagcttaatagggcctagnntagctgtaaaaaaaattatagcgatttgaatgagatagaaagagcaggttcgatgaattttggtaagcaaaaaatatccaaatattaaaatctataaaa

SEQ ID NO: 44299 - DNA, 1048 bp, Heterodera glycines
gcatttcaatctctgagactcaattctcaggctttccaatcgctgggactcaacccaccagcatttcaatctctgggactcaaatctctggcattccaaacactgggacttaacccaccaactttcaatggcattccaatctctgggactcaacccaccagcatttcaatctctgggactcaacacaccagcatttcaatctctgggactcaaatctccggcattccagacactgggactcaacccaccaactttcaatggcattccaatctctgggactcaacccaccagcatttcaatctctgagactcaattctcaggctttccaatcgctgggactcaacccaccagcatttcaatctctgggactcaaatctctggcattccaaacactgggacttaacccaccaactttcaatggcattccaatctctgggactcaacccaccagcatttcaatctctgggactcaacccaccagcatttcaatctctgagactcaattctcaggctttccaatcgctgggactcaacccaccagcatttcaatctctgggactcaaatctcctgcattccagacactgggactcaacccaccaactttcaatggcattccaatctctgggactcaacccaccagcatttcaatctctgagactcaattctaaggctttccaatcgctgggactcaacccaccagcatttcaatgtctgggactcaaatctccggcattccagacactgggactcacccaccaactttcaatggcattccaatctctggggctcaacccaccagcatttcaatctctgagactcaacccaccagcatttcaatctctgggactcaacacgccagcatttcaatctctgggactcaaatctccggcattccaaacactgggactcaaccccccagcattttaatttgattccaaatctctgggactcaacccaccagaatttcaaactctgaaactcaattctcagggtttccaattcggtggaacccaacccaccaacatttcaatctctgggactcaaatc

SEQ ID NO: 44300 - DNA, 357 bp, Heterodera glycines
cgaaaatgataaagaatgtgagatctttctgggatttttatgaataaagacaatggattttccaattttaacacatattttggcaatttttttttagcatacatttcagcattttttggcacatattttattgcatatttcaggatttttagtagagtgcgccgggaccgggaccgggccaggaattcccggtcctccgaggtcccggtcccggtagggcaaccgggaaccgggaaaaacaagcactggtaagaatggaggtctgagtgaaaaattagagatgaaaattggagttaaagaaaaaaattttaaaaaatatattaatatattctttaaaagtagcactaccaactgtga

SEQ ID NO: 44301 - DNA, 933 bp, Heterodera glycines
ttccgcaactcaattgtctgtgaccagtaaagctgtcacaacatttttgctcagctgcttgacaaacattgtgctggctgtgaatgggccagtgctttacataatgaagtaaattttagaggaaaaatataaaattgtaaattacaatatttagaattttttttctcttgaaaaattgacgtgagaaatataaaatagtgtataatatttttttagtctacttttaacaatgactaaaattaatcattaaccaaattaaatttttactcataaaaaaattgtaatttcgataaattgcaatgaactagagcttgtcggaaccgggactggttctgaaaaaaacgagtacaactgagtacccagtcccggttttgaccagttttgaccgggaccgggactagtcccggttttttcccggttttcccagccaaaaaatcccggcttttcaatccgaaaattcccggttccagtttttgtcaaaaatcccggtcccgaccagcacgacaatgaactcttaagtgccttattaattattacatgataaattaactttttttaagcatggaatatcggaatgcatttcaaaaagtgttcaaatttcttcaaccaaccaattacaacacaacaatcatcggaacgcaacaacaacaatgggcaattcgcgtagcaacagagaatgttcagaattgaatttaacgattaaatttaattttccaaatttccaatttaaaaattgtttttcatttttatatttttgcaatttaaaataaattatgaaataaatacagaaacggagataaaaggaagggacaaatataattaaaataaaatgaattaaattcattaatttaaataaatgttatccagcagatgctacaataaaagagttttgattaaaaaaataggtttttttaatgatattaactattttta

SEQ ID NO: 44302 - DNA, 1336 bp, Heterodera glycines
  misc_feature (613)..(613): n is a, c, g, or t
  misc_feature (1173)..(1173): n is a, c, g, or t
gggttgggaattcttaatcatttccctttttctttcactgctgtcatattcctttttcagatggattctgagggtgaattgaagcaattacttgtgaattgtctttccgcttcgttttttccgctgaatgcgtcgccgccggcggtccaatcgcgaaacaccgccccttttgcgatgacaagcgcaagtgacgcgaggggttcgcattgcgaaatgaatttaattgaaaaaagagtcttacgaattaattcggcaaatttccacgattttacccagaaaccttcaaattcattcgttgcccttttcaggcgatgccgtttcactgctcgtcgacaaaatggtgcacaggtgggccacacccattcactcatttgtctaattgggttaattagccaaattccgcttcggtccgcttacattttggcctatgaatttgtggacatttacgctgaccaattgcataccaatcgcaactctttcactggtcccttttcaccattaattgccagtaattaattttttttaattagaaactcaaaaaatcgatgcgtccaattggtgttcggaattgaggggatattttgcgcagtttttgcaacaaattgtggacggntcgcgcccgttgcctcgtctgtcctcctccctttttcgtctcacttttcgtccctttttcagcttcgcttttcgcccattgccgcgtccttccattgtctttttgtgcccagaaaaacagaaagccaaaaatggaggaccgccaccttttgctggtcaattaaattaaaacgggggaaaggggacaatttgcatttcgttcggttcattgtaatcttccatttttattttcttttaagccatcattggacatcgtcgagccggaaatttcgcaaaagctttccaaaaaggtcgacccatcggcggcacttttcgccgttttcgacgggcacaatggcgccgaatgtacgctggccattttttaaattctacattaattggggactaattaattcctcgacaatttccattttaaggcgccacttttgcgagtgcccatttgacggagtgttttttggacgcttttgagcaatcggacgatatcgaaaaaatattgaatgacgcatttgaacgactcgacaaacgcataacagaaaaatgcacgagtgaggttggaattgngaaagggtggggggggaaggaccctccgaccccttccgtctttctttctttctgtccgttccctgccatttgcgatggaatttcattccctccttagaacatcaaaagcggcaccacggttagctgtgtttatttggagggcacaacatctgcttatttggcg

SEQ ID NO: 44303 - DNA, 772 bp, Heterodera glycines
ttcttgaaagtaactctagccgccaaaattattataataatacttatttgaaagcacaaaaaaacgcgattctattgcacattatgagtccaatcaattaatcctacctggttattatattcgaaagcacaaatcataatacgagaaagagaatgctaacatttaagaaaagttacaaacgaaaataatcaacaattacttaatgatcatttatctttttttgcaattgcccaaacgctgagattttatatatattaccttctacagactttgtgctttcgaatgatacccaaaagcttcgaacatgagcaaacttattgtataaaaaccaactatgattaattgattggactcataaagagcaatagagccaaaaaagctacaaaaaatgttaaaacaaaagacagcttttctaggaattacattttattggagaaataaactcgacataagaggtgatcctgttctgcgttcatttcaccaaatttctggtcagaaatactttcaagtatttcattcagcgccgtaatttcgtcaaaaagctcattgtcgttcacttccggatcaatctgttcagccaaactcatcacttcggcgcgagaaacttttttctttgagagaaacccatgccaaatccgttggaaagcgctcaacgcggaaccatttatcgacataggtaagtgttgatttcagaaaagtctaaaaataagaaaagcttaaaaaatctccagattaaaaatgtgcgctgggcaccccaccggaatgaggttgt

SEQ ID NO: 44304 - DNA, 996 bp, Heterodera glycines
aaaattttcaattttttctagtctaatctactcaaaacgggtcagaattcaataaaaataacattcacggtgcgaaaaatggggtatgacaagtttattgggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaacaatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaatttttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaa

SEQ ID NO: 44305 - DNA, 1012 bp, Heterodera glycines
tttttgacaaaaaccctcaaatttttcagattctccgtaaaattctcagtttcttttctcttggttttcctgtaaaaatactcgtacataatttacttggatctaatttttcaacaaaaataaaactcacaatcagtcaaactcattggttttagggaaaatcttcaatttttcattggtatttttcctgtaaatttccacttttttttctcttggttttcctgtaaaacctacatatgtatatacattttctcttttaccaacaaatttgatggttgaaaacccgctaaattcataggtttccggcaaatccctcaattttcttgatttttttcccctaaatttcccgacatttctaatttttttttcaaaatgcctcatttctccccccccccccaccccagcagcaaatggtaccagcaacaaatgcccgttgttgcccatgccgtgcacacccaacagcagcagttggagcaaagggatgccgtcgggctgtccatggcctcggctgagccggcggctgacgactcggatggcacaaatgtttttgtgcggatgccaacgcagcggcaccaccaccaacgccaacaacaacaacaccgcctgacagatcccgctgaacagttgaagtttgttgtttttggatggagtttatgtggtccaacaaaaaaccaccctccatacattataattggggaaaaaatttgggaaattttggttggatccatgcggggcggactattttttttttttgaattttttttaaatgggtgcattttttgagaatttttcaccgccgactaccagagacggtcccaggaatccccaatacccctccacacactcgaaatatctaacaataagggaaaaataatatttgttgctgaaaattttcaattttctttgttggtatggcctccaaggtcttcctcacccaacaaaaaattacgtgaatttttttttgaaaatccacaaaattagcaatgtttggtgcaaatatgttttaaaaatg

SEQ ID NO: 44306 - DNA, 1306 bp, Heterodera glycines
aaaaaatggattaaacaaaaatggcaattttatttttaattttaaattcaaatggcaattggacgccgttcatattacggttacgcgttaacggtaattttggagcatttgaattaaatgtgagccacccgcttataattgaatttcatttaaatgatgctataataagagacaataaaatcgcccgaataaaaaataaaacaaaaagttttttttttacaaaataaaattataattaaatttataactaaaaaacaatgcgcttcaattgtatcggtattgtattgcttgctgtatcatgtttgggtcatattgtgtgttctattaaaatacaatcgttattatgtacatacaatatcaggaacatgaatttaacattttgttttaaaatacaaaaaaaaatgaaataaaatttttatcaattttaaataatttttattcgaaaatgttaaaagttttataaaaataaaaacctttttcagattcattgtatggcactaaaattctttggggttcaaaatgtccaaaagaatgcctatttttcaatttccctaaaaatgccggtgccatcgtcatctctctccccctcctcctcttcctcctcggtgaatgttggcaacggcaccaacgggggaaggggtggtcgtcggctgctcatttccatggacggaaaattggacatgtagaacagtgaggtgtcgggatggccaaggggtggcaccgtttcggaccggcgcattgccatcagtccaatttgtgccgggttcgtcgtcgctggcatggaaccgccggtgcaaatgccaccggcggcggcggcagtcgacgacggcacggaaagggaccagcaggaggagggcagcgcagtgtccataaaggacaaatcggggtctgaatatcggcattttccgtcccaaatcccggcatttttccgtcttaaatccaaggcatcttctcaccccaaatcctcgacattttctatccccaagtcttggcattttcagtcccaatcccggcatttgcttgccacgaatcccagacattatttccccaaatcctgcattttctagccccaatttttggcattttctagtcacatatcccggcattttctcgtcctattgcttcaaccctggtcccaaaaatccacccgaattaatgccggatgttgtgctgtccggcagctccgcttcatctgctgttgttgttactgttgttggcaatggtggtaatggatagttatagcatttccgtcgaagcgacgacccatcgccgacgacgggcgcaaggcgcaggcgctgctcatcgt

SEQ ID NO: 44307 - DNA, 952 bp, Heterodera glycines
  misc_feature (6)..(6): n is a, c, g, or t
accaanttttgccgtaaaaaaatgagaaaaaagagatacccttttttggtcaagaatttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagagatagctattttttggtcaagaattttttttgttgcgtttcaaatatcgtaagattgtttgatagggccagacaagagaaggcaactgttggtaccaattttgcggtaaaaaaatgagaaaaaagagataaccattttttggtcaagaatttttttgtttgagtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttccaatatcgtaagattgtttgatagggccagacaaaaaaaggcaactgttggtaccaagtttgcggtaaaaaaatgaaaaaaaagagatagctattttttggccaagaattttttttgtt

SEQ ID NO: 44308 - DNA, 1094 bp, Heterodera glycines
ttgatttaaagtttgtttttattagttctttatcgcgttgattccataattttgttaccctcccagcaaatggaatgaattttttgcctagtttgtattttgtgttaaatctgtaaaaggggatgttaaagcgtgctgatggattaaatatagaaaatagtttcagatctgttcggccataaacaattttgcgccatgaacagatcaaaaagcttacgcctattctcaagtgttggcagttgcagctattctaaccgattttagtatggaattggtggaaggctacatttaaaaaaacccttttggtgaaatatttttgacacttcaatttttataatatttttttgaagagacggattccaaacctccggagcatattccaataaaggcctaatataagttttatataacgtaatccaaatcttagacgatttggatttaattattctaaacaaggaacgcatacgtaaatacgcattccttgttatttggtttacatgaacggaaaattgtaatttattatcaatgtttactcctaaatccctaattgtatccacagcatttattgtattcccatcaaatttatatgtttcttttgggtttttggaacccaaatatgtataatataaaagttttttgaattgaaacttttatttgcccattcgaataaattgtgcaatgctttatgcatagtttctgtatctgctcttgctttatagcatatataatttaacatcatcagcatataatttaattcttactccagagggcaaagcatcaggaagatcgttaatatagatcaaaaataataaagggcccaggacagagccctggggaacgccagagccaacttttttacttgaggataaagaatccccaattttaactcgaaaagtcctattacttaaaaagtcctttatccacaataaaagtttgccctttataccaattttttccaatttatataaaagtaaattatggggcactgagtcaaatgctttttgaaaatcaatataaatacaatcaacactttttccattaataattgcctcgtagaagcttctacaactgttattagttgacttgttgtagac

SEQ ID NO: 44309 - DNA, 1012 bp, Heterodera glycines
  misc_feature (955)..(956): n is a, c, g, or t
taacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcgccgcacttcctatcaagctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcacctcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtnngaataaatggcgattgcgcaccgcacttcctatcatgctcgagagcatttgtaacg

SEQ ID NO: 44310 - DNA, 999 bp, Heterodera glycines
actaaagcatcagagtgctaaaattaagtgctaaataaaatttggtgcgctgtagagcactgtctgaaaaaaatatttatgaaaaccaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaatcaattaaggggagcaaaaatccaacgcagaaataaagttcaggctata

SEQ ID NO: 44311 - DNA, 1246 bp, Heterodera glycines
tcggaaatatttaagaaattaatacgtgcatccataataagtaattgtgtatcctaaattttgacaactttctggccaaaattagaaaataaccttttgagccttattaataatttttatttatattttacccgggctctaatcgcacaaacgttggtaccgttatttgcattttgggcacattttaagatttttggatttctaggtatatctgagctaattttagagcgtaattaaaacgcatatgtactcgttttgatagtgtacaagaaaattcacttttttttgacaagtatgataaaaaagacatctttcacatttactaattcagcgtaaaaatcaggaaaaaattgtgagcaaaagaaaatccgaccgggagattccgattctaaaccttaccaatgttgtatattatctacaatagttttacccaggttatcgtatttaattgttaaataaacacgataataggatttaattctgagtttattataatacaaatttttctaaatataattttattttaataatgtttgattgtttgtttataatatcactcaactatggtcaggaccatacgcgctcttagacttaaacctagcttcggcatagttttaatttaaagcctaggccgagtacggtacttccaatttttaaattttgtgtataatcatagatatacccatattaaaaaatggctttctcgtttccaaataaaatccacatataaacgcgattctgctggccaatttgctaacccaaaaaacgtctcagacgttaaggcattcaacggggcaggtgcatttattgtacatgcgcttataatcgacctacagtataaactgtatgaagtgagttttatctctgtaatgctacatgcatacattctgtattgtaaaccttaggcttgcccaaccgtagctaaaaatgggctattatgcaaccgtaagctgtccgaacagagactttgttcgagttgcggttttgctaccaaaaatccaacagatgctgttatccttcgacttgaacttcaagatctaatggataaagaatgccgccaaaatacaacaatgttcaccagcagtgctcaaaagtatcttggccgtaaagcaagcgaaatccggatgatggaacaggacggagacggggaagggttggctaggcttttagattccttcattggaaagaagattgtagccaaaataactattaaggtattatgctctataataataatcgactaaat

SEQ ID NO: 44312 - DNA, 1071 bp, Heterodera glycines
cacgctccaagtctcgaggaaatgttgcagtgatccaacgctatcgtccacaggtcggagattgatcagttcggactgaagtgcttcagcgattttccgtggatctccgaagagtcgcctgagtgcggcaacggcatgggcataattctcccctccacggtaggcggttacggcacgagcagcctttccgcgtaggcaaccgtggagatagttgagtttgtcgacgggctcaagggcggcacggtcgacggcactctcgaaactctgccaaaacgcgggccattccattggttcgcccgaaaaaacaggaagactgactgtggaagccgagcagtggcttgaggagcagctgccggcggcaaaattggcatattgtgaacattggcgaccggcactggaggtggcagataggcatgattggcagcagctggctgctgaagatttgcaccagcagcagcattgattgcaaccggtatggctggcatttgtggcatggcttggttcacagcagctactggctgctgtcctcccgctggcatgacttggttgggtggatttgcgagctctgctgctatgtgagccagcagttctcgcgcatcctccaaccaatccgtcagatgacggtcgtctctcacaaagttggcaaatagcgcttcttctgcctctcgtgccgggccttgaagtgcgttcatgattgtaccccatgcatccatttcagcttccatccttgacaggattcggatgatgtggtctcgttcctgcctcagggagatgactgtttgggcatccggatcgtcttcatccagcaagttctcggctgaggtgatgtgctggcgaagacggaaaagtgcagggccgagggccatccggcatcgtgcagaagacattacgaatcgctaacggcaccacttgtcgcacaaaggggatggacaacgaccgggaggggggggtgaccacgagggggcaccgaaagagccaaaaaagggcggcgaacggagagacgtgtgggcgagagactggccaaacgattagggaaaacgagcgagtagacggttagaaaagtgcgcttta

SEQ ID NO: 44313 - DNA, 689 bp, Heterodera glycines
gacacctaaagagattaggttcgtatggaatggcacagtcagacatcaatttcttttagatttttcattgataagttaagacccaaaaatgtcaaaattttcatttggttttccgtcaatttgcccatttctgagtagtttcgtagaatccataagggattacaaaaaatgaaaataaatcataaaattgcttaaagtcaagcaaatgagatgttcttggtatcattcgataatttgatttcttaacctgaaaaaatacgccaaattcaaaaacttcctcttggcgggttttcaaagcgccatgggtggatagcgaaatttaatcaggcactgacgggtctttggcatgacatggaacccaatctcccctctctgctatccacccttttctggttctgatcagtgatcactcctcccaatttccttccgcacagtttgacacgtccaaagcgtcgctactacgaccgggtggaggacttgccgcagaatgttgttgcccggtggcgcaaggagcgcgagcagttccaaccaccgaccgacccatatgttgggaaagaagacgaataatgagcacggaagggagaggattggatgattgataattagtgaccatgaggatggtgttgaacaatattttaatgaattaatgaatgtaaatgctaaaaaaatgcgccacaaaatttaatttt

SEQ ID NO: 44314 - DNA, 1021 bp, Heterodera glycines
taaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaatacccactctccacgcgaggaggtagtgacgagaaatacgagaccgatctcttatgaggccggtcatcgggatgggtacaattaaaacccttacgagtatctatgagaggg

SEQ ID NO: 44315 - DNA, 1177 bp, Heterodera glycines
tttgcaaaacaaaaggatcccccctttgtttttgatagaattcaaaaggttgctctttgcaaatagcgcccatatttttcggggttcgaaattggttgaaattaatgccatatcatgaccagcgcccctgaaagcaccacaaaaaccgctcataactagggatgcaaatatttgaaatttttccaaaacctctattacttactaaaatttaataaatattataaatttagggagggaaaaattacccctcaattcggaaaatttatgtccatatttttgcatccctactcataagctcataactcccttttttcctctttttatgggtaccttttttacttatttatgtaatattttgtgatttttttgcgtattatttctagcttgtttcttaacaaggctctcgcccagagtttaggccccatatacaaaaatttttacatttcagaaataaaagaagccaatctataggttttcggggtcgcttccggcatcaatttcggccaatcccaaatcccggaccctaattcgaacaagaagtcgtaaaagtaaaatttttttatttttcatttttagtctaaaaatggtttaaatgatttttaattgaagcactgatgactttcaattcaattacgagcatttaaacatttgttgattaattaaaatgatgattatattttcaatgatatgaggtgtagaatatctcatagaatggcgctctacagagatggaaaaagaagggggctttctctactttgttcgttgcagcatgaggaaggaatttgcattatatttaggtatatatcgaaaaaattatcgccaatcaaaaaagaatagagataaatgactagatgaaattataaaaatttacgagaaaaatcgatattggaaattaattttctctcttgttccctatccaatgatagatttatcgattaactttcagactaggctaatactcgcattgattactaaaactatttgatttagcttataaacagatgagccaaaggaacatatattatatgattgtagacggttctaataaaatccccgagggtatggcggtgcccgctgacatcctctattttgacttgctccctttaatctaagacaaaaagaaatttgttggaaaattagatgacacagataaatttatagacgcgaaaattaatgc

SEQ ID NO: 44316 - DNA, 983 bp, Heterodera glycines
  misc_feature (849)..(849): n is a, c, g, or t
  misc_feature (912)..(912): n is a, c, g, or t
actagtaaggtttgtatcccccttttgggtaaaattttttcaaaatttttttttcttttttattgtcgcaattgctttaaataacaaataaaaggagatttatgtgtttattgggtacaattcagcgatttgagaccacaaattataaaaaatatccggtcctccaaattgcttacgccacaaaaaatcagaaatgtatgtggaaaaaagtgatctgtgagtgccaaatctcgctttatgttcatgtttgaacttctgccacgtcgattcaattgtattcgtatgctggccagttccaaagcggttgattccggtctttaatccatttgtagctcatttcgttgccacagtcacaaaaacgagtggtgtgtagaagcttaagttctctgagccattcttcgaattctttgtctggtagagccaatactttgaataaatcgtcaagagtgaaatttttaagcttttccattaatctaaaaagcaattgcgacaataaaaaagaaaaaaaaattttgaaaaaattttacccaaaagggggatacaaaccttactagtaccgaattttttaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccattgccgttcggtcccttcccaagggggtggaatggagagaagggtgggaggcaaacaagaagtgggctgttgtttgaataacggcaccaccgactncaatttgggggaagaagccggtgctcccaggttcaactgcctaagtccgagcactcctgtcangcacttccggcgtgccaactcctgtccgatcgtgggcgctccggagtttcactcccgtttcccctttcgct

SEQ ID NO: 44317 - DNA, 794 bp, Heterodera glycines
  misc_feature (675)..(675): n is a, c, g, or t
agcaaattatttttttcatagacaactttcaataatagattttgaaaagaacacgattactttttggaattaaattttattttcactaaatcaaaagcaggaattattagctttttgaaatctatcagaaataaccccaattttgatatgattgacaaatttttcgcagtgttaaaattttttgaaaatttttggcgacaaattaatgaatgaaacaaaataaatattatttcctaataagaaaaaataaatttttaacaattgtccagccttgaacatattaagcgttgtctttcaattccaagtggtggcgcgtggtcagatttagtcgcagtcggaaatacctttagaatatttcttattgaattaccaaggcattaaaatataaaaaaaataaaattactaattaagttaaataattgatcatttatttcttatataatccaaccggtccaacgcccaaataatcaattttatggccaagtcgaatggcatgttccaatgctttttcattgttcactgaatagcccaaaattgcatcggggccaagcagttcacgtgcagactcaaccggcaaatcgttggcacccaaatgcactccgtcagcgcccgaggccaggcaaacatcgacatggtcattgataatcagcggaatcccttttggcctaaatttgngtaattagcacacaaaatggccattgtttttcatttgccggttcattcatttcactgatttcccccattacacccagaaaacttttggggttttgaggctcgctaaaattaaaaaattt

SEQ ID NO: 44318 - DNA, 1079 bp, Heterodera glycines
caaacccgggaccgggaccttttcgggttgaaaaaccgggaatttttggctgggaaaaccgggaaaaaacccgggactggtcccggtcccggtcaaaaccgggacctcggtactcagttgtccgtgttttggtcccggtcccgctctactctactttaaacatatgctatttcaattttggaacggaatacggtattttatcgaaaataatttaacaatgaaaatgccgacaaattccaattcaattttttccccaattatttttctttttttcgttcactttttatttgcatttttttgataaatattttgtttcttattattctcattggttttcaattagtgctgtctttctttcttttctttcgtccgttttcattcgctttttttcgcttcgattttttcccctcccaccgccacgtctttgtagaacaaattgccacgttcgttctgttccgcctcgatgctttcgaataacgctttgaagttgccggcgccaaagccctggggggaattggtcattttggcattggcaacctaacgccgacgacattggcattgtgcccacttgcctggtggttgtgccgttggatgatttccaggaaaagggtggggcggtcttggcatggcttaattattgatcaattagtcctcgttcattcattttcggtttttcccttttcgtaaatttacctttgaaaatatttggagcaaatagccctgctcgtcaaaatcgaccagaatcttcagctccctcagtttctccaagtcctccttcaactccacgcccgcgtcgctcagccgctgcttcagagacgcgtagtaactgtccgggatgctcagaaactccaagccgcgggcgcgcagcgattggatggcgtgaacaatgtccgaagtgttcagagcaatgtgctgcggaaggaaacggggcgggcatcatcaaagggacagatgagacaagaagcagaattttttgaattttctccggccgagcagcgcatttcggcttcttcggaatgccaatcctttgatgtttaaattcctccgctctctctctctctctttctctctcactctca

SEQ ID NO: 44319 - DNA, 1846 bp, Heterodera glycines
  misc_feature (138)..(138): n is a, c, g, or t
  misc_feature (167)..(167): n is a, c, g, or t
  misc_feature (1748)..(1748): n is a, c, g, or t
  misc_feature (1793)..(1793): n is a, c, g, or t
  misc_feature (1796)..(1796): n is a, c, g, or t
cagtcgctttaaccctccgctcgtcatcgttcgtctgaccagtgttgtctcactcgctgcccgggagagagttgcggctgaggggcgcgtgcgccgggtgccgagtcattgacgcgctgcgcgcgtgctgtccgattncgcgtggcacgggcggcggcacttccccnggggggcacgcgggcgggggtgcgggtagcccgcgatgcgcctccctcgtggggcgggcgactgttggtagtgcgccaacagcggcggacagttgggagcctagcggtcgggtcctccactggcctggactgtcccgaccggtgggcacgcactgcgcggctacggccgcggaagtgtccggctctcagtgtgacttggaacgcgcgtttcgcccataaagaagcgcttccgcgcctcgatgaagctggcggtcgatgcatatttttttaattttatgaactgattgatttaaattaaataatttttaaaaggaagtaaaataaatcaaattttattaaattaattcttgcttattgggtattttttaattaaaaaaataaaattttacaaattctgcacaaatgtacttatccgaaggagaagaagcttcgttcgaaggcgatggcggcgccgtcgatccggcagcagcagcagcagaagaagttgattgatttgacatttaaataaattttcgggtctattatcacttaaactcggatttttagtgctaaaaatcatgaaatatgtgttaaaaaatgctgaaatacatatatgtgctaaaaaccaaaaaaaaatgtcaaaaatgtgcgaaaattaaaaaaatcaattgtatttataccagggatgcgatcgaaaatttttcaaaataagaacattgagcccaaaaaatcagattttggggtcgaaaatcaggacattttgcttcattgcttcaaaacagttatttttacaatttattcaatcaaaaatgtattaaatattatattttttcacctcccattaacgattttaacaattttggggaggaaattagcaaatcgtaaattttaatgcaattttttagcggcgtaatttttccaaaaaacttctgaggaatgggcgaggggagagggtccggcggtgccattaggcaccccggaaaattttttttagattttcaccaaaaaaggccaattttttcaattaaattaagtcaagcgacgacttttttgctttaaaacactttttttgcggcgcgtttttaaaaaaattttggaggatggacggagggtccggcggtgcctataggcgccgcagggaaaaatttttgcgatttttaatgcgatttgttaacagatttttgtcaaaataaccaaattttgccacaaatcttatattttcttaataaaatagtgacattatgccatacaatttcaaaaatgtgagtttatttaagaaatcaggacaaaattttcaggacaaatctgataaatcaggacatttttattttatcagatttggaccctccaaatcaggacaaatttgataaatcaggacagatcgcatccctgcagtactatcacatgttactttttggggaacgggaaatggcgttggcattggccaaatgccatcagatgtaaggaataagctgactggcggttaaaatctggaaagcggaatttacgagacaaggaataatttttaatgataaacaacaacccaaacgaagtacattctttaaatcaacattatatatttttaataaggatagaaaaggntgagggggtgtttatgttccctttatataaataatgggatatgcnttntttccctcggcagaagaaattgacaaaaaaaaattgatcgccgatggacg

SEQ ID NO: 44320 - DNA, 1072 bp, Heterodera glycines
  misc_feature (962)..(962): n is a, c, g, or t
taaaaaacttttgggtatggaattattttttgaagtgagtcaaacaccgtattagtgctttgctgtgccgagaaccgacagacaatggatagctttaaatctgcaagaaattagattggcaataagtggttgtaaaaaacttttgggtaatgaattattttttgaagtgagtcaaacacctctattagtgctttgctgtgccgagaaccggcaggcaatggatggctttcaatctgcaagaaattagattggcaatatgtggttgtaaaaaacttttgggtatggaattattttttgaagtgagtcaaccaccttattagtgctttgctgtgccgagaccggcaggcaatggatagctttaaatctgcaagaaattatattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccctattagtgctttgctgtgccgagaccggcaggcaatggatagctttaaatctgcaagaaattagattggcaataagtggttgtaaaaaacttttgggtaatgaattattttttaaagtgagtcaaacaccgtattagtgctttgctgtgccgagaaccggcaggcaatggatggctttaaatctgcaagaaattaaattggcaataagtggttgtaaaaaacttgggtaaggaattattttttgaagtgaatcaaacaccctattagtgctttgctgtgccgagaaccggcaggcaatggatggctttcaatctgcaagaaattagattggcaataagtggttgtaaaaaacttttgggtaatgaattattttttgaagtgagtncaacaccctattagtgctttgctgtgccgagaaccggcaggcaatggatggcttcaatctgcagaaaatagattggcaatatgtggttgtaaaaaacttttgggtaatga

SEQ ID NO: 44321 - DNA, 1006 bp, Heterodera glycines
gatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttctcacgttacttgctcagctcggctgtgggggttttggtgtgctggcgcgaacttgtgagtctaattcgcgttttacggaccgtaactcaagcgcacccatgctttgcatgctgtggcggagtgcctggattactggcattcctgctttgatttttcgacctgaactcagacgtgaacacccgctgaactaaagcatat

SEQ ID NO: 44322 - DNA, 1624 bp, Heterodera glycines
  misc_feature (24)..(24): n is a, c, g, or t
  misc_feature (57)..(57): n is a, c, g, or t
  misc_feature (68)..(68): n is a, c, g, or t
  misc_feature (1575)..(1575): n is a, c, g, or t
  misc_feature (1582)..(1582): n is a, c, g, or t
aaattgaatttttttttttattgnttggtatttaaattaattttttaattaaattanaaaatatgtanttaattacaataattacctgctggtcatcacgagaacacgaatgtgtttgcttttgtactgcctattaaaattgaaaaaaataaatcaaatagcaataaaatatttattcattttttttttacttttcgaagtagtcggtgatcgtatcttcgtatgcactgtaaaattgacaaattaaataaaaagtatttattaaattaatttcttaattaaccttatgtcgtcatcggtccacctaaaaattggaaaattaattaggtaatggaaatttgcaaataattaatggagttaattatttttcatcattaattagttaattaattaccctctcgtcttttccgctcggtaccgtatgacgatggactcaattttgtccatgttcccaaacttgggcttgctcgtcttcgacacatgaaccccgtagaaatttggctaaaattttgcaaaaaattttacaaaaatttcaatttttaaccgacctgtaaattgacttttctgcccatgatcaatgaaaatgggtagtcaagtttgatgcggtcattcagcggttcgtgtttcattacccgatcgtactggtcttgaaagccagtctaaaatttttttttttttgaaaatttaattttatgaaaaaaattttttggcttacataaaacaattggacaggttcgctgacgttgcaataaaagttgcaaatcattgaaaatgattcatcacggtcatgtttttgattgtagaaggtcaaattgtgccggacgaggttgtcaacctgaaacaaaaaaaaaaattttttgaaaaattcagcaaaaaaaaacgaaaattttttacatcgacagtttcgcgcaatgattccaaattcatcaaattgttgccctttttcggcaaaatcagcaacaaaattttgactccgagcccagtctgtccgaagaattcatcttggacagcaaattcgttcaatgaacgcgagccatacggtgtgtagccggtgatttgatttttgactctgtttaatgagggggaaaaataattacattaattcttaaaaaataaaacttttttttatttttaaataaaaatgttctttaaatcttaaaatatgttgtttatagataaaattgttatgatcataattatgattacattgatattaaatattatacatataaataattatttatttgaagaaaatgaaataaaaaattatttaattatttatttgcttattttaattaaattataattaatgagaatgaatgaagatattcgaaatttgattaattatatatattaaattaaaaatttttattattaaataatctattaaatttattaaaacaatttttttaaaagtctacttcgtgttcaacattttgaagccacaaattgcggaggcaataaagcagaggaccacaattttccatgtgtgtgccacaacaaaatgtgcccatcggctgtaggcacgtcgaatgtagcgttgtaaaaggtcggaaaggtcttcccttctgcttntttgcgnaagtgaaactgaaattttgaattttaaattttataattgaaa

SEQ ID NO: 44323 - DNA, 892 bp, Heterodera glycines
agcggccgagtgagtaccttcggtgcaggaaaattattaaggaagagagttcattatttatttattttttgcataattaattcataaatatttttttcagaaagggttctgaaacgcaccaaattttatttacatgttagtttaggcactcttatgctttttctatcaaaaagggagatgaataaaatttttaaaaatttttaattcctttttaaacaggccaaaaagtttaggcttaactttttagtgaaaattcaatcactcatttttcgagtagtgatcagaagcgaaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcattaaggaggagggttcattatttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaacttttttttcagaaacttatcagaagcgcaccaaactttgcagggatactgaaaggaagagaaataacctattttaaatattatctagtcagttcatttaaataatttattcaaaaaaaatttttttttgggttttcggggcagtccccctgaaccgatgcgcccagatttatggggagaaaattttcaaaattctgagtctcctattattttatttttttttcaaaatttgaagggcggggggggg

SEQ ID NO: 44324 - DNA, 945 bp, Heterodera glycines
  misc_feature (20)..(20): n is a, c, g, or t
ataagataaatttaaaaatntctctgtgaaattaaatgccgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgcacttcctatcatgctcgagagcatttgtaacgtataaaatttctctaaataagagatagtcatttttcttggatataaaattaatttaaaaatctctgagaattaaatggcgattgcgcaccgcacttcctatcat

SEQ ID NO: 44325 - DNA, 894 bp, Heterodera glycines
aaaaagttaagcctaaatttttcggcatatttaaaaagcaattaaaaaatttttaaaattttatctcacctccattatcgatagaaaaagcatcagagagccttcatctaactccgtaaataaaattcggtggcgtttcagaaccctttctgaaaaaatatttaagaattaattttcgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcccggcaccgaaggtactcactcggcctcttccgcctcgtggggggccttcgccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaaattgaaaattttgaaatcatgttttccactcccttctcccaggggtattattttgtaaagtcttttt

SEQ ID NO: 44326 - DNA, 979 bp, Heterodera glycines
  misc_feature (43)..(43): n is a, c, g, or t
tttagcgttcataatgggatgtatatagacgattgtagaaggnaattgatgcgctaaaattgtttgagaagctttttgagcgtagttacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaagggcgattgtagaaggaattggaagcgctaaaat

SEQ ID NO: 44327 - DNA, 967 bp, Heterodera glycines
caatggcgaaagaaatgagcaaaacgatcgaaaggaatacaacccaagagatgagcgtcagcttcaaaaacattcatctaaaaagaaaacgacaaatgaaagagacttaatacaatttgagaaaagactgatgtcgagggacaaaactccgaaatttagaaatataaaattaaaggagagagagggagaaaagaccggaccgaaatggggaacaacgtacacaaaaggcgggggcaaacactcatttgagggggggggggggggctgatccagtcggtcactcaaatgtaggctaaaaatggaacttttggtaaacaaagataatccggggaatgggattaggggatggtcgaaaagcattgtaaagggaaagggcgggggaggggggagagatcggcgagtgaccgcccgaaaatcccccaaattcttcgctatgaaatgacagcgactcttttgcttcggttgactgaagtgtttgttccccgtactcccttcttttgttggtgtgtacaaacaaatttgagtataaaaacacttcaggacggatggactcatggaaaatgcgggggaaaagggcgggaggcggggaaatgaacaatttgcgcggaggtgggggtaagtcatgtgttgagatcgttgaaaaacggtagtgcgtcgtgtgcgctgtccacactcaaaggagcggcactccagcgaagagatcactgtgggaatgggccagcctggccaagtccattttgaaggtgcctaaacggcaagggcccattgtgccgagttggcattgcccttcaacagaccgtcctttgcccagcgggccgaccaactgttgaccagcagcaaatattcctgctgtgcgttgatgccatcgctcggcgcatttggacgcctctgacggccccatccgatcactttggcacaatggtcgtacacgtgcaattcgcccgggaacaagtcgaagtcgtaaacc

SEQ ID NO: 44328 - DNA, 1311 bp, Heterodera glycines
aacaggcgggagtcccgcttcagggcgcagattcaacccatcacttcacaggcaagatataaattaagaaaacgaaaaacaggtagggtaaacttcgatgaaaaaaaaacgtagacattttctcgggaaccattcatttcaatactagaaaatttcagggaaacaaatgtagatgagtattcgtggttttcaacataaatctatcgtagccagtaaacggttttcaaaaatcttcaataaagattcggctcggagaaaaaaactcggtctttcagaggttaaatctaaaaaacttcaaatcggagcttttctccttcatttcgagtcaaaaaatttattttttcgaattggatcggtttattcgtttctccttcaaaaaattctaaaaaacaaaatcgggtaattcttttcgaaattggtgtcccaacgggaaaaagagataaaatttgcaaaatccgaactcggatttatgatcatcgcattttttactagcaaaagcgattttgtaagaaaatatttttttttctgtcgagacaccaattccgaaggattaccaacaaatttattgttagcttcaaatgttttggaaggagtctttccattgcatgtgaaaaaaaactaattttagtagcaaaataaaagcaaaatattaatgtaatttaattcggcctttgaaaattcacagtcctatttttcttcctttccgaattcagcaggggttcgatcgaaagaaacccttgctaaggctttcaaactttcgaactctaaaaatcatcaatttttcattcttatttggcttacagaaacgaaaaagcaaaagtattatattcagagtcctgttttttaacatattcgcaactcgggagctgttttttatacttatctctccgacacaagaagattgatttttttttttctttacgggctcatttttcgtgcttattatctacactgcgattcaattttgggctcccagtgcaaataagtttattatttatttagtaatcataacgccaaaactttgcaaaacttaaattttttgggattttcccttgtaaaaacggaagagccgatctcgagttaaaaagcgattttgataaaaaacgaagcatcatcctataggttgggttaaactatgtgtttatgcaaaatttcgaggaaatctgaccgtaggaaaaaatttttgactctagtgaaaatttaattaaatttctatcgttttttagctaattaattattttcttaaaatatgaggttaactgggacggattctccgagaattttcccatcaaagatgagccagaaaatggt

SEQ ID NO: 44329 - DNA, 1820 bp, Heterodera glycines
  misc_feature (66)..(66): n is a, c, g, or t
aaaaattaaaatttttggccaaatttcatgaaaaagcggaaaaatattttaaagtggataatccanagttacgtggatttatttttattttacctttttctaataattctgtataaaaaaatttagttttttttataatttttgtcaagagtaaatctctttctctaagtgattttttccaaaaaaaaattgtttttttattcgtaagaaaattttctaaatttttccgaagaaaactttgtttgtcaaaaattataaatattataaaatcatttccggcttcggaggctaattgaaattcgaatcattaccgccgttttttcgggagagaagcaataaaaaagtaaaaacaaaaaaatagaattaactaaaaagaaacttttgatcggttaaatataaacatttcgaaatttcttttttttcaaaatttaaaacattttgctaatttcaacgacttgaactccattttcatcaaaatctttcaattaagtattgaaatacaaatacttaaattaaagaattgcgagggagtgcattaatatttaatttcgtctttttttgtcatttcttttttgttaaagttgctgtgaacgtcactggttacaattcggacaattatgttttgatgatctaatcctatgatatttagcgggagtttttgcttagtatcaaaaaacgctgaaattttcagcagggtggtcaatgctgttcccgcgccctctcacttcatttgcacttcatttgcacgagggattgccagccacaagtggcaaccgaaaatatattttttgcagtcatttttatccaactaattaactttttgttttatatttaaaaaattaaataaattattttctatccccttttttgaaataatttatctaaagttaattatttttcacaaaaaaataatgatgatggtgctgatgatcattgtgaaactgaccaaaaacatttgtcgagccactacctttcacgggcggcggcaaaaaatataggttctcatttatatcacctgcttcacaattacagctccatctgatatttgatccctcattctgcaacgcctcaaattttccacatcccacacggatgagatattccttgttattgtaacacgacaaggcaaccaaagagatgttttgatcaactgaaaaccgaatagactaagttgaaaatttttccaagggtgaatttttcggaagtaaaagctatgattcatgtaatatttatttattttgatgtaaaactatgcttcaattgtttaattggataaaaatgcgaaattttcgccaaaatttgaccggtttaacttatattttggagaaaaaatttttactttttgttcgaattcgaattcgtgcccagggttcgaattgggtaaatccaagctcagattagtaatcagcaccctcgaaaagccttcgagaaatgaaaaattttaaaaatcgtctttaaaattttttggacaatatttgaatttaaaaactaatgtaactcaatactggttttgtagaattttttttgaataaatttttttgtcattttacacccttaaatttgaggatttttagtgcctatttttccattttttagtgcctattttcggggttttttagagcctaaggcctacaaattttgacggtttttagtgcctataaatgtaatcccttttcataatgttgtatttaccacttaaacaagtgcctcttgtacaaatttggtcagtgggtttgcactgtttgatgacaaagacatctgcagtgctttcaattccactgttgttaagtgcaccgctccaacagttgagagcttgaaaa

SEQ ID NO: 44330 - DNA, 1573 bp, Heterodera glycines
  misc_feature (1504)..(1504): n is a, c, g, or t
  misc_feature (1526)..(1526): n is a, c, g, or t
  misc_feature (1558)..(1558): n is a, c, g, or t
tcctttcctcccctcctttctctctctctctctctccctttctcctttcctcccctcctttctctctctctctctctccctttctcctttcctcccctcctttctctctctctctctctctctctttccctttctcctttcctcccctcctttctctctctcttgttccctttcctcccctaactctctactctctctctctttccctttcctcccctaactctctactctttctccctttctcctttcctcccctcctttctctctctctctccctttctcctttcctcccctcctttctctctctcttgttccctttcctcccctaactctctactctctctctctttccctttcctcccctaactctctactctttctccctttctcctttcctcccctcctttcactctctctctccctttctcctttcctcccctcctttctctctctcttgttccctttcctctcctcctcttctttctttcattctcttattaccttcccaattgttctgcgttttcggtgaccaacgaaagatcgaccaaattgcgaattacaaagtccaaagtgtcggcaaaccttaaaaaagaaagtgccaataaaagaacggtttgatgaataaaacaaaatataaaacaataaaatttaatcactttccattcttttacagtacatattcgtatgtgccacaaaatttggctccattctcagccttttgccattcgatcccttctcaattccgaaggtcgcttttaactcttcggcttccacaaaaatcgcttaaattcaatagaatttattaatttgtttttctttttaccttcaaaaatgtctttggccattcgattctttggtgactttttgctccacgatttgattacctcaaatttaaaagtaaagcttcatttccaaatgcccaccaaatggcattggcgcggagtcattcgttttggcctttgaattgcgccgtttcgcgctgcgactaacgccgcgctgctgcaccgtctgccttaaaagcgaacaaataaattaaataagtttattaatatgaatgaattattttacgctgccgggccctttccgccgccgaattcattggcaaatcgccacttccattcgatggggtgccaatgttattgttatgccgatctcaacagaatgcaataaataaaatattatcggaattaatttttctgaaataattatgtaattagtttctaattggtttattttctctttttgccaatgtttgttcttaccccccttcgtttgttctgcgcttcttttgctgttttgctgaaagtcggaacggcgtctgaaatttaattttcttattttcgattctttgttttataattgcttatccattttgatcatttgcctgtttaaccggtgattcgccactttttttgccgttggcggtgattgcgtcgaaaagcgcgtgtcgcagtgtttgcattgcccatttgtttgtgcccattaaattgcttttataacgatnaattgcaaaaaaaaataaattntaaaagtcattcaaaaagcgtttaattttaanttaaaaaaaatttta

SEQ ID NO: 44331 - DNA, 836 bp, Heterodera glycines
tttaactgttattttcttttatctgactaactaattgttttatgccaaagtttggatgaagaatagcaaattaaaaagtaaaattttcaccggtaaaaccagaataaaataactttttcagatttttaaaatgatttttggtgtgcttttttaaaatatatcattaaattcacaaattttctgcctttgaattgcaattcaaattttagtgaattaatctgcacttgaaaatatattatgaataagaacattttgcaaattgcttcaaaatgaatacggctgactcgactaattgaattaataattaaaatattagcaaggtgtataattgatgcttcaaacaatatgttttatactaattttggacgggccttatattgcaaaaatttattttaactttccgctttgaaattaaacacctttataaaacaatttaaattaattttttaattattttttaatcaaagtactaatttcccatttattaattatttaatttggaaaatttatattgaaatttttaatgatgaataattatgatttttttgaagcaaaaataaatttatataagttaattttcaatattggaaatgaaaaaatttatgaatattaatagtcttaaatgccgattcaattgtagtgaatgatcaatggctaaattaatgttatcatccttacgatgattattatagtttaaaattatattcatttggcaattataataattgtaatacaattttttcattgatattattaatttgttagaaaattaaacaattatatgaataaatattttttacaattttcaaaaaaatatttttaatcaattaactcgt

SEQ ID NO: 44332 - DNA, 804 bp, Heterodera glycines
ggtgtctgcgacaattttgttttggtttattgtagaattagtagttaatctcttttttggggctgaggagaaattcatctataaacataattttttgccaaaatttactaatctcgggcttggcccacttttctctccctttcgttgactaatcccacaggcattggcatgttatcaatgggatctttggtggaaaatgtgccgtctgttgttctcccactcggcccttcccggcactgaacgtcacactccgcccgactccgccatcggcctaccataccatcgctcgcacattggcctatcgcttcttcacattcttcgcccttaccctttctctgccgccctgtgccctcatctcgcgcacactttcattgcacacgcccaattggaagacttcgtccgcccccatgtgaaaatggcgcatgccgaaccgcgcgtgcacttccgccacttggactaccatcgttttgagcagttcaaatgcttcgtcattcccaatacaaataacctgccaaaaacaaacaaaattaataaatgcattaatacgaacaagccgaagaatcaaaaaaactgttaatgcaatacaaaaatttgccgaattttgcaaaaataatattttcatataatttttcaaagcggtgttttcattttattgtacatttctaaagttaaccatcaatcaatagaaattcacctgaggaaactttggatgctctctgagatgggcgaactgctccaatttgagcacccattccaaatggccaaatgtttgcacaagcggaataatttccaacccaatttgtt

SEQ ID NO: 44333 - DNA, 1657 bp, Heterodera glycines
  misc_feature (1533)..(1533): n is a, c, g, or t
  misc_feature (1565)..(1565): n is a, c, g, or t
  misc_feature (1630)..(1630): n is a, c, g, or t
ttttaaaattttggctaaatgctcttttaaaatttttttaattaaattttatttttttatattcacgtttttttctcccatttttagacactctcatccagctgtgctatccgaaatgcgaacaatcggacaccggcacctattccattcgcattgtgaacgacttgggctcggattcggtggacttgcgcctgaaggtggtcgatcgccctgcaccgcccgaggggtcattgaaggtgctgaacattgggaatatttttgtaaacagaaaatgatgagaggggcatatttgtaaaacaattaggaatggattttttgaatttttttctaattaattttaacggagtatttttcgtttttactgttttttttttacaaaatattcttttaaatatttaatgtataaaaatatgaacaggagcggaccgcgtccagtagcggaaggcgacgcgttggcagcaccgcggcggaccggcctgcacaggctgcagcagcggtttgcgctgcgggcgaagaggcaacagacgaggtggacaacaacgaggaggagcgacaggacatggcggtggtgacaaaaaggatggcaattttggtaaaaaaaatttcaaaattattgtgtatgcttttcgggatttttgtgcttaatacctaggcgccttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcgcccgaaaaatgccattgaccgacgaccgagtgcggtgccaaacggacggtgacacgggacatgtaagtggcaatttttaaatgaaatttttaaacacagaaatttaaaaaaaactgctgttttttggaaaaaactttttttgtgaaaaagtcatttatcataaaactgagaaatcataaaaaattttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaataaaaaaaaatttatcaaattctaaaataatgttaaaaatattttatcaaattaaaataatgttaaaaatattttatcaaattaaaataatgttaaaaatattttatcaaattaaaataatgttaaaaatattttcaggtttctctgatcatttccaaatgtcggccacaagatgggggcgagtacacattgatggtgaagaacgcgcatggcaagcacaangttggcgccaagctgcttgtcacgccagcggncgaagtgaaaaaaatttgcagccaaattttaataaatatatttacaaaaaataaatttacagtcnaatttggacttccggggcagcagaaaa

SEQ ID NO: 44334 - DNA, 953 bp, Heterodera glycines
ttaaaattaattattcgctcgcctcgatacgaaaagaattggggcgtttgatgcgccgcttaaattggcaggcacagagaaaagaattcggagaaaccaaaaagtgatcggttggctatcagcagaagagggcaaaaacagataaaagacggagatcagaaagtatccgccgacgttaaacaaaacgatgagaaggagggagaagaaaatgtgccgttggtgggaaacggcggcggacgacggagcggaccctaaaaaagggaacgggaaaaagtgagaccaaaaggaggaaaagccgggaaaaagtgggaccaaaaggaggaaaagccgggaaaaagtgggaccaaaaggaggaaaagccgggaaaaagtgggaccaaaaggaggaaaagccgggaaaaagtgggataaaaaagaagaaaaaagccgggaaaaagttggacgaagaggaggaaaagccgggacaaaagaggaaaggccgggaaaaagtgccggctctaaaaagaggaaaagcttggcaatttttaattgaaaggaaataaagtaaaaagttgtcactgtcagaaaaatcagcggactgactttgcttaaagcggagcaaaaaggcgacagcgacgtaaacaaaaattgtggccaaattacagacgaatttcgaatcagcgtacacagaataagcatatccaccctgggaattaatcataaataatttttttttttttttgtgattttggcacttttgtgagtaattcgccaatgttcccagtgatttccatcgaagggatttcttcgcttcgccgccaatacaaaaagaccaaaccgacacttggaacggtacaaaagagtacggtaatgggaacataaggccaaagatttaactgattgtatctgaaaggggaacatatgcttaccgttgttggcttttgaaatggtaaaattgccaactttatgggaaaa

SEQ ID NO: 44335 - DNA, 1090 bp, Heterodera glycines
ttttagtgacaaaaaatcccgaaatagttaactaaaatagttggtaaaaatgttaaaatagtgacaaaatagtggcaaaaagtccgaaatagtgacgaatagtgacaaattttcagccaaaaattgagcaaaaataatttttattcactgattgcagttgcaaatgagtaggactgggatttttaagaccaaaaaacccaaaatagttacctaaaaaaatttttttaattaaaaatttttgccaagaaagtaaatttttgagaaaattttttttcatttcataggagtatattttgaaaaattttagctcgattcttaggggtgtattttttgaaaaaatttttagatcgattcttaggggtgtattttttgaaaaaatttttaggtcgattcttaggggtgtattttttggttttattgcatttttgttaagtaattttccaaaaaatgtcgaaatagtgaaaaaatagtgacaaaacgccaaaatagtgatttttaactattttagtgacgaagtagccaaaatagtgatttctagtgaccgatagtgacatcagaatcgaaaatttttaatgcagaaatgcgttttttgagctcctttcttcaaaacaattgagcaaaaaatttagttaaaacctaaaattcacagccctacttatgaagtaaaaaaaatggaacttgtaatgttagagagaaaagaagcgcgaaaataattgtaataaagttgtttattggtaagttaagttttaattgtttttaattccaaataattctgataatacaaaaaataactttatttacaaaacggagtaaatgaaccgataacttataaatttgttttaaataaaaaaaattactataaacataatcaaaaatcatctttgatcaacatttttcgggtccaaataacttcaattgctaagcatgcaaacaaaatatctagcaacataatcattatatttgcttttaacaactgaaagtcagaaaagttactctactggttttggtttcttcacactaaatgggcagatgtttgtcaaaaaaattcttgagtattcaaaagtcaaaatataatttttattaaaatata

SEQ ID NO: 44336 - DNA, 945 bp, Heterodera glycines
  misc_feature (827)..(827): n is a, c, g, or t
tttttaggaaattttctatctcgtaaccccgatgctcattcgatccacagagactcttcaaaattttttccattaccccatgagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattntttccattaccgcaagagttgcggaaattgtgaattaattctcagaaaaatggctatctctttttaggacaattgtctatctcgtaaccccgatgctaatccgttccgcagagcctct

SEQ ID NO: 44337 - DNA, 547 bp, Heterodera glycines
ctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaaacttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctagttttagcgaattggtgcctttttagcgttttttccgaaaaattcaattcaattcaattcaatttatacgcaaaagcgtgacaccgacattaaaacaaaataaataaaataaaattgttcactgaatgagatggggcggtttcaaaa

SEQ ID NO: 44338 - DNA, 1148 bp, Heterodera glycines
tttaagttttttgttttttgtcgctttcaaaaacgtaaagtaaataaaaatgtgtctgatcgcgtcgaacgattttcgaaaatgttctattagacttgcacaaaatacgaagattttcaagtacatatataaagggcgacatgaagtttgggcaccaaattaaggatttaaaaaacaataaatatgtaaaatgctaaatcggtaaaatttagtaaattttaagaacccttgtgcatgcattttccaaaaacttgggccgccgccgaagaatagaccctattattcgtcatgatttaatttgataaacatattcttgttttttaatccaatcggagcctaaaaaaatacaaaacgtgcaatatttatacaaaaaataacaaaacatgaaatgaaaatatgcagaacaacaaagattgtgattgatcaccagtggttcttcccgccttctcatcagtgatcgccctccgcgtcctgaggctgcaatgggtcgttgagtgtttcttcatctcttgctgcaaaagtgcaatgttatgcatgtataaacaaaataaagttaatactatagatggtgggccctctttttggaagatatttttttgttcaaaaaactcgtgaaaaacttgtctatgggggttctcagggttggggaacccgaatccgaacaaaaagttaaaattcaaaattctcacttttgttccagaattgttgaaaacaagctgaatccagtcaaaaaccattgaaacaccgaaaaataattattctgtatagatatgaacataaaagtgaattttgaaatttttgaattttcgacttttttgtttgaattctggtccgggattcagaattggtaaaaatgaatgttgtattcggattctccgacccagaaaacccccataaacatgttttcgcgacttttaataataaaaaaatttttccaaaaagggggcccaccatccatagtattaccaaaataaattctaaaaattgtttaaaaataaaagaatttcaattgttagtcaaattttcaatggtcgaagaagtcggtaaaaaattaaaaaaaaattgtaaccaaaaattgaattaaaaaaacggtttgaaattgaatccatatgggcgccttaccaggaccggattagtcagtttaaacg

SEQ ID NO: 44339 - DNA, 1173 bp, Heterodera glycines
  misc_feature (1052)..(1052): n is a, c, g, or t
  misc_feature (1080)..(1080): n is a, c, g, or t
tattccctcatttttttgtggatcgacctagcacccctcttttccaaggcttggcagtcggagggtttggcactgagtgtgagcagtgacgaagcggcaaaactgttcgattcggccgtccgtcaattggtttctttgacggattgtgaccaatttggtggaatccacggcaccgcaaaacgaatgatcaaagcggagcccgaattttgtaaaataaaacacatttttaaaagcattttgccgttagtgatgggccgcgttttttctcttggcctcgacgcacttggcgtcggaagatccatgcgaaccgatctcaattacaaagccgaattggacgcattgttggcagattcggcgaagttgggcacagttagggagcagagacatgccaatgctgtccatttatttgctaacgggtgatgctaatacatttaatacaaatatatttatttaattgcgttatcccccgactttcccgccaccgatcgaatggttggttggggtagttgaattaatatttctcatttttcaaaaaatattcttattaaaattaaaatcaattttttaatagctttcctttgttattaaataaaatattgtggagaaaaatctaaagtttaaaatttttttaaccttaaataaaataataatacaatttttttagttatttcatcgttattctaaataatgtattattaaattttatttgaaagagttataccaacttgaaaatgaaatttgtacagagaaatgcaaagtgcgtgcattgagtgggaaaaagttttggcagaacatccgaatgatttgttggcccttagattttcgcatgatgcggtatttttgcttaacatttctttacattttcatcaatttccatttagtatttctttgtcggcgattgctacggtgaatttaatttatttttaattaaataatttaaattaatgaataatgattgaaaatgattaaggcaaaagagacagcgtcggccgagtgattgaaaaatgggacaaaaatgccccgtgttacaggtggaaaaacacatgcaaatncaatgccgaatggagtgtgatcgctganatttgaacagctatttacatggaatgtacgccttttgggctggaggagtgcgagcagtacgcggaggcggacgccaagcgccggttgcgctgc

SEQ ID NO: 44340 - DNA, 1325 bp, Heterodera glycines
  misc_feature (83)..(84): n is a, c, g, or t
  misc_feature (210)..(210): n is a, c, g, or t
  misc_feature (235)..(235): n is a, c, g, or t
tagcatttcaaatattcgtgtgagtgtttggtagagccagactagagaaggcaaatgttggtaccaagttgcgggtcaatccnncaggagaaaaagagatagccatttttcggcaagatttttttcgttagcatttcaaatatcgtgtgagtgttggttgagccagactagagaaggaaaatgttggtaccaagtttgcggtcaaatccncaagagaaaaaagagatagccattntttcggcaagaatttttttcgttagcatttcaaatatcgtgtgagtgtttggtagagccagactagagaaggcaaatgttggtaccaagtttgcggtcaaatcttcaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggagaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaattttttttcgtagcatatcaaatatcgtgtgagtgtttggtagagccagactagagaaggcaaatgtttgtacccagtttgcggtcaaatccccaagagagaaaagaatagacattttttcggcaaaaattttttttcgttagcttttcaaatatcgtgtgagtgttt

SEQ ID NO: 44341 - DNA, 1072 bp, Heterodera glycines
tgacgttttgttgggttgaagaaatgcatattggacaaaaatccctttaagaatgttgccgaaaactgtcgcatgtgcaaaacaacagccttattaaaaaaaggaaaaacatttgtttaattatcagacggtctttcaaataaaagtctcgagcttacgttgtcgagttcaagtctcggtagtctgataattttatcaaacaaaaataactcaattttttcagttgattaatgctttcaattttgaccgcactttgtgagttaagcgctgcttttttgctccttttataggcaacaaatgttaaaatgttgatcagaagtgccaacagaaggaaaatggaagatgaaactgccttcaaaaagctgttataacgaatatttggccgtccctgattaaaaaaaatataaaattcttaattaatttaaattttgaatttcaccgggtctttctttgtctccgaagagaaaactgttgctgtctaaaaaataattgttgtgcttggcacagtaattatcattggtaagatcaacataaacacaattaaatgccaaaagtactttttccataactaaaaaataacgaattaatttaactaattattaattaccattttgtgacggaatggaaatgcaattgcagtgaaacgattcaacaaaatgaaaactgtcacaatgtttgagactttgaattcgaaagtttttacgaaaaaggttaagaaaacgattgcccaatttggtacggtgctgtaaattggcaacaattgttggccaaagaatgcaggaagcaaattgccaaagttattaggcactaaattaagaagatcctaaacaaaaatcattttttcataaattttgaaatattttttttaaatagcttacagcaacggtacggatgaagaacaatttataaaatgatgactttgaaaattgtttatgccttatgatggtaatcatttccaaaatgtaaacaattgtcgaaggaatgtcagtgcaaattccaaaataattaaataactgtcgatgactgagcgaaaaattataaatttggtcgagcatttttttgccttttcaaa

SEQ ID NO: 44342 - DNA, 1721 bp, Heterodera glycines
gagacaactgctttcttcctttgccgcggacacagacaaaggggttgttttttccactttaatttcaagcactttgttgcaaacatttgttgttggcaggatctaaataagttgttttataattataattattttcttaaaaattattttaataaattgaaagttttttttattttttactttaattccaaacagaatgtcgcaatatgttttcaacataggcgatttgtggttcaattcatcaataatctggtattttatattaccggtttttgtataaccatttgagcataagtcggtttacttatgttgttctcgagaggttgtcccgaagcggacttctgtggattgtttttatttacttttcctttgtcttagtttaccaatggaattttttgatatacatgtgccagttaggttcggcagcaattgtgtttgagtaaaatgtcttctttgcaaaatttgtagacataggcttaaatgtaaagaatttacagttaaaattagtctttaatttaaaaatttgatttattaatttataacaaaaacctcaaattttctttcaacaaaaacaactccttcccatgcgtctgcggtttcccattgcattgttttgtcaaatttcggcaaaattgccgacttcttttccaagttttttgcacagttcttaatttattagttctgaatttattgatatttctaataccttcttcaaaggcataaatccaattggaacccttttctccatttttttcttcaattcggtctcagtcttccactaaaagtgtaaataagattatagagtaagtacaatacaaattttcattaccaaaaaaggacgttcctttgtgaccacaatgaacgcattcgagttcccttttttcacaacattcttaaccatcggttgggcaactttcggcatcaatacttttttttccacctatatacattaaacaatttaaatacttaaatatttttaattacgggcgccaatccaggaattattttcttagtcgccgtagaaaacaatggcgcaacattcggccatgcgatttgtgatggcttcggaacaatctgatgtcatttgtaattaatactatcatatgtaaagggtttttacagatcttggtgcatcagaattttgggcaatcattgtattttcaatgctttcccagcggtccaacaatcgacgacggagacacccgatgacgtgtccgcccatggttatgcctgcaccaccggcatccatgatttcggctatcacaccattgatgtgtaacagctccgtcacattgtcacgaccctttgatagattttagtcaaactatttaatagaaatttgttaagaatatgaaattttaattacttatttcattttattttttattttcaatttgttacatttagatgaatattttttattaatattttttattaacctcaatgggctttgacaaaatttctagatcgtactcttcagcacacttaagatccagtttgtgaccgcagatcacgagcttctttggagttatttggacaatcaaataacgcatcttggcgaagaattttttggagatagaaagggaggaatagctgatatttagagttttctgaaattataaaaattaaattaattaaacaaaaacaaaaaatcactaacaaattgtggggaataaatttatgtttattttaataaaatatttttagggccgattaaatga

SEQ ID NO: 44343 - DNA, 1427 bp, Heterodera glycines
ttctgaaccgttttgagtagattagactagaaaaaattgaaaattttgaaatcatgtttcccactcccttctcccaggggtattattttgtaaagtctttttttcaaaataaacttttcaaaccccttttttcgcaccgtgaatgttatttttattgaattctgaaccgttttgagtagattagactagaaaacattgaaaattttgaaatcatgtttcccactcccttctcccaggggtattattttgtaaagtcttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccccaataaacttgtcaaacccccatttttcgcaccgtgaatgttatttttattgaattctgaacggttttgagtagattagactagaaaaaatatgaaaatttaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttat

SEQ ID NO: 44344 - DNA, 732 bp, Heterodera glycines
  misc_feature (44)..(44): n is a, c, g, or t
  misc_feature (47)..(47): n is a, c, g, or t
  misc_feature (70)..(70): n is a, c, g, or t
  misc_feature (87)..(87): n is a, c, g, or t
  misc_feature (110)..(110): n is a, c, g, or t
  misc_feature (112)..(112): n is a, c, g, or t
  misc_feature (131)..(131): n is a, c, g, or t
  misc_feature (133)..(133): n is a, c, g, or t
  misc_feature (144)..(144): n is a, c, g, or t
  misc_feature (149)..(149): n is a, c, g, or t
  misc_feature (170)..(170): n is a, c, g, or t
  misc_feature (229)..(229): n is a, c, g, or t
aaaaacactaaaaaactattttacatttttaatttatacaactnttnaaaaaaacacaaaaattcaaacncttttatacaatctaanactcttcaatccattctcattcncnatacccaataaattttacnancatctctcttnatccntccaattttcttcactttctntacactttttcaattctataactaatttcttcatcctttcttacactttccaactcctnctcatataacattccccttaatttttcaccacgatcatcttttacgttttattttatttttacacatcattcaattctatcatattgataacgatttaaatcattaaaaattaacccttttttgaatgatatctcaaatgaatctctactccaatttaatgaccgattaaaatatttagaaaattttttctataatcttttaaatttccgacttccgataattaatgcaaagtaaaaaattagaaaatacgttcttaaatgatatttatggtttatttttatattcaaatttaactttataacctataaatttaaaataagatattctttcttgtactcgacctatcaattttatcgagtcattaaaaatttttaaaatgaatatatttgatttttagttgtaataatttaattgaattcgacctttgggttatgtatttagaattttaaataaaaatgtccactttatgtctggtttcacattacctaatcaaattttgcaa

SEQ ID NO: 44345 - DNA, 921 bp, Heterodera glycines
ctcaattgggtggggggacggccgagcagagcaaacgttacggagtccaggggcgaaatccggcggagagccaaactcagggcgggctcttacggcccctcttcacgcggacaaagccgagcgccgttagcgactccgtatttgttttccacgtccgcttcatctcagtgctgccagtgcgcaattggcgagccggggccatcaggccaaccgggacccgtaaagcaaagggaagctgctaactgaattcactttttaatttcagcccggagttgctggcccagacggtgtccaggggaaaatcggactgcgcgggtcggacggaattccgggggcaagtttggctgaacaagaatggtgtgtattttcattaaaatccgaattttatatgatttgcattcgcaggtgctttgactgtcctcaagcaccgcccggcccaaaagggccaaagggaccgaaagggccgaacggagtgccgggactgccgggaagagcgggaaaacgttctcaaattaatttatcccttaattatatgggtataagtttagccggagagaaaggccctcccggggtgcccggttcgccaggattacccggattggtcggtccgaacggtccgcccggcccgaaaggggagccgggcaaggtaataagaaaataaggtgattttttaattacaaaataaaaacacccatttagctgaatgatctgccggcagcaaagggtcccacggggcttcacggcctcgacggccctctcggaccccccgggccagacgggccctccggcaaaccagggccaagtggaccacccggacaactcgtttgaccatttatagcacaaattcagttgaccgattggatgtttagggtattccgggtcaaccaggaagggccggactcaatggccccaaggggacgc

SEQ ID NO: 44346 - DNA, 936 bp, Heterodera glycines
gtaaagtctttttttccccaataactttttcataccacatttttcgcaccgtgaatgttattttattgaattctgaaccggtttgagtagattagactagaaaaattgaaaatttgaaatcatgttctcactcccttctcgcaggggtattatttttagtcttttttccacaataacttttcaaaccccattttcgcaccgtgaatgtatttttatcgattctgaccgttttgagtagattagactagaaaaaattgaaaattttgaaatcatgtttcccactccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaatgaaaattttgaaatcatgtttccactccctttctccaggggtatt

SEQ ID NO: 44347 - DNA, 1060 bp, Heterodera glycines
tgcactcggcctttgagagagcgttgtggaagatattcggaatggaaggaagtccaagccgaagagagaggagcaaatgtggaaatggcaaggaaaagcatggcgagggaaagaggaggaggagaaggagctggacgggtgtcaagcttatgaaggacgactgacgaacaaaaaaaaacaatacgggcaataacttaatgaaattcagggaaaaccaaacaattaaaattgaaaatattccataaaatttttcgtaaattataaaaataactcaattgataaaatcgaaagacacaaattatatgatgaaaattttgaaattaagaggcaaaaagcaaaaggagagaaaaattgagagggaaatcgattgaaggaatatttttagggaaacattggaggaaaggggggggggaatgaatgcaattgtgtacattttcctgcacatattttgtttaagtgtttgttatgtgagggaaacagagaaaaaagatcaaatcgatcaccaaaatttttttatgattaatccgagcacaagcgaagcgcattcattttagtgttcgaattcatgctttttagactacatacaatctcctgttgtccaacaatattaaatgataacagtcaaaagagaaaatccttaccgttttatttcttttaatttctcgttcaatgtggcccttaaagtttgttgccgaatgtgaactaacagtagagaccggacgggaccgggataacgccggaaattgccgggactcccggtactgccccaaatttgaaaaatttaataattattttggcgaaatgtttttatttcaaagttcgaacatacaacttaaggatttttttaaatttgtacaatttcaattgttaaaaagatcccaaaatccatattcaaaattgcaattttgttgaaatctcttaaaatggatgtaaaatctgcaaaacttccccacggacccctaaaatccttattctcttaaaaaaaaattgacgcagaatcccaaaattttggtctttttttggacaaatctgtcaacaaatcgcattaaaaattgcaaaa

SEQ ID NO: 44348 - DNA, 1492 bp, Heterodera glycines
  misc_feature (34)..(34): n is a, c, g, or t
  misc_feature (74)..(74): n is a, c, g, or t
  misc_feature (95)..(95): n is a, c, g, or t
aaaatccaatcgctcatttccccactgaataatntaataataaaaaattttattgttttttaattttattttgncatagttttcaaatgcttttntaagcatgaaataaagcaatgattttattacaaaaatgaatgatgttttattttgaggcaatcccataataaaattattttggcaataaattttttgcccaattttggacaaacgataattttgtccatccatataaatatttaaaaatttcaaatttttgtcatttaaagatttttagtttatccaattttcaattcattccccattaaaaataagactaattaaggtcctattatgtcaagtggttggaaatttgtgctttatttcctcctgctgctgctgctgcttgtacaattttttgctaatttgtcaaacaattaataaacaaatttaggcctcaattacaaaagccaaaatttttgttgataagcaacctgccattgaactgaatgtgattgttgatgatcgcacgcctacgcgtaaaaaactaattaaatttaattaattatttgaaaaattttagtgggagccaaaaatgatgaaaagccggcaaaaatccaagttgataatgagcaacaaaagcgtgaagaacgtggcattgaggcgctgccttttttgtttaacaaaaattgtgaactcgacgatttgatatgccaacaacgtgaatgtaggaaaatattatttcatatcatataaaaagggtgggatacgaccgaaattgaaaattcgaaatagggttcaacgtcgggaaaatttgcgaatttgcaccaaaaaacccagaatttgactaccttttttaagggcttaaactgagtcttaaattttaagacgaaagatagggaaaggcaaatatgtttgaattttcattgaatttttagagaaagttggcattatttccagcatattccctcattatgtacagaaccaaatcccacattttacttaaataaattattataagactaatttatcattggaaaatgcattatatttcaaataattaaaataatttagcgagacgaaagacgagggaacaagacggtataattaaatatctttgacaatttctaaatttatattttagaattggaaaaatttttccattcaattttcaagtaaggatggttttgtaatttttttattgcatatgaccattttttcctttttttaattaagttaataaaatttaaaagtttaaaatttcaatttgaaaatatattgaaagttgagagcataaaaacccggggaaaaagggactgcgctgatctctattgaaaacataaaaatttactttattaaattttcattttgatattgtttaactttattagagaatgatgactttatcatgccagggtccaaaaatagcagcggttttggaacctttcgtaattttctaattcgggttttactgtaacaggccttggtcccgactaggcatgccagaatttttcaa

SEQ ID NO: 44349 - DNA, 933 bp, Heterodera glycines
atagagtataaatataaaaaatttcctcaaaaataaaaaggtctattgcgccccgccctccctatcatgctcgagagcatttgtatatgtataaaatttatcaaaaaaagagatagccatttttctgggataacctctaaatataaaaatcctctgtgaaataaaatggcgattgtgcaccgccctccctatcatgctcgagagcatttgtaaggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtaaaataaaatggcgattgtgcacagccctccctctcatacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatctctctgtgaaataaaatggcgat

SEQ ID NO: 44350 - DNA, 1016 bp, Heterodera glycines
cccccccccccccccccccccccctcgacagacaatattcaacaaaaatttttaaaaatgactagagcaatcgacgctaacggacgacctaatggaaaaaaatccccgaaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacag

SEQ ID NO: 44351 - DNA, 1294 bp, Heterodera glycines
cattcttatcactttccctctcattcttgcttccttttcagcaccaactcttccccgctctgtttctcttccctctctctttcgcttcactctttctctccctcccttttctctactgacaacgcctcctctcttccttttccctcctttttctccccttttttcccaatttttcgtccgctttgctggtgctcgtcaaacagaaaataaacatcgaataaagttaatattgccgcggatgacataaaaaaacaaaggcattgcccgcggcattccccgcgtcgttttccctcccttttttcattcattggtccttccgtccgtccgtccgtccgtccgtccggtgcctttctcttccggcaatcgtcgaaatcggagacatttattttgtaatccctgctgaaattcgcccgctgctcaattggcctttcgtccccaaaatttggccctgtggcgtcaccgccacggcgacatttgcgaagatacgcccggcggggctaagtgcggccaattggccggccccgtcaatcttcatttcctgctgctgcggttccgtcctccgattactccgtccctccgtggtccattcaaattattcgcctctgtttggcatttcgaagtgccccttggcaattattcgctcattcttccgacagcccccgcggcgtttcttcccttccccggcactgtttggctgagtttcgtctttggcccccgcttcttccgcgcatccgtccaccctttgcgcatgcctctgccccgtgcggccccgtccccgtcgttctcatccgctgaatctgtcaactctggccccacagcgcctccgtccgtccgcttcccccgcttttcgggcgttcgtccttctccttccgcttctcctccgcagttttgtccctatctcagcgcatccttcgggccaaatggcaaaaacatttggacccatgggacaaatgccgcagcagaaacagcagcagggaaagtgccggccgatcggtgagtgccaaagtcggcaaattcattggccattctttgattttctgccaaaaaactctccatccttgggaagggagtgagtgctctttttgcattttgtcttatgactgataaaataatggtccaaggtttgccccccccccccaattcttgcaaaaataaaattaaaaatagattttcaattggactaatcaatcgatttactgtccgattgacaattaattagtggccaaattaaggccatcgctatgtgatcgacgaaatgggctgcgaccttttcgcggtgatggtgacatttgct

SEQ ID NO: 44352 - DNA, 353 bp, Heterodera glycines
atacttggtttgtgttattgttattatatagaatacatctttctggaatggacaatataaaaaaatataaataataaaattttattataataaaataatgaataattattattattgagattaatcaatatatacaaatatttaacaaaaaaataactatccgtgtcaatgaaaataaaactattttttcgggaatgtttaacaaatttatctgataattgttttggttggatatttgtttgagattaattatccatgttgcaaaataataatttggctgaatatgaaattaatgagcctttattgcagaatttagtaaaaaaaaattgaatcaataataaatttatttataa

SEQ ID NO: 44353 - DNA, 1121 bp, Heterodera glycines
ataaaaatttcaatgaatttcttcgccaaattgttactttgaatttcagaaaaaggaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaacactttgtgtcccctttatgactctcccaatgcagcagttgtccatttttgccactatttttatctcactcatcgtctgctcgcctctcctttttatcagctattttccaaagccaacgcccttttctccctcttttctgtttgttatttctcattgctgctgagatccaatagtcggtgtacaaatttgtcaaacccgccaacatttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatttttgcgtttcgaattcactttggaattaagaaaaataaaaattgataatcatttgatcatttttagcgcactttaagcaccgccgttaggcagcgcagttccaaaatttattccatgccacagatattatgggcaggatacgccaagtacctcaaacttgggtaattaaaccgaagaaagaggtgcagtgggggaaaatggcgcctaaaatgaaggaaatattcgatgctgtgcgaacactttgtgtcccctttatgactctcccaatgcagcagttgtccatttttgccactatttttatctcactcatcgtctgctctagaagcctttttatcagctattttccaaagccaacgcccttt

SEQ ID NO: 44354 - DNA, 1470 bp, Heterodera glycines
  misc_feature (654)..(654): n is a, c, g, or t
gaataagccgttcaaggagcgaattcgacacttctacagcatttggatctccaatgaggcggaaaaggagatcacatcagcgggcaatccaaaggcacctgctcttcatgtggtacttgattggatccaccgatcatggcaggaaatctccaaagaagtgatcatcaaatcattaagggtcagttaaaaaattaattcaggaaaaatgtctaaacttttaagtctgtgggctgactacgccattggacggaactgaagacgaaaaaattgcttgcttcaagccggaaggagcaattggaccgatagggatcaaatttttgcgcaagtttaggacaaatgaaacggcgaaagatggacgaaacaatcacgaagaagacggcttatctgatgacgatgatgcaggctggatggagtcggagatgacgacgaattgttcattttttgagccccttttactgttgaatttattttaatttttttggaaaatgtgccaaataaattattaaaaaattctatttatccccccccccccccggcacataaatggagactggtatattatttttcaaccttctcagaaaggggtatataattggtgacggacagattaatggagactagcatataaaaagagtatatacggtatatatcatntaataaaaaacactgtttttctcgcccacgccgaactattattttctatttcagttcagttcgttaatttttttattataagaaaaattaattttttataaaacatatttgaaagaaagatcttaatgttttgagccgggatgagcaaatatatgtgtaaaggttgtcagctacaattaatacatttatcttgaatataatttttacaaagatgcctattgctgtggtaatgaggattcttctataataaaatgtttattatgttttcatttcattttttggcataaattcttttaatctcaagtaacggtagcatcgatttacattattaagcaagtttattaactgatttaatgtagttttttgtgcactaataaaccatattttatttatttttatttttctttattttaaagtttaaagcttaaatttataagattttaatgttaattatattttcatattgtttcgccgttgccattccgcattgagatagcaagaactcattcccaagaatatgggaccatctggtcatttccttcactatattattacctattttattgaaaatatcttgttaagtattgatttttttaataaaatttttgtcattgcctttatttctataaaataatctttgtcctttttacttattgcttatttaaattattttagattaataggcaatatattgacgcgacaatttcaataaaacacaaaaaaaaattaataaatttttatcaaattctttatttgcttatcaagaataaaatatagaaaaaatattggaatttaaaaaattcattttaaattact

SEQ ID NO: 44355 - DNA, 728 bp, Heterodera glycines
tctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggagcgcaatttaccttttatttttgagggaattagtaaatttatactctatcccagaaaaatggctatctctttttttgagaaattttatacctcactaaagcgcttgcgtatgagacggagggctgtgcacaatcgacattttatttcacagaggatttttatatttacaggttatcccagaaaaatggctatctctttttttgataaattttatacacatacaaatgctctcgagcatgatagggagggcggagagcaataaaccttttatttttgaggaaatttttaaatttatactctatcccagaaaaatggctatctct

SEQ ID NO: 44356 - DNA, 1024 bp, Heterodera glycines
caaataaaaacaacgattacaacaacaacaatcgctctataagcagcttcactaataatagctcaacttttggcaatttttgaaacaatcgcacgaactttgacactgggaataaccaaaacaacgcatacaacaatgctaatgaaagtgggcaaatggtaaataacaatgtcggatggatggattgatcacaaactttaatcaattttgcaaaatagttcatgtatttgaatcatcatttcataataaatttaaatattaatcattataaatttctttaatcccctttggtgtttgaatacacccgtaaatgtgacaagcgcatcgccggttagcggcatgatgcattagtttctcttttgtgccggttcagaaatgccgcacatccctttgttatttgaatttgaccccgttcgcatcggtcaccgaagcgtcggaccttggctacacagatggccacgatcccgcctcatataaaagggcacatgggaaagtcgccctcttttttttcctccattcacccccaaaaatgaattcccagcagcgccaggcagaacgtgcccaactccgtgcaaggttaaacttacttgtcgacgaggtcgactttgtggtccaagggctgatcagcaattatcaggccgatggattgatcaacgaggtaagttttctttattttttatgctgtttttgctttttttgaattttaatcttgattgaacaggcgccgcatgagggacagctgatgggcatggaccatggacaaggtctacagcatgagcagcagcagcagcagccgtgggaactggacccaccaatgcctgcacagcaattcgaaattgggccacagctcccggatgcgtgggaactggttccctaccagccgacaccacaatgggcccaagttgcacatgtggaacaacacccgcagcagcagcaacactaccacccaccagcacaacaacaacagcagcagcaaggcgcgtgggatgaggaatgggaggggccgctttcgccaaatgcgctt

SEQ ID NO: 44357 - DNA, 1117 bp, Heterodera glycines
  misc_feature (30)..(30): n is a, c, g, or t
agaaaaatgaaagattaaaatgactaattntgcggttcaatttggcaagtttgaaggtttgaaactctttttgcagcgtgccaattttcaaaaaaaaattctgaaaatgacgggcgacggcggggaaaaatgttggaattttaatggaatttttatcgaaaaaatagcaaatttttccacgattggtcggtgacttcgccacacccgccgcaacctcttttacaccggcccctcctcggagcgaagtgtctcccattttggagggttttatggacacttggaagcccttgcaaaaaacaacaaacccaataatctcgggacatgacacgtttgccaagtccctgcttggccagtgtgtgtccttaccatgatcagcgacggttgccgactcatccgtgtcataataccatgtcgcattgaactgctccagagcgtggccactgttgatgttgccgcaactttcgctgttgcattggtgcggagtgctgctgctgcggcgcggaattgcaccaccatttgacgcggtcgtggagccggacgcaaattcaaattcgtccgtttcaatgtcatcctcggagacgggataaaccttaaaaatgtatttggaaacataacaaaaaaaaatgccggacgaaatttaacagttggaggaagcactccaattaggggactaattagaaaaaagggtaacaaaattggggagtcaaataactgattaaacctaaccatgattgctaaaaagtgagtgttttatcaggaacggtcggggaatgttgcgggattcccgattcagagagttttttgaaaagtataatggatggttagtctaaaaacccggggatttttgaatcctaaaatcatagtctttaaggcttttgagttactgaactatgtgaagattgatattaatgggtttggaatgcaaaatccatgaaaattatgaaaaatttaccgatttttgtgggtacatgaatttgtcattttcccgttgtttgaccgcggcagcgtaaaatttcaatgcacgaacaattgcgcccgggttcttcttttgatccgcttcggtgagcccgctcacatccaacatcttgaaaaacggcaaatttattacaaattttat

SEQ ID NO: 44358 - DNA, 1347 bp, Heterodera glycines
  misc_feature (11)..(11): n is a, c, g, or t
tgcgccccgcngttgaccaaatggacaaagtgatgaacttcttggccacatttggccacttcgttctcctctcctttggcttcgttttgtttcggaatgccaaatgcgtcgtcgttttctctggctccgtttccgtctctgtcgttgccgctgtctcttccgttgtgcctctctctgtctcttccgtcgtcgtctccgtctctgcccctgccccgtcgtccgttgtcgtctcttccgtttgctctgccgtttcctcttcccccgtcgttggttcgctctcttccgtcgtcgtttgctcctccgtctgcccctccggcgtcgtcttcgtttccgcagtcgtttcgcttgtccgcttcggtgccgtcgtcgtcgtttccgtcgctgggccttcgctgtcgcatcggtacaatttgttcactttcatcgcatcgatttcactcaatttgtgcctaaattcgtcctctgatttctttgccaaatttcccttcaaacctttgtccaatttccacgcttttcgacttcttacaaatgcaattgtcagaatgccccctcccttttcccaaaccggcacaattgtcgcccttccattgcgtgaaaatgccaatttgtggtaatgcatcaccgagccgtagtcatacggcatcccaagagggtcgatgattttctttgggtacttctcgaagtttcgcagcattcccggccgcacattgtcctccaaaagatccacgtattcgtctcggtctgtgcgcgaatgttcgtggaaaaagcccaacgcatgcatctgaacagaggaggggggggggatgaatcggtggcaaagtttgattggacgtgccaattcgtgggcaatgattcccttggagaagcatttgtccaactccaaagacaccgtctgatttccccccgctcttccgacgtacgaagagcatctgacaaagggaccgaccgccgcttttcatgccaaaaccacggcttacgcaccccaacccgaagttccgtctcacataaatgaagtcggattctgtactttgtctcgggacgaagcgaatgcacgttttgccttaaggcattggccctttctttcattcgtttggccaatccttcccttgcaaattgcgacttgcctttgtattcgtcaaatgcgctggcaatggcggctctttgactggaaatgagtccatttgtctccgtagtgccaacccctcactcacagcgcactcattccctcctcaagcatgtacggcactcgcccttcgtgccacagtttgttcgggtacgtttgagtgttcaacgaactgtaatactatggtaatgggacgattatctgttcaaatgtagcaaagaaaa

SEQ ID NO: 44359 - DNA, 1129 bp, Heterodera glycines
tagtaacattatttggtgctctcatttttgggcgcgggatcttataaagtatctttgcataatgcacaatggttatgtcctaatcaggccaatgttccttgtatagcaaaacaagacgttctgtcgtgtagtaacattatttggtgctctcattttttggcgccggatcttataaagtatctttgcataatgcacaatgcttaagtcctgatcaagccaattgttccttgtattaccaaacgacgacgtgtctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgcacaatgcttatgtcctgatcaggccaattgttccttgtattatcaaacgaagacgttctgtggtgtagtaacattatttggtgctctcattttttggcgccggatcttataaagtatctttgcataatgcacaatggttatgtcctgatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcagaccaaatgtctcttgtattacaaaacaagacgttctgtggtgtagtaacattattttgtgctctcattttttgtcgccggatcttataaagtatctttgcataatgcacaatgcgtaagtcctgatcaggcca

SEQ ID NO: 44360 - DNA, 967 bp, Heterodera glycines
  misc_feature (45)..(45): n is a, c, g, or t
  misc_feature (95)..(95): n is a, c, g, or t
  misc_feature (886)..(886): n is a, c, g, or t
cttgcatttttataaattctctttgccaaaagcaaagaaatgacncaacagaagaaaagggcatgggaagggacggacgaagtcatttcgctgcncaatttgaaatgtcattattttttcggaaaaaaaatgttcaatgataaccaactttataaaatagacttgacaaaaaaaatacatgagaatgaacaataagcatttgggaaaatataaagatggtatgtacaaaaagcagtcaaaatatgtacattaactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgtcattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgttgcccgagagaaggccgtatacaattgaccgtgggaaaatacttccctttccagatcaatgccgacagtgcggattgtttgaccctgacctttttgaatggtcatagcgaatgcaggctttattgngaactgcaaacgctcatattttatgccgccaggcgatttgtcttcatagacatttcgtgttctttcaagaaagatctcact

SEQ ID NO: 44361 - DNA, 1075 bp, Heterodera glycines
gctcgatcacgattcgggcatccatttcggccaattcgaaccccggatccgatctcgaacaaaaagtcgaaaattcaaatgttcgaatttcgcattttgggttcaatgttaaatatatgaaaacattttaaaagttaccaattttgcaataaaagaccatttaagtcatttttggaccaaaaatgcgaaaatttgaattttcggctttttgttagagttcggatccggggtccaaattggctgaagatgccggattcgtgatcagcgaactaaaaagtcatcgcccggagagggtacgcccccaagccgaaatccttagaccgtccctgcttaattggcaaaaattatatggaaatccaatccatgtaaatcctggcagccctaatcatgggcaataaccgcacctcaattatcgccttctgcaccactttgctgatcagcaacggtttcttgtcggaaatgccctcaaaattggcgctgtcggtgaacgcggtggccatgcccatgttggtcaacggtttgttcagttcgtgcgtggtcttcaacgagaacttgggcaactgcacctgacaaaagaaaggggctcggattgcgttttatgacagttcatttaggccaggcccgtatccacgggggggcgagaaacgcttcatttaattcttcaatttactacacatatttattttgcatcttttttttattgtccaattaatcgatcaaatcaatttgtctttttaattttgcctaattcacttttgtgttccaaattatcttaataaagaattggctagcaaagatttttcttaaatttgtaaattaaaacaatattttagttacttatgatgtgaaattaatatgttttttgaaacatgctttgggattgatccacactgtcaaaaaacacgaaagtcccttaaattacaaacaaattcaagcatttagaaaatatttaataaataaaccgaaaaaaataaacataaatttaaatgaaaaatacagaaaagtgtctttcttgcttgtttggtaaaaagttgtcaaggttatctcaataaggcaggagcactgacaaatgagc

SEQ ID NO: 44362 - DNA, 578 bp, Heterodera glycines
tttcagctacaccttatttaaaaaagtaattaatttgttgcaagtataattaaataaaacaacatgcattgaacatgcaacagaataataattaacgaacttattatttatgtatcagaagaccatatactgtatacgcatttattattataataattttttctccatttacgaaacaacggagttttataaatattcatgagataattatgagagctataactcaacttaaatgaaaaattaatttaatttaagttttatttatataaaaatattattattctataaattacaaaaatgaatatatattattctgcatttcagacgaaaataaaaataaaaatcaccggttcgaataattttattcatatttattcattaaataatattaaatttcgtgacacaaccaaccttaattggatcccatctaatttaataaataattaattttaaaaaaattaataaaagcaattatgctattctaacttaattctatatgtaaaagacttatatataaaaataaataaaattggaattcttttattatttggcataaccaaaatcatcatcttcttgct

SEQ ID NO: 44363 - DNA, 962 bp, Heterodera glycines
gtcaataattatttttggtgcgttttcaacacactattagtgctttattcacgctacaccagaggacaaaagttggtgtccaattcccggtagggatttaatagtgactttcagagatagccattttttgtcaagaactatttttcgtgcgttttcaaacacactattagtgctttattcagcgctacaacaaaagacaaaagttggtgaccaattcacggtagggatttaatcgtgactttcagagatagccattttttgtcaataactatttttcgtgcgttttcaaacacactattagtgctttattcagcgctacaacaaaagacaaaagttggtgtccaattcccggtagggatttaatcgtgactttcaaagatagccattttttgtcaataactatttttcgtgcgttttcaaacacactattagtgctttattcagcgctacaacaaaagacaaaagttggtgaccaattcacggtagggatttaatcgtgactttcagagatagccattttttgtcaataactatttttcgtgcgttttcaaacacactattagtgctttattcagcgctacaacaaaagacaaaagttgatgtccaattcccggtagggatttaaaagtgactttcagagatagccattttttgtcaagaactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtctaattcccggtagggatttaatcgtgactttcagagatagccattttttcataactatttttcgtgcgttttcaacacactattagtgctttattca

SEQ ID NO: 44364 - DNA, 1295 bp, Heterodera glycines
  misc_feature (1195)..(1195): n is a, c, g, or t
tgctatttatgtgattgattttgagttttaaaaaatattaatttataaattgttaatttattattttacgtgtgtttgggcaagcgtacagccggttaattttgtagaggtcattttggctgaagccaattctctaaaaaactaattttaaaatgaaaattaatgtttttgccaaaaaataaaattaaattgcctgtccaatggttttcccaggctgttttggttgaattgtcggctttccatttttggtaaatgcctaaataatatttaaattttaaaaggattatctgataaatcaaagatcacatatggtccatagtgcatcactgaaccataatcatctaaaaagattttgaatttcttgtagcaaaaattttaataaagttaaatttacattgtgttcccaaaaagtcgatcatgttttgggaatatttgtcaaattgatcacgcagattttgatcaatgttatcccatttgatattcacataattatctctatcgctgcgaccttaaaaaagtcattttttaaataattaattacttgcataaaaattattattattttttactttgttcatgaaaaaagccaacagcatgcctcaaaaatattttaattttttaattttcattcaaatctaatacaacttacatcagctcgtggattctaaaataatggaaaaaaaaattaaaaaatgtaatttattttgttaatcttttgtacttacataatccctttactcatgcatccatctccaaggcttacctgaaaaatcatttttataaaaaacaaatttttaatttggtagaacaaccggctgctttccaccgacttttccaaccaacgaataacatccatcatcaggaaaaatgtgaatctttaaaaaaataaatatttattatttgattttaatttaaaaaaaattatttttatttgatttaaatcttttttaatttataatttatttgctttacataatccatatcgctgggtgttttgggacgaaatttaatgcacgttttagtggaatattcatcaattgcttgcacaatttgatcacgcccatacagcaaatattgttggctaactgtgtatggaatgatagcgcttggccattttaaatacgcttgacgaacctgaacaatttaatttagatatacatttgttttaaatacgtaattttattgggcaaatatntaataatttttactgcattatgatgaagtccaggcttggcaatttttccatcgtccgtctcatcgtttggtaaaattcgcaaataagcccggatttactg

SEQ ID NO: 44365 - DNA, 891 bp, Heterodera glycines
aaattcattttttgtgtgtccatccgacgaccaatcagtttcgggaaaagtgttggcaaatgaatcggaatggaaattgaccgaaaataataaaaaaaataatttaatatagtaaaataaagaatcgatcgattaattatcgtatcgtataagaaaaagccatttaatttgttggaggcatttaattaaggatgaacggggataaaacggaaaacgatggataaacaaaatctcgaccgtacaaaatatataattaactcattcgtcagctaacaactcgacagaacgtcaatgagtcgaaaatttcggctcacataaaatgcgtttataaaaacaaaattctgtatcattaatagggctttcttttttaggcacaaaagatcgcgaaataggcacctaaaaaggcataaaaaatcgcaaaataggcattaaataggcataaaaatcctcaattaggcacaaaaataggcaaaaaatttttttttattaacgctttttaggtattaaaacacgtaaaaacttaaatatttcaaatgtaaatggatagtttaaagttattttctaaataaggacaaatttttaaatcaaaatttttattaagaaaaaaatatattaaattttcgggatcaattttacaaaaaactttttttcgatattaggggtgtaatttcctgaaattttttttcgggtcaattctagggggtgtattttttcgtttttattcgcctttttcgttaagggatttttttcgaaaatcctaaaataaggcacttttaagcacaaaaaccccgaaataggcaaaaataggcattataaaagtcattcgtagaccccccaaaccaaacggaaaacgcgtttttcgtgcttatctacgcgtatcaagtgcgcaaa

SEQ ID NO: 44366 - DNA, 800 bp, Heterodera glycines
aacttagaaacccttgccctagtaattagcagcaattttatgagtaaatctattttattagaaagtctttgtatactgtagttaaattttgttagattaccgtttttattgaaacagaaccccccccgggggttctgttttttagcccccctcaaaaggggggttctatcagagggggggggggggttctatttcaataaatacggtactctgctgccggaccagcgaaatgctttggtcatcatgtgaatcaaccggcttaaaaaacactttttttttttgcaaaatcatttgtgttgcgcagttggggtataatttctgatgatgttaactcaaaagtccaaaattcggtaatcgaataaaagtttgtaatctttcgagtgccccgtctccttagaaaaattatataaaaatcacaaaatttgatcattttttagtgaaaatctgtcaacaaattttaatcaaattttcagaaattttcccggcgccgcctgccccctcttaccaaaaagtttttttggaaaaagagcgcctcaaaaaagcgttttattgatttttaaatttggaataaaattttaaaaaatgatttttgctttatgattttaactattaaaaagttgtagaaaaaatttcgcttttcgcattttcgcatattttggcttttcgcatttcgcttttttttcatttcgcatttttcagtttcgcaaatttcgcttttcgcatttcgctttttatttttcaatttggcccatccctgatttgcacattccagttctgggtctgtaaaactccaaggagcg

SEQ ID NO: 44367 - DNA, 1119 bp, Heterodera glycines
ctatcatgctcgagagcatttgtatgtgtataaatttatcaaaaaaagagatagccatttttctgggatagagtataaatataaaaattccctcaaaaataaaaggtctattgcgcaccgccctccctatcatgctcgagagcatttgtatgtgtataaaatttatcaaaaaaggagatacccatttttcggggataacctctaaatataaaaatcctctgtgaaataaaatggcgattgtgcacacccctccgtctcatacgcaagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaaatttaaaaattccctcaaaaataaaaggtctattgcgcaccgccctccctatcatgctcgagagcatttgtatgtgtataaaaatttatcaaaaaaagagatagccatttttctgggataaactctaaatataaaaaattctctgtgaaataaaatgcggattgtgcacagccctccctctcatacgcaagcgcttttgtgaggaataaatttttcaaaaaaaaaaaaaccatttttttgggaaaaagaataattttaaaatttcctcaaaaataaaagg

SEQ ID NO: 44368 - DNA, 946 bp, Heterodera glycines
catcatggaaataatatgttttacgcatagttaaactcatatgatgctgatgatatgcgctgctttgtgcattatgtagtttggaatacataattaatggctctaattatagtagatttggaatttggatctaagggtttaaaaaaaagcctggacctgctacacaatgcatgtatgtgtacagtaagtgattaatgtgatatgcatgtgtgtgattgggataatcagcagcagacaaaggagtgccatccatttctccccctcaatttgcttcaccattgacattttcggcactgttaagctggtagtacggtaccgcctccggcgccactgttgtcgtaatcgggtggcatttgtccgctgtcgccgcttttgtggatggagcggcacaattcggcatttgtgccgccgccttcgtcctcttcgtcagcagcagagcttccacgccaccaccatcattgccattgcccgcttcggcaattgcatttctcattttgcaccaattcgttgcggtggacagtgagcgcgactcggcaaattgtcggtggcgagcagttccagcaacacaaccacctgcaccggtgccggcagcgccatttcggcttgcggactcaaagggtggcgatactgctgcgattgccgtcattgttttctgtgctgctgttgcgttccttacagaggaaggaaagtttctgttttggcagtgcgacgaacttttcacagttccaaggccctttatttaccgactttttcgcgcttactttaatgggttgcaaccatttgatggtattttgttggaaagacgacggagaccgggcggtgagtgtggagctgatcccacgcattcgttgttgccgttggaagcacaggaaccgaccaattctgaaatgattagaaaacggatatcaaaatgctacagtaacccacacccactacagtaacctac

SEQ ID NO: 44369 - DNA, 1066 bp, Heterodera glycines
tttaaaaggatcgaacaaaagtcgaaaatataaacacactatttttcatgtatatttttttgtcgaaaattggtttaaaaatatagaaataattttagtcagccaaaaataaaactaaaaaataatttcgggttcagtctcgaaacacagtcaatgccgcgcattattctctgatcagatttaacatatgatcagcagaatcagtgatttaactggcgcgggaattagagttacaatatcaaacggttgatcaaaaacttgattgatgaacacacaaaacaaacaaaaaagggcaaaagcatgcacaaaaacaaaatatcacactgattgaaaagagtcgaatttggcatggcattttgctgttactgttcagagttgaagttgacacgccgtagaagcagcagtacagcagcagcagtgccaccgggcggaaaaccgacgaagagggcggtgacggcgacggcggacgtgacaacgatagcacgcagaggcggcagagcgcgcggcatcgacgtgatctgcgccccgggcgtgttcagctaccgcatctccaccgacctgtactgcgagcacaccaagcggagcatcacctgctttgcctatttgcaacagccgtaaatacgtgtgccaacgaaccgatcgtggaatttgcaaaagcaatttgaggacggaaaacggacggacggcacagcgccaaagaagctttatgacatttttaaatttaaaaattgaaaccacaaaattatttgacataaaaaacaaaggcatgcgcaaagtttggcaacagtgtacaaaatcacacgcacaaaaggcattcttttcaattgatggcgactcattgtcaacattttctgaggcatttttttaacgattcacaaaattcaatcggcaaatttgtttatcaaatcaaaagacttctgcgcaaaacgcgagcataaatgcacaaaaaaggattttaaaaaacaaatgattaccatggatggggcaggtcaaactcgttggcatttctcctgcccatcgaagaaagtttttaattttttatcaaaaaatatcacttataaaagat

SEQ ID NO: 44370 - DNA, 337 bp, Heterodera glycines
taattctgcggtgaatttgtgctctccataattgtttgagtcccccaatcggacacttgaaaaaatcgatttttttgttttcggggcagtccccccgaaccgatgcgcccagatttatggggagaccgaatccttcgggaatagcttccctatagcctgtactttaattctgcattggatttttgctccccataattgtttgagtaccccaaacggacacttgaaaaaatcgatttttttgttttcggggcagaccccccgaaccgatgcgtccagatttatggggagaccgaatccttcgggaatagcttccctataggctgtactttaattctga

SEQ ID NO: 44371 - DNA, 736 bp, Heterodera glycines
gttgtttgcgtgcatttccgttcgattttgttgagtaaatggtaattttttgaaaaatcgaattttcgatttttgttcgaatccgggttcgtggttcggaatgggtcgaattgagtgtcagaatcggattcctcgaccctgaaaaccctaaaaacgccattttctcgaaaaaaaaattttgaaaatttttttcagaaaaaggtggggaacattcttaactattaccaaggtttggactcgtgggttcggaattggccaaaaccaaaattatattacttcactgaaaggcacaaaataaactgttaccacttaaattgggtattgtaaatataaacaaattttcaatttttccgaattaatttatcaccttctaacaacacccgtcgtgcattgcatttcggcgtaagaaagaacggcgtaaagtgcgaattgaaccaaagtcaaataccaaccaaacggtttcatgccgggcagccgaaaaacgagttcctaaaaatgcaaaatccaagaaaatgtgtccggcgctagtctaaaagtggccgtttttgaaacaaaaggggggacccttttgttttgcaaagtttttttaagataaaaaaccataattttttatccggggttttaaaggtcgctaatcacgaatctgacatgtattttgactaatttctaatccctaacccgaactcgaataaaaatcgaaattttgaatttttcaaattatgattttttgttcaaa

SEQ ID NO: 44372 - DNA, 1066 bp, Heterodera glycines
  misc_feature (34)..(34): n is a, c, g, or t
atcgctgcgagagttgcgtgtccagactgtatgnagagcggaaagtggcggagagcaacgacaggatgccaaatatgcggactacatcggaccgtcgctttctgtcagcgccgttttatggacactcaggtggacaagcaagtagtggctgacaaccctctggaggcatttgtggattggctcgtctaccaattgccaaaaaagtacgacacctatgcctactctcactttagcggccgcttcgacatggtgctcgtcttccgcgagctgttccggatcgggttcaaccccgagatgctgagacgggtacaatgctatttttctaaatttggttaatttaaaatttagggtaataaaatgtacgagatgaaagtgcggaagcagaaaaagcgaaatcccaacgtcgtcttccgagattctttcaatctgatgccgtgttcattggctgcgcttatcccttcctatgggctggacgtggaggacaagccgttcttccctcatctcgccaatagaccggagaactacggcagagaaattcagcctacacctgacgactacctggctaacggaatgatgcccgggaagaggcgccagttcgacgagtggtacgccgagcaccatcatgagcctttttggctcgatgaagcgcttgccaggtaatttctttatttttatttaattttttattgttgatttttcagttattgcacgaacgatgttgaaatcctgatggcagctctcgtcgcattccgccgtgaattcttcgagatttcgcggcgacaggagtacattgatggaattgacgacagggaaaaccatgacggcatcgacgtactgcgcgagtgcatgaccatcgcgggagcgtgcatgcggcatttccgcacaaatcacctgccctctgaacatctggccatcgtccctgagcgcggctatgacaacgcgcagaaccagagcctacttgcacttcgcttcttccactggtattcggaggagcatggggtggaagtgcaaactgcccactcggctggaggagagaaacggatcggcccctactcgctggacgggt

SEQ ID NO: 44373 - DNA, 423 bp, Heterodera glycines
ttgtcgcggaaagcgacataaaattcattcaccaattaattagttttttgttcattaatttgtcgatcaatttgctctcggtcgcttctattatgagtcatccttttccctcttcattcattttccctatgaatcatccatcgatcgattttttgtatgcacatttgttcacgtgatttcctccgccccattgatttgtgagggtataaaagcccgccccattttcattctcgtcacttcttctcatcacttcttctgctcagcaccaaattatatttgtttaattgaataaagagtaagagaaaagctcttctctcaatctgtaaaggggacattcaggagccctgtcatacagaccattaatttgacccccgttgggtcattaagggggttaaaaagaactctcagattcagtgtccacat

SEQ ID NO: 44374 - DNA, 1095 bp, Heterodera glycines
  misc_feature (1039)..(1039): n is a, c, g, or t
aatgaagagttctgttggtgcccgcccataggcaccgccgtaaaaaaattcatattttgaatgagagatggttaagaaaattaaaaaattatctcacttcctcgctggaagattttttcaattcgtagaagttactacaagtttttttccactcataaattctcaaaaaatttccaactattttcagccaaaaaaaattaaaggatctcttaatcgttttatcatctcttcaaaatcgttaaaatttaacattttatttcgattgatttcaatgtttttgcaattttcgtgtcattatttttttatattttacttttttttaatattctttttacatgaattgaagaagaaatttgattgtccccaaaaattgaccgggacaaaattgtcgatcagtttgagataataaagcaaacaaaaattaccagtttataatttcaaaatcactctgataactgcaaaactgactaagtaaatcagtcttttgaaattttgtgaataaaaatttcccatctctatttatcaatcaaaatccgccatattttactttgactgttcaaaaatcattttttcaatttcttattttctttttccgatttatttttttgctaatttttttgcgtcctttttcccaattcagaaaatgaatgcgtttgcatttgtcaccaatttattcactggttcatattgtgtgatgagtgttctgcttctgctgatgtttatcagcagaagaagcatttgtaaaagctatttgatcggctgctgaatgtaattaacagagaaacggattttttgctacgaaaaacaaatgttgaaaaaaaatgtcgtgggttttttaaaataggctcaaataaaacattaattatcggacccaatttttcactttttttctcgaccttactgacgcataaattcggccactgtccattttaaatccaaaaaataaatcctaattttaattaatatcttatggcggtagctctcaatattctctaaaaaaatatttcgccaactatgtatatgatattcaagagcgcgntattctcatgaaaatacgaaagatgttataataataggctgcttaatttagaaaaa

SEQ ID NO: 44375 - DNA, 1665 bp, Heterodera glycines
tagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtacgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatgggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggatggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggct

SEQ ID NO: 44376 - DNA, 621 bp, Heterodera glycines
ctttcacgttatgggatggtcgtgtgcccaatttcgacatacctttagagcagtttggctggaaattagaaagaaatgtcggcactgagtgtgcctcccccgtccccctccgtccgtcccattccttcctcccctccctcgctcctgtcccgcatttggctgttggctgctgtccccgcccctcccccactttttcccctcttttcccgcacggctttctgccgctgctccaacagatgagagaagaaggaaagatgactgactgaagagggggcgaccaggagaagaaggccgacgaactggttcctcctcttcctctctctttttcgcccttttttctctcgcattttccatccgtcgccatcgtttattaaggctccgcccgcccgcctccccccagcggcgggggtacggacgaccgtctgggccgatcgatggttggcccttgtcgccagcgagcggtgggagaggtggggaggatgaaaagccgttaaggatggacggaattagggaggtggaaatttgttgagagagaaagagggacagaggtgggcgatgggaagggcgggggaggggagagagaggggggaaagagaggggggaggagcgaatgttattcga

SEQ ID NO: 44377 - DNA, 966 bp, Heterodera glycines
ttttaagaatgctgcataattttttattgtaaatagtcacaaacaaacttttttttcactcccaatatttaccagtatcatacaaaaaggcaaaagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataa

SEQ ID NO: 44378 - DNA, 962 bp, Heterodera glycines
cagtgattgaaatgctggtgggtttagtcccagtgattgaaatgctagagggttgagtcccgttgattggaatgttggtgggttgagtcccagtgattgaaatacaggagaattgagtcccagtgattgaaatgttggtggattgagtcccagtgattgaaatgctggtgggttgagtcccagtgattgaaatgctggtgggttgagtgccagtgattgaaatgcagaattgagtcccagtgattgaaatgctggtgggttgagtgccagtgattgaaatgcgtgaattgagtcccagtgattgaaatgctggtgggttgagtgccagtgattgaaatgcagaattgagtcccagtgattgaaatgctggtgggttgagtgccagtgattgaaatgctggtgggttgagtcccagtgattgtaatgctggtgggtttagcccagtgattggaatgctgttgggttgagtaccagtgattgaaatgctggtgggttgagtcccagtgattgaaatgctggtgggtttagtcccagtgattggaatgctgttgggtttagtcccagtgattgaaatgctggtgggttgagtcccagtgattgaaatgctggtgggttgagtcccagtgattgaaatgctggtgggttgagtgccagtgattgaaatgaattgagtcccagtgattgaaatgctggtgggttgagtcccagtgattgaaatgctggtgggtttagtcccagtgattggaatgctgttgggttgagtaccagtgattgaaatgttggtggattgagtcccagtgattgaaatgctggtgggttgagtcccagtgattgaaatgctggtgggttgagtgccagtgattgaaatgctggtgggttgagtcccagtgattgaaatgctggtgagttgagtcccagtgattgaaatgctggtgggttgagtcccagtgatgggaatgctg

SEQ ID NO: 44379 - DNA, 811 bp, Heterodera glycines
gataaaataattgaaaaagtttctcaaaatatggagtgactgatcaacaaaatgtgcaaatggatgtgataaatgaaagtgccaattcagaaattcgtcaaaaactcattcaaatgccacaaggctccgctgatcaggcccagccaatgtcagaagggacaataattatcgatttggaacgaactggatcaacaacaacaattgcaaatgaatttgcttcaatcccacaacatgatcaaactggaacaaatgataatgcaaacccaaatgatcaaacaaattttgttaatccaaatgatcaacaattggtcaaaccaagggaaactggtcaattgatgccaatgaccgctgataatttaaatttggcatcccttcatgaagcggataatgttgaacaatttgtgatgatccctaccccaaatatgcgacaaatcaatgcggaaaatcgcgtcaattcaaaacgcaattcaaaaagcggtgaaaaaactgattttggcgctgccgaaagcataaatgaggcttctccgtcaactgtacaacgaaaacgaggacggtcaaaaacgctgaaaatccaagacaaaaatgcagtgggcaaatcaaaaatgggagtggaaaaaccatcgatgaaatcggcaaagggcaaatcaaaaatggtatttataattaaatattagaaatctaaggtgattacataaatgttgttgttgcattcctgttttaaaagataggctaacatggtttttgttttgttgcacttttgaatggaaattaaattatcaattttctttactatattttatttcgtcaggat

SEQ ID NO: 44380 - DNA, 1146 bp, Heterodera glycines
  misc_feature (71)..(71): n is a, c, g, or t
gattattttttctggcggcttctcaacagcgatcactgacaaatcaaatttgtctggggcaaacaaagcanttcaaatcgggttggtaatatgaccgactcatccgcgagcacagcgcaaaatgaatacgtcaatgagaaccctgaaaatacaaccaaaattaatttaaaacaatatttttccattgaattttttcttaattcaaccaaaagttcccccattttttgctcacaattttccctcttcgctttggtcgtcgtcctcggcaattggcacttggaaaatgcgcagcacttcgcccgtgttgttgttggccaactcttcaaacaaatgctcctccaggcgccatcccttgcccactttgaggcgaagttttgcacagaatttggcccgtttgcttcccccgtgtgccgcttcgccgcccgcaaaacggcgcccatgacgaaagcgttcggtgccccaaccgtcgaaaaaattcttaaaattttacattcccatttatatgttcgtcatctttctgtttcccaaacttacgctgacaattgccttgacaaattcgaagaacggttcgtccctaaatgtctccgccggcgcttcttgggaattcttttcgaagataatttcggcctctgaaaattgcgagaatggcacaattgactaaatgttttgcttttaaatgcccacctttctccgtctttccactcccaaaagttgcgcactcgccccattgtttctgctgttggccatcgtcctcctccgtttttgtgtccgtccccaattcgatgggcgcctcgacaacgatgcgcaaagcgtagccaaaaaatggtattaattcagtgccaccgccgcaggctttggcgaactccagaaaaaagaagaagaaaggcattcagaatggcaattagtaaattttttttggtaattttggcaaaagtgcagaatagtgcgtcctcgaaaatttatatcatatgggttttttctcgaaaaatctgaataaacgcactttcaagttgcgaatggagtacaatgtgcgagcgttgtcaatggaacattggaagaactcgtggatttcataggagaagatgccgttaaagaggattttgttgtttttgaaagaggtaatggacggacggcagactctagaga

SEQ ID NO: 44381 - DNA, 1439 bp, Heterodera glycines
  misc_feature (26)..(26): n is a, c, g, or t
  misc_feature (1436)..(1436): n is a, c, g, or t
catgcacccagagactccggaagagnatccgccttcgaacaaatatatatgaacaaaaacaaatagtttacatgccaaaatgagaaggtcacaaatgctagcaagaaacgaatcctttttggagacactgtgtaatgccaaaaaggcgaatgaccttattcgagacgcaaccgatgagcaacttttgtgcctagtcgaaatatgtctcaacattctaaagggtcgggttccattgcgtactcggcatttgaataagctgaaagctcatgcacaggtgcttcgtcgtctcgcccgcacacgctgctcgcgctctgccaaaaaggttttgctacagcacggagatggcctcccagctattgtggggctcattgcgtcaattgctcttccgcttattatggatgtcattgaaaattataaataaggtgcaacaaagtaaaaaaaaaagaagtaaaatgcagcatacaaagcgctatttgtttgtccccgaagaaatttatcagagtttggcatcaccgccaccgtctgacggaacaccaattgggctggtacgtaacagaattaaacaaatcaaaaacgatgacggcataaatgaggcagaacgggcaatcaaatatgagcaggaacttaagcgtctcaacaagctgactcgggacgaggatgaacgtcccgtgggtgttaaattagaaaatttgagtgatgtggttgacgctatgccaaaaccagtcaacgtcaaaagaccaattgttgtcgctacgcgtcgccatttaaaggttgggcgtgcgcgaaaagcaaatgttgaacaactagaagatgttgatgatgatgatgatgatgatgaaactccaaagccatcgagttcaaataaacgacaacccacacaaacggaaatcttaaaattaatttataaaaacgcccaatctcttggagtgtctgaggaaggacaggtcttgagagcgggtgggcggccttttataaccagcagtgtttatgacattgttagtcacctgatgaacaaggacaagcgtggccaaaacaaagagacaactgcattcaaagaatttgttgaaagggcaagacagatcccgctcttgagtaggcacttatttcccgaaggccaatccggcaaaggcatttataaaaacaccacactgaaatttaatccatctttatggatttgaaaaagcttcgtttgcttgagtttttgtacaaggaactaagttcgcctgtcgcattcacgagcgttgaaccgctgctgagagaggcgcagaaaactcaaccaaaaattaatcgaaccgatgtccaaaattatttagccacccaacgtacatacacactgcatcgtcaggccaagcggcgctaccgtcgattgccaacattggcaccaggcttacacactgaatggcaggccgatttggctatttttgaccgacttgctnaaa

SEQ ID NO: 44382 - DNA, 1361 bp, Heterodera glycines
  misc_feature (40)..(40): n is a, c, g, or t
  misc_feature (65)..(65): n is a, c, g, or t
gacaatcggacagtaattacactaaaggtagtaaatgcgntcgccgaaggggaccgattgtgcgntatcaacaaaaaaggaaaataggcaaataaattgatgagtttttgtaataaccctaaaaatcaaacgatatgaatttattatcttttagtgtaatttactgtcggattgtccactgtccaattgtccagtcacggtgaatgattggaatggaaaagagtggggggggggggaagtgatcagcggaaaaggggagggatgtgaaaagggatggaaggaaggcaaagagaaaacgactgatcagcagagagaatggtgaagaaattgtcagaccgtcttaagtgaacggacaagaaaagtgatcggacccaactaaattaattttaaaattaaaactaggcctaaaatccataaaaggtgccatttttagcgcaaatctgatctcaaaacctggaaaaatatcccaaaaatttcccaggcggcgcctgtcggcagcgccagaaaaaatttctttttggtttttttaacgcttcccaaaagtcattttttggattattttattcgattgttcgaaatgctaaggtaatttattgaaaaacattctttgtccgaccaaatgcaaacttaggctttactaatcacatttaaagaaaatatgccttttttggccattagatatgcttattttggaaaatgtttctcgactttttcttttaaaagggaatcaatcgcttggattaattgtaatttaaatattcacttttgctgatcaaaagcacctttctctcctgttcgtccacataatcttccggcacattttccaattccttaaggtaatcgccttcaagcgaaggccgaagggacggcgaaggtctggcaataggaagaatatcaggcaattggacggaggacgaaggaggacgcggccccggcactattgggggaagtaaagtggggaatcgcaaggggagaaaggggctgcaattagaagcctgcatttattctttagatataactttgctcaaacgcaaccaaattttaaaataatgatatttttcgataccactaagcgcttactataaattctggacattcatgaacaatggggatggttcaagaaagttatgacaaaaatgtgcaaaaaaaattagttatttaggcttctcagatcaaaattgattccaagcttaacgaattgcgtagaaagcactaatggctaccgaaatatatcacgattttattatttggctgcttttcggcaaaattatgaataattttatgccaaaaatttgcttccaagtcatttttccccagcactgcatttttccaatattgttttgttcaggaaatctagaccc

SEQ ID NO: 44383 - DNA, 1140 bp, Heterodera glycines
cgccagcggcgctgaaacggcccaaaaatttttttgtccttttttgccggcctgtatcattgcgggaagaagcgggagcgaaaaacgcttggtgggaggattttaagttggagtgttagggataatctggcgcttatttggcatgcctagcttgtacctcttttaatcacttttgtacctcttttaatcactgttgtacctcttctaatttaaaaacgggcatgaagcgcccgtatgagctcaaaaaaaataaaaacgggcgcgaagcgcccgtccaagcacaacaaaatttgaaaaacgggcgcgaagcgcccgtctaaggccgagaagcggcctaaaaatcccagataattccaaatatcttcacaacccatagcttgtctaggtagcgaagctcccaaagcgcgaagcgcttttccccagctaaatagccgacggttcacgcacccgctagttactatatacgttatattgacaaggagtttcgtttcaaaaactaatttgagcttaacggctaatgggacgggtctgaaagtggtggaagggtcttacaactttttgaggcgcatctgggaaaactatagaaaaaaattctcgacgcccaactgagtcccgaggagcgatttctcactttttcttgcagtttagggcccgtaactttttttctaaaacccgaatcaaaaagtgcccgctgtgagggcactccgcagaagtgtcctctataatccggtattttttttttttgatcagaccaaatcccggacctgtacagacacggagactcagttaatttttttttcccacttcagtaccaggcgaataactcattaggctttgacctgtgcgcagggtggccagcagacttattgtagagctttaaaagcccgatttttccaaattttaaaatttcgaaaattttcaaaatttttcgagttaggcctaaaaaacggttttcgtgttttttaattttatgattttttaacgatttttcccagagaaacgaagaccacttccaaaacatagtttttcgagctctatcgattggtaatttttttgaaaaaaattcggtttttttccggaaatagaaaaaatttttggcctgagcgggacatttgagtcccgggcctataactcggcagg

SEQ ID NO: 44384 - DNA, 575 bp, Heterodera glycines
tgattgaaatgctggtgggttgagtcccagtgattgaaatgctgttgggttgagtcccagtgattgaaatgttggtgggttgagtcccagtgattgaaatgctggtgggttgagtcccagtgattgaaatgttggtgggttgagtcccagtgattgaaatgcaggagaattgagtgccagtgattgaaatgctggtgggttgagtcctggtgattgaaattgttgtgtccttacccaaaggaacgacaacaaatataaacaataaagtttattgaagaaaataaaataataaattggtgacggagagaggcgaatatcgattggctttatgccacaataaaattggtgaatgaatgaaggaagtccaaatgtggggaagagagccaacattaaatagacagaaatgggggagggaagaagggacaaacaaagggtcagagatcacaaatgtcaatggtcactatctataacacctcccttctctaattctgatcactcctgatcagtggcggcggcgcttcttgatcgggctgggcgagtaaaattgccgcggcttgacgatccgttctgatctg

SEQ ID NO: 44385 - DNA, 1081 bp, Heterodera glycines
ctgtcggcattgtaatgggcacgggatttggcttgacgtattgcccggcaatggtaatcggtaaacgagaagaacacattaaatatatattttggtacttattgtctcaaatcctgtgtctaaatggacttaaaattcctctaaaattataaaatcttccttggagaccgacatcacaggaaaatcgcactcgggaagctttttttatccattgctctgaatggaaatctagattttcctcactattattttagctccttaccattcgaaactctcgttcattggattcaaattttatttatttatttttcaacattttagttacaatgtatttcgagaagtatcgtgcacttgcgaccggtcttttcaaaagttcacttcgtttttcaatctcttctttaggtgttactgtttgcggtgctggagttggtaatttctgttattttttgtctcatattttgtaaaattcatttaggaacatttggtttctctaaattgatcagcattttgattgtccactttgactggcgtacagtttttctcatttacgcaggttttgcctttcgagttctagagacaacctttctttcatcaatttgttttcttttgtcagttgttgttctgctgtgtgtgccgtgcggtgccctttaccggccgattgaatttgtgccgatttacgaaggagagggggaggaagaggaggaggaacacggaatgacggacaatgcaaaagaaatgaccaaagaggagaacgacggcgaaacggacgggcaacatcagtacaaaggtcgcacccgcaaagcccaaaaaacaaaaccattctgatgatagtttagttttcttttttttttttgctcttcaggccaaccagtaatgccttggacaattaaacgattaaaaaaaagaatatttatagatccattttccaaaaaagtcttccgattggttcagctgatgacgagctgtccattcccgcggacactgccaccaccgtccacccatccgaccacggcctcgtccctccgtcccaaccattgcgtcccgcccgttcccaccagctgatcagcaaagtgtcgatgat

SEQ ID NO: 44386 - DNA, 969 bp, Heterodera glycines
cttgcatggcctggcagggtcccaaaaataaacgaaagaagcaaccgtattatgcgaagtgactttgtccgcttcgagtggatagtgcgatttgtcaggaggagggaccaaaaacttggtagcctaaaaacccactttacaaaacagcaattgaacacggcaaaagacttgtcctagggagtagtcggcttggtgaagaagtgccattgcgtgtagcaaagtgatgtcgcgcgaggcggccgacgccgtttggtggagagtggtcaatttggtggaggaagagccgtccaaagcgcgagaaaatattccgacagcgctaaaagggattgaacttgttataaataggagcgaaagtgttcacggaccgagcgatgatcagaaactgatcgatgtcgcggtcactgagccggtggtgcgggtggtacacgacgaactctttgtccgtacatcgcacttccgtccgtccggtggtctcttcctccccttctctcttcactttattcacttcttcttggctaacagtcaattcgggaatttgcgcttggtatcgttctccgatttcaattcgtcctttgtccgcgagaagcgtttgattggtcgggtcgtaaaccaaagaatagaagaaagagtcctttaaggggtaaaaattgtattatttttgttttgttggtgtctcgagaatggttgcctcttggtccaaatacatgtcgcacgtctccacctcgttcagaatcacaaccgaacatttgccacgaatttgtgtggctggtagggtttcgacaatgcgcgagaggaaaagttcatgctgacgaagtctgcttagctccgctgcgtcgagtcgttctgcaccggcggggagaccggcgaaaccaacagattccgcccgaccgtcgtcagccgtctcgtcgttttcgcgtcgcgagttctccgcgtccgtcgacgagcccccgccactttccattgcgtccg

SEQ ID NO: 44387 - DNA, 80 bp, Heterodera glycines
tgtactgggcccaggccctggccgcgcagaatgaagatgccgcgctgaaggcgcgcttcgccccgctggccaaggcgctg

SEQ ID NO: 44388 - DNA, 1192 bp, Heterodera glycines
  misc_feature (960)..(960): n is a, c, g, or t
  misc_feature (1096)..(1096): n is a, c, g, or t
  misc_feature (1114)..(1114): n is a, c, g, or t
  misc_feature (1183)..(1183): n is a, c, g, or t
gcgatcgagacgggactatgttgcgccccaacacccgcagtgccagggatcacacatcagctccgtaagaagccttcacttttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacaggaatcctcgttagttcttttcctccgcttacttatatccttaaattcacccaatattcacatcttaattcatttcaaaaaatcaaaacaacaatnccattaatccactcattccaccacaacatccaaaacatttttaccccctaattacaatccttaaaaccctaattaaaaccacaatttctctccatcacaccaaaaccccacaccctatctcatcaactaacttaanaacacatacaaatacatnatcccaccaatcaactcacaatcacttcattttatattaactaccctcaaccatactttccaatctatntaactccaa

SEQ ID NO: 44389 - DNA, 897 bp, Heterodera glycines
  misc_feature (880)..(880): n is a, c, g, or t
tctgaatttctataatattcgatcatttagtccaaaaatgattaattagtttagaaataattagaagaaaaattgatttcaaaattttcattaatttaattagctttaacttttgggttttataaaataaaaataaaataaaataataattttatattattttcactttaaaaaaaaaattaaaatttgaattttttaaaaattttaaaaattttttgaatttttaaaatttcccggttggtcccggttccggtcccggcttctcaggtcccggcaagtcccggtcccggttttgcccaaaattcccggtcccgctgcactctacttaaaaaacattttaaatgttattattttgtatatccagccaatttcaattaatataaattttttaaaagcggaatatttgtgaaaatcatgaaaataattatatcaaattcattaaatgaattttttggaagcaaaaatttattgtataaacatttttagttttggcatttttcatccgagtcaaattaataagaaattgtgtaatgaaaaaactttatggctaatgttttaatagctataaatttacaaaataatgatgcaatattataaaattttttatgtaaaataaccatcaatcaatatgccaatgacgaattttgcaaaaaaaaaatgagttggcaaaaatgtggcgtaaaaaattcatcaaagaaattcgtgaaaaaaagaatgaaaataggtaggaaatattgcaaatgaatcggagagtgacagagataaaaagaaatattcccggtcccgaaaaaaaatcgaggtcccggtcccggcttctcaggtcccggtttttgaaaaattcccggtcccgtggcactctagttgggataatttacttatntttaaggatttcttgaa

SEQ ID NO: 44390 - DNA, 994 bp, Heterodera glycines
aatggtatatatgtaatttgtgtattttttgactgacacttccttatgttcccttgtcagcaaagagacgacgacaaacactcggattccctggggcggaaagaataattcggcagttggaaaagaaagacttcgtcaagaaaagggttggattggcatcaaccaaagcggggagggcagcgagaagtgcgttgacgaaggcagcccttcaaaccaccctaacattcttacttagataaaatgccaattgccaacccaacagatggttcttccgttggctttgtcaccagcggatgtccttcgccaactttagggaaaaacattggaatgggttatgtggacaaggcgtatgctaaagttgggaacattttgacggtcgaagctgggcgagacagaatgattgaggtcgaagtggtcaaaatgccatttgtgaaaagcgcctattatctgaagccgacttctgtggacgaagacaaaaagaaatgattaacattaattattgtatttgcattttacattaaattatatatttccatttttaatcacttattatatttgcatttctaattaatgtacaaataaaatattgtcagtttttatgggccaaattaagtcatttaagcttccattttttgttttccgaaatatgcattttgacagatacatacataattttagtatttcatttatattattattttttgaagcgtttccatttattaaaagtcgttttaaaaaatggacggaagaataaaaccacgaaacatttataaaacgcttgaagggacatcggaaaacgaaaaagtacagcacaacgaagatgaaaggccgcccgtgttggaaccggagacgacggacaatttggcggaagaagtgcgaaattggggggggggtgacttaatcatcttttttaaaatttaaaatcccactacggataaagccaatcctcaaaaatggtaaatcggaatttttatttaaataccgcaacaacccc

SEQ ID NO: 44391 - DNA, 1170 bp, Heterodera glycines
ccccctccctttatctctctcttttttctactctctccctctccctttatctctctcttttttctactctctccccctcctccactctctctctctctctcacccctttctctctctccccctccctttatctctctcttttttctactctctccccctcctccactctctctctctctctctcacccctttctctctctccccctcgctttctctctctcttttttctattctctccccctcctcccctctctctctctctttctctctctctcgctcccctctctctccccctctctttggcatttcaccccttttttgcttaacttcttttgctgtagtggttgctggctttttgtattcgattgctgttccaacagcaaatttcgctcgctgcccgccgtgttcatttgcgtttggatgtgcgccgtggccgtgcccacgacggagttcaatcggctgagagaggagaacattggcattatgcccattccgtcgtccgtcgttgcgcccactccggcgcttctcgtcccgcctcccccaaaggtcgtcgtgcaggccacaacatccgaattctgagtccgcaccgattttcgtctcgcccgtcctctccttaaccaatgtttcaattccccgccgtcgaatcagtcccacgcgcccattcgaatcacctgcacttgaaaatgtcgcgaatggcagaccgaaatcgctgactcataaactaaaaaaacgaacggaaggaaatatccgcggactaattcggcggaataccgcgtaaaggaaagggttgcaggaggaggagagaaacagcaaaaggtaagtgatcggctgaaccaacggctccaaactgttgttgcacatcatctgctcagtccacaccttcaaaatggcgaaaagagttcgaaagtggtcgaaaaggaagccgaccgaccgtatagagaagacggacgtggtgtgggagggtgagcacggcgaaggaactcacaatggcgatcagaagtcggatcacctgaacggcggtggtgttacggcccgatttcattcccggcacctttttacgcgactccaccgtgcccaccagcactgtgccgttgggtgtgcccagcgtggcaatgccatcctttgccgtcgacagtgccaacatttcgttgttcttcatcaccttggcca

SEQ ID NO: 44392 - DNA, 1083 bp, Heterodera glycines
tccgagtggttgttgtgcgcacgacagtggtcggcatttcggaacggagtgaatgagtagggaattagtcagcagatttgtgggctaaacttggaagatattcgcatctccttgcatttggcatgcattgaatttaaaaagagacaatcgattcgacttggcaggccactgcgcccattcaatgcctggagaaagggacggagggcccgctgcgtcttcccccccccccccctctcaattctcccttttccctcccttctgtcccatcattttcctctgcctttcttttttcgcgtttgaggcaaaacagcgacagatgttatgttcttttcacaaatgttccagtttataacgccctttttcgtttcaatttcagtttaatctttaatgaatgaaagtaaaggtcgttttggaggccgacagaacggagacaaagggcaaatcaaatgattgattaatagcattaatcgatcggagattgtgaagaaaaaacaaattatacacttaatgaacaaaagtaaaatttaaaaagtaatcaacaaattaaaaggaagagaaggcataaaaaacactaatcatttatgtattggtcctttttcagcgttcttttggtaaattgtgaagcgaaaaggtaagtctctgaactcgcgtctcgacttgcgtcaggttttattgtgcagacggacttaaaggcagtcctcaattctttgattaagtcatttctgtgaacgccgtcgaaaatctaggaatttttttttgaaaattgaataatgaatagaaactttgcaaagtaaaattccattgggcgcaaggattggctcgggatcgggcacagtgccgaacataaagaggtcacggcagagtttgattatccgtaaatggtccatgtaggattcgccttaacggaacgaaatttgagcaatgacaaaaataaatttaataaattgctgtcgcctcccaccggtcggattcggtgccatgtcactgagcagcaaatcgacccttcggccattcaaacgccgtctgatttctgtctgagtggctcttctggtgaagtcggctttgcacagtaaatcaacattt

SEQ ID NO: 44393 - DNA, 1017 bp, Heterodera glycines
cataaaaatgcatttattaatatagaaacactctcaaaagaataacgaagtactcggttcgggaacgtgaaaatagaatgaataaataattgtttatatgctaattatcaattaaataataaatttaataatactagcataaaaatgctacatatatttgaaaagttatgtcgtaactatttttacattgaattaatagaaaattatttatttaaatcgaattgttaaatatatagcttaaaaaacaatttattacttctgctttttaccttttttaaaatttcaactttgaacacttttaacacattatcttaaaattaaaatatattttttattattaataatggaattaagctaaataatttttataaagaattattttttgttgattttcatttatgaataacaataaaattgtcatttagatttaaaagcattttatttgccaataattaactttgaatttaaacaaaaatattttttaaatttgttgttctatttttggtgtctattttcataaaagctctttaaagccaatttaatagttactaattattaaaataattaaatattaatagatttatacattataaacgaaaaagagttaagccatgaggcaaaaaaatatcattaacaaaaatgttttgatatttaaacaagtttcatagcttattaatatttataaaacatcttaatataaaataaaaataaatataaataatatttttatttttcgaatctaattttgcccgttttcagtgctgaaaatagttaaatgcataattgacaaatttttttttcaaatttcaattatttgtaaatagagcaaacaaaaagactaatatctcaaaattagaaaaaagtaactataaaaaatgaatttattaataaaaaatgatgccgcacgcaatgagtgaacgaacctgtgcacattaggagaacatgaagataaaataaataataatagtatttccactccaaaaaaaagatttataaaattataaaaacaatatcaat

SEQ ID NO: 44394 - DNA, 948 bp, Heterodera glycines
aatcaaatggaaatggacattaggggggggggcagtcaatcagtccgattctttgctgcctccgtactgtggggaaacactgccgacgagcgatggaccacgagcagtacgggtcacgcgcacaacggacgcaatcggagccgtacaaagcgcactgaccaagacggaattgggagacctgaggagttttaattaagctaattgaccgtatttaaggaatatttgcagcactttttcctccgtcgccaaatacaaatattcgttcggaagaattgccattgcgtggagttttttggtggacggaattcggtaaatggcgagcaaaaggacggaaaagggaacaacggacaaacggtggaacactttgagaagggagtgacggcttaagaagaggggggaaggggaagaaggcaaaaacggacggaacggaagccaattacttaaagtcgtagacaaaaagcacaacacggccaagccgatcggggccatcggatacaatttgggaaaaaagggcgccgtgccgatggaggaggggcgaaccttaagcaagaggaaaagcaaatgaaaagcaagggaaaagcggacacaccgccaaacggaggcacggactcggccatcaacagatgcgacttggcaaagtgaagctcctcgtcggacagttgacgcgagtcggactgacacttaacgaagagaggcaaagtcaatgctttcgcattccgattggttttggcatttttatgggatggtttgggaaagtgccggcatcgtaccgtgcctggtctgttggtcggcacttggtccgctggcgttgggttccaccaacttccgcttccgctgaccgattgttccaggaaaaggccggaatcgaacagctaaaatgagagaaattggccaatcagaggaaaagctgagaagggactggaagaaagtgcctgatttatggcgctc

SEQ ID NO: 44395 - DNA, 795 bp, Heterodera glycines
  misc_feature (13)..(13): n is a, c, g, or t
  misc_feature (19)..(20): n is a, c, g, or t
  misc_feature (26)..(26): n is a, c, g, or t
  misc_feature (33)..(33): n is a, c, g, or t
  misc_feature (35)..(36): n is a, c, g, or t
  misc_feature (39)..(39): n is a, c, g, or t
  misc_feature (44)..(45): n is a, c, g, or t
  misc_feature (53)..(53): n is a, c, g, or t
  misc_feature (66)..(70): n is a, c, g, or t
  misc_feature (74)..(74): n is a, c, g, or t
  misc_feature (76)..(77): n is a, c, g, or t
  misc_feature (87)..(88): n is a, c, g, or t
  misc_feature (90)..(90): n is a, c, g, or t
  misc_feature (95)..(96): n is a, c, g, or t
  misc_feature (99)..(99): n is a, c, g, or t
  misc_feature (101)..(101): n is a, c, g, or t
  misc_feature (106)..(106): n is a, c, g, or t
  misc_feature (110)..(112): n is a, c, g, or t
  misc_feature (118)..(118): n is a, c, g, or t
  misc_feature (127)..(128): n is a, c, g, or t
  misc_feature (131)..(132): n is a, c, g, or t
  misc_feature (135)..(135): n is a, c, g, or t
  misc_feature (137)..(137): n is a, c, g, or t
  misc_feature (140)..(141): n is a, c, g, or t
  misc_feature (155)..(155): n is a, c, g, or t
  misc_feature (159)..(160): n is a, c, g, or t
  misc_feature (165)..(165): n is a, c, g, or t
  misc_feature (170)..(170): n is a, c, g, or t
  misc_feature (173)..(173): n is a, c, g, or t
  misc_feature (190)..(190): n is a, c, g, or t
  misc_feature (193)..(193): n is a, c, g, or t
  misc_feature (197)..(197): n is a, c, g, or t
  misc_feature (209)..(210): n is a, c, g, or t
  misc_feature (225)..(227): n is a, c, g, or t
  misc_feature (245)..(245): n is a, c, g, or t
  misc_feature (251)..(252): n is a, c, g, or t
  misc_feature (270)..(271): n is a, c, g, or t
  misc_feature (281)..(281): n is a, c, g, or t
  misc_feature (284)..(284): n is a, c, g, or t
  misc_feature (290)..(291): n is a, c, g, or t
  misc_feature (306)..(307): n is a, c, g, or t
  misc_feature (309)..(309): n is a, c, g, or t
  misc_feature (325)..(326): n is a, c, g, or t
  misc_feature (329)..(329): n is a, c, g, or t
  misc_feature (333)..(333): n is a, c, g, or t
  misc_feature (337)..(337): n is a, c, g, or t
  misc_feature (348)..(348): n is a, c, g, or t
cagaacaaacagngccgcnngaacanccccgcngnnggncaaanngaacacgnaaaggcaaggcgnnnnnccgnanngggcaaaagnnancccgnngcncnccgangagnnngcgaancccaccgcnncgnncangncanngaaggggcgaacanaccnnccgcnggggnagnccaagacaaagggcgcnggngggnacgagcgaccannagcaacaagggaaannncgcgaacaggaaagggcngaaaanngaagggaccgcgccgaanngagccgacanaancagcanncgccaccaggcccanngncacacgccgggggaannggnccangaanagaacggcggngaactcataccgacccggactgatgaacagtgatttcatcattgttttcctcacagcgtagcgggcaggcttcacctccaactttcgcgcaatgtccagcgccaacccatccatcagagacaccttcttcacatacaatttcagtcccacaacctcgaaacggtagcggggtgcacccgcgagcggcgcaattagcacaaattcgttgtcgttcggcaaaatttcaatgtccagctcacaaaagttgatcagatacaacggctggttgaataggtcggtgtcaattttggcaatgaactgagcaacgttgctgagcgcaaacaaatcgcatcgcgctgtgcatccgtctcccgtctcaagcacatcacccgggtcccggtagtaccccgctgcattcaggtgtgagtcctttgtcgttgttgaataggagagctcatgtgaaaaata

SEQ ID NO: 44396 - DNA, 1308 bp, Heterodera glycines
cgtaaaacagatcttaacaaaaataccaggttttttatgtattttatcttgggacaaagatttatatgggcgacaatctctgaaaatctgacagtattatttatggattaaaaataaaaataaactttaaaaaaaagtcgcgggaaaacaacagaaagaaaattgataataatatcccaataattaatatttaaaaaaggaatattcaaaaacccgaagtacaagaaaaaggagggggcgggacgaataaagggaggtaagtataaattcctgggggtttgctttaaaaaattttctaaatttgggaccaaatgatcacttttattgtttggtcatcaacacaaaatttcggttgacctccctcttccctcccagtttttaaactcaatacacagcaacaaaagccaaaggctttgatcaaatggataaaggtgactaattcacttctttaaaatatattttttgctttttttttcttaatccatgctttaagattaaagggagacttatgattcttcgagagccggagcaaaatattataaaaaaaaatttgtgagttaaaagttttagaccgtggaaattatgaatagggatggcatttttatggcctgctagtaaaatcgcttagaatatgtacgagtttttgtttttgttttttaaacccaaaatattaactaaacattttctaaattgggtgtttaagttggtcaaaaatttgttttatctttccatcaataaataatcatcaaatagaaccaatttcttcaaattcaaaaataaaatttttctaattaaataatttttttattgaaacaaggaattttttgaaaggtttttttaaaaaaggccaatgggtctaatggaccgaaattttaaataaaaaaaactcggggtcaaaatttcgatttagtggtagaattgaaaaattttattgtatttttggggtcggcgatgccaaatacttttgagttttgcccatccaatttttaataaaaaatgaaaatattttttcatttctttcaaagatttttaccaggaattccaaatttaatcgtttccaatattaattcaaattcagaaagtcaattttctcgttttgtattcttttttttagctgacgaatgatgcgccgagacggaagagtaattaatgtgtgaagttgatgagaaaacaaagatgcattaacaaaaaaagacaattaacgtttaacatttttcttatttattcacaaatttgtgatgttgctggcgaaacgttagtcattggctcaatgaatgactttggaatggcctcagtaaaaaataattt

SEQ ID NO: 44397 - DNA, 631 bp, Heterodera glycines
tagggcatccaattatatggaaatccatatttttttcctggactgtgggaggcctgaaacgcacgaaaaacatgtttttagctcggtttgaagcttctaggaatttccatatccatattttccatatttcgcgatttatgtccatatttccatattgtccatattttggcatttttatccatattttggcatttttccaaaaaacctctattagaacggcccccaacagctaaattggctttttgaccccaaaaaccgaaaatttttttcaaaaaaacaatttttgcaaaattttctcgagaatattgaataaatttaaattccttaaaatcttaaatttaggtcaaaaataagcaaaaaaagtaaagtttctagttgattttttgctaaaaatgagtaaattttagatttatcatatttttttcttctaaaatgatttttaataccatatttagccatttttgaaagttttactttaatttagcgaatttgaaggaattttgaaaatttaaatgcaatttcaaccaaaaatttgaagaaattttacactcaattttaaaaaatttatgtccatatttggagatttttgccattttatgtccatatttcgcgattttgatatccctatttt

SEQ ID NO: 44398 - DNA, 1166 bp, Heterodera glycines
  misc_feature (67)..(67): n is a, c, g, or t
  misc_feature (243)..(243): n is a, c, g, or t
aagcgctttgtgaggtataaatttctcaaaaaaagagatagccattttctgggatagagtataaatntaaaaattccctcaaaaataaaaggtctattgcgcaccgccctcccctatcatgctcgagagcatttgtatgtgtataaaatttatcaaaaaaagagatagccatttttctgggataacctctaaatataaaaatcctctgtgaaataaaatggcgattgtgcacagccctccgtnctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataaactataaatataaaaatcccctcaaaaataaaagggcgattgcgcacagccctccctatcatacgcaagagcatttgtaagtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccattttctgggataacctctaaatataaaaatcctctgtgaaataaaatggcgattgtgcacagccctccgtctcatgcgcaagcgcttttgtgaggtataaaatttctcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtatatatttaaaaattccctcaaaaataaaaggtctattgcgcaccgccctccctatcatgctcgagagcatttgtatgtgtataaaatttatc

SEQ ID NO: 44399 - DNA, 68 bp, Heterodera glycines
ccaaaaattttattgttagctgagtcaggagatgcggatgttaaagcgtgaaatgaacattgccgatt

SEQ ID NO: 44400 - DNA, 1190 bp, Heterodera glycines
tgtttataattatatttgcataaaatggcaaaaacctagcatgttcaatgctttataaccttttttcagaagcaattaaataaatctcttaagaacttcaagtcctctatataatctattaaatgataaaatttcaaaaaagttctgataaataattttagcggagtgatcagcttgcaaacgtcgtttggcattggctgaattgtttttggctttgtttattgcttttttccggtgaagcaaaaataaatttgtagcaattaaacactgtaagtgaatagggctaattaattttggtgattaacataacatattatattaatatacatatatttttggacataaaagtgttaattgtacatttagtcgtatgtaataatgagggcaattcagcttttaaaattctttaaagtttgaaacaatttttataaaaacaaaggtgtattaaattaatagtaaaatgattttttttaattatgactttcataaaacgggcctcaaattgttagagatggaatcgaaaaattatataaacgattaaattttattttcaccttttctcttttaagcagaatttgtcaaatggatcatcgaattaaagaaagaatgaagaaacaaaggatgtgaaagaaagaaaaataaattatttatttgttatcagagaaggaaatattacagattacttttgcacaaatttaaatattgcattttaaaaatataaatttctctttaaattaatgaatagaaaatagaaatagaattaatgcccttttcagacttaaaaagtaccaggactgaaatttctaaaccaagccaggactcggggtctgtggcctagccgatagacgccgacgatgaaaatgatgatatgctgctgcttttggagacaagtctcgacaggacaaaggtgggattttcgatctcgacagtatgaaaaaaaaattaaaaaattccgtagttcaaattggttttacgcataaatgaacaaaagcacaatgccagaaaatcgtcagtttaaaaattatttttcttagcaaaagcaattagtattcgcgttacacttcctctttctttgtttgtccctcctcatccgtctgtgtattttgtttgtttcacttaaaatttaaaaaaaaattaaatttaaaaattttgaaagtaaaaaaatttcttttttataattttttttattg

SEQ ID NO: 44401 - DNA, 1762 bp, Heterodera glycines
  misc_feature (1687)..(1687): n is a, c, g, or t
  misc_feature (1725)..(1725): n is a, c, g, or t
  misc_feature (1736)..(1736): n is a, c, g, or t
  misc_feature (1740)..(1740): n is a, c, g, or t
  misc_feature (1746)..(1747): n is a, c, g, or t
attttctattcaattccattcttctgttgccgaccccctttatcaactgtggctttaaatgcacaaatgtttcaaattcgcaaaattatggctgttctgcggagggaaatgttttgcgcttttttgtcatcggtgacatcggtggggaggagtatacggtagagggcaaacagcagcagtgtacggtggaaggacacggtaagttgaagagggagaacaaaataacattttaaaatgagagaaaataaaataggaatatacaataatcacttaaacgcatttgtgaccactgtgagttaaggaacggtggctgattgtgtgcaaaataattgtcctacggtggtaaagtattatcgtccaactgtggcacaaaaagcggtggcaaaggcgatggattcgcttgctacgagtaaaggagtgacaccccgagaggtaattaataattaattaattaatcctaacaacaaaaaaaactaaaattttgatataaaaattctttaatttctcctataaatttttatttgtaaaaattaaacaaattgtttttataggattttacaaaagtgtttgcttctaaaaagtcgaaaaaagaattgtataaaattgcttctggagaaatggcaccccattttttgttgaacgttggcgacaatttttacgacgaaggcgtaacaaaagaggatgttgcagagcgttttgaacaggtaattaattgttaattaaggataatttataaaacaaactataccacaaagtatttatttaatacgggaaaagaattttttaataaaaaaaatatttttatataaataccaatggttttctttttatagaattttactgaagtgtacaattatgacagtttgaatgtgccatggtatacaattgctgggaacaacgattgggaaagcaaagatggaattgagccccaaattgaacacccaagtggcaaatggtaaatgtaaacgttttaaaatgagagtaaattctcttgaaaattttttaaaaattaatttgcctgcaaaatttcggaaatttcaaaaggttgtgacaaaaagaagcgaaaaacttttgtcaattttttccgtaaataatactaaaaaaacaaattttttgaaagtatgtactttttggctaaatatctattttattattttaaataataattttacattttttaaattttttcaggactttccctgcccaacattatgtggtcaattacgaatttggagaaagcccggacaaccgcaaaactgctcgtttcattatgatcgacacaacagtgctttgtgggaatggggcaaccgttttcgggaaaatgcagaaaaaagacacacaaaaatatgccaaaatgattgagaatgccaaaaagcatttcaaatggttgcgcaaggagttgcgagaggcgaaacgacggttgaaatatgaacaataaataaattaaaaaataaaattaatgggtattattaataaatttaaataatttactaaagaacatttcattttatgatattaatatatcgtaaataataataacaaattaaaatagaatgatcgcttaataaaaactcttacacatttaacattaaaatagaatgttaatttatttaacggattccagttttaatagaaaaaagccagcaaacaatatttgttttttataatttttagaaattttgaatanatggaaaaaattcaaaattattcaatttctccgatatntcgggtccaanattntgtcgnntctggaaagttttgt

SEQ ID NO: 44402 - DNA, 956 bp, Heterodera glycines
tagagttgagcggtaatcggtaattgtaaaaaaaccggtaccggtactgaccggtaatgcaaaaaccggtaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtatttttaatgcgatttgttaacagaatttgtaaaaaaagaccaattgattaatttttgggtttttaggatgcttaaaatgaaagaaaaaaagttggaatatttttttaattaaaatttcaattaaaataatggtaaagaaaatatgaagaatattctatcccagtggggaattgaacccacgcgagaaataataaaatcagaaggtttagccacttgaccacttatgcatatgatcaaatgctttaaatgaaaataaatatttaattttttttttctcaaaaaatttctccttcttcaccattccctactcttttctcacccagacccacattcttaccagtgcaaatttttaccggcggtaccggtactagacaaaccggtaccgatactttgatttttgaaaaaaccggtaccggtaccaaaaaaaccggtaattaccggtcggta

SEQ ID NO: 44403 - DNA, 1129 bp, Heterodera glycines
agggaatttttaaatttattctctatgccagaaaaatggttatctcttttttgcgagaaattttgtaccatacaaatgttctcagcatgggcagcggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattatattctacagggaatttttaaatttattctctatgccagaaaaatggtaatctcttttttgtgagaaattttgtaccataaaaatgttcccagcatgggcagaggggcgcggagagcaatggccattctattctacagggaatttttaaatttattctatatcccagaaaaatggttatctcttttttgcgagaaattttgtaccatacaaatgttcccagcatgggcagaggggcgcggagagcaatggccattctattctacagggaatttttaaatttattctatatgccagaaaaatggttatctcttttttgtgagaaattttgtcccataaaaatgttcccagcatgggcagaggggcgcggagagcaatggccattctattctacagggaatttttaaatttattctctatgccagaaaaatggtaatctctttttagggcaattttgtatcttgtaaccctgatcatcatccgctccggagagcctattccaaatttcttcctttccttcagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattagcagaaaaatggctatctctttttaggacaattttctatggagagaccccgatgctaatccgttccggagagcctcttcaa

SEQ ID NO: 44404 - DNA, 1592 bp, Heterodera glycines
caaatttaatttaaaaaaatacatgaaattctatccattaaaaaaataattaatttaaacttataaaatgtattcatcaaaaaaaaattaatttaaatataattgttttatttattaactcaacaaaatattttaaattaattaaaatcattgaaaataacgtaaaaatgcacagaaaaataatgttacaccgtccggactcgaactttgcccccccccccaaaaatgatgcctcagaatccccaatcacacaggcgattcatgaggtcttaacgatgtcaaaagtaaaatctgatcacatattcatgatcagcgtcataaaatagccctaataacatgtttctggaagatttttggtgaaaaaatttttccactcaaaaatcctggtcacccccctttggtcccgaaccccaaaatcacttttattttggtatcattttttaaaaatgtgataaaaatatgaaataaaatttatttggtagagcaaaaaattgcggattttttcagtatttaaaatttcaaaagcacctttacggaaccgagttctgaatttttttctgaaaattcggatttttccagaaattcttgaataactttttttcatttgaagatataaatttcatttaaatcccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattttgaaacgaaaaataaacatcatattcgtgctcagcacatcaaaataccccagaaaaatatttttgacccccattttcaacccaaaaaaaattttcgaaaatttctagggggcctagctcgaaaatttttgaaaatttcccgccatatggcacaccattcgatagagcttcaaaagctctacaattttgccctaaggcgttttttcgataaaaccaacccctaacgagttatggacccgggactcaaatgtcccgctcaggccaaaaattttttctatttccgggaaaaaatcgaaattttttcaaaaatatcaccaatcgatagagctcgaaaaacggttgcttgaaagtggtctccgtttttctgggaaaattcgttaaaaattcctaaaattcaaaaacccgaaaaccgttttttaggcctagctcgaaaaattttgaaaattttcgaaattttaaaaactggaaaaatccagctcattgaactctacaataagtctgctggcaccccctcgctcagttcaaaccctggcgagttattcgcctgggactgaagtggacaaagttggtactgaatttctccatttttctgcagcccttcatattataggtagaggcctggaattttttttgttttttagaaaacacttcaacttagccccctcacagcgaacattttttgattcgagttttagaaaaaaagttatgggccatcaaacgcaagcaaaagtgagaaattagccgccgggactcagttggccctcagagaaaaaaacctatagttttcccggattctcctcaaaaa

SEQ ID NO: 44405 - DNA, 1400 bp, Heterodera glycines
tgataacactatccaatgtttttgttcaattgctttttgaatgcaatcaatttttaaaaattttgttttttagcactcaaattcttacaaaatgaaaaaatggtacattaaatattataaagatttcttaaaaacttaattacactgagattggaataaaattgatggcacattggttaaattcgcattaataaaaattgaacataactggaaatcggcccttaggcctaaaatttcgtttttgaggccccataactttttggtttctttctatggaggcgtaatactaaaaattcgcaatagaacgaacgaccctactatatccaatgttgccaaatttatatgtgtcttcagagttacagttatttttattatttataattatttttcaattttttcatcttttttacagcttaaataaggttttcttttaaattctacgttaatagtatattttaatgcttattaatttatcatctttgttttgaggcaatgtaatgcctttaaaattcggccacgcaattggcttggaatgacgacacgacttttgtacagaagacagcccccaatttcaaaaatttcatttattttcggattaaatggtgaaatttcggtttcactgcacttctttggccaaccagaaataaccaaattaacaatttcctgtagggtctcatctttggttgtaggttgcgcaacttcttgtgccgtgacgggaagatgatcggtttgcgactgtaatatcgtgttaatataactcggtttcgacgcaaatgttggcaattaaaacatcttcctcaggccttggattgcaatcggcatgcggaataaatcggaattccctttttggagccgaaaatggcaaggaaaggcttgtgatcagtaaataaagtgaatttcctctcgaataacattcagtggaatttctgcactgcgaacacaagagccattgcttctttttcgatctggctgtaattctgctgggaatttgacaaaacacatgaggcatgttcgatcactttcccggatttgtccggaaaaacatggccagtcgttgcgccaataccgtttttggaagcgtctgcggccacgattattggaagagtcggattgtaatgggtcaacagcagatcagaagtcatgatcttcgccttttcaaaagccttctgtcgctcttcgctcccattccaattttcatcctttcttaggagctgatcaagcggagtgcgtatctcacgtatttcttttatgaatcggccataataattaagcgctcccaaaaacgatcgaagtgacgttttatcgtgtggcgcgggcataagctgatcgcttctgaacgtaccggagcttgacccacggaagtgatgacacaatgtgtccaagaaaatgcaattcttttt

SEQ ID NO: 44406 - DNA, 802 bp, Heterodera glycines
aataaacttcaatttctccgtttcatacagtcccgagatggaatgaaattttccaacaaaagtttgcacaaatttcatttcaaagttttacacaataattaattatctgtctcataaactatcaaatccgcgaatttaaaaattatttctacagtccatgacgctaggaaaaagtgtgggaaatgaaaatgtcccacttttgctgttcgctcatttcccggtcctttaattccatttttaaacccacaaagtttttcacttccaaggttttgcacattaattatttgtttttactatattttgttacagtatctgctcaaagtggaccagtacatggtggaggacggggcggaggatgagcacgacttgctgtacggcacggacgacgacgactcggccaactatcgccagtcgtcggtgcgcgagtcggactattacgcagcgggcactggacgcggtcggcgcggcagtggccgacggagaaggcaacgcggcggcggcagtgcggcagcttcttatcgcggcggcattgccaatgatccgcagcagcgacaacgcgtgtccgcctggcggtcgccgccgcgacgcgtgcgcacgttgacgcgatggattgacggagtcagtgggacgcgcgagagggggaggggcgacactttcatttagtttcagaatttgtttttgtgatgcattttaatccccaccccctttaacaataagaaaaaaaatttgctaaattttgtataaaaaagaaagaaaataactaaagtaggttcttggaatttttaggaaaagaaataataat

SEQ ID NO: 44407 - DNA, 858 bp, Heterodera glycines
ggagactatatggcatagggcaaaaattgaaacccccgtcacgacgccagagcgtttttttcttttttatttgaaatatttgtggatccagttcaattagggagccgcgcaactcgccgcgccttttgctatttagccgtccgatttcaaaaaaaaattaaaaaaccctgaggaccgcggagcggtccgccaatagcgaaaaccggcgtttcttttgcccatggttttattcatatctgcattttataattatttttcaaaataatgtgaattcgcgcggtgactccgatccgtttacatatttatttcagaaaaagcggccaaaaatttcaggcactatttcaacatttgtgattttcagcaaacagacagaagcataagccatgatgacgattcttgtgcaacgtcttgacggtaaacttcattacatccattccgaccaattttgagtcccggacccgaattcgaacataaaatgaagcttaacgatttcgcacttttcgtcaaaaatgtgtttaataataatgcatagtctgaaaatcttacaataaagttcattcaagcagttttagtcgaaaatgctaaaaccgaagtttcgactttttgttcgagttcggtcaagggttcgaaactggttgaaatggatgtcattttcatgagcagcggcccggcccgaaaacacatttaatccagaataaccggctattcgtttttctttttattttttaaattttttattatatacctatcatgtatcattctcaatcactaaaaaaggcttggttcaaagttcaaaccagggttacacgggcccgggtatttaaacattggctcgggtccgggcacccggtaaaaccg

SEQ ID NO: 44408 - DNA, 1008 bp, Heterodera glycines
  misc_feature (951)..(951): n is a, c, g, or t
  misc_feature (960)..(960): n is a, c, g, or t
  misc_feature (966)..(966): n is a, c, g, or t
atgatttcaaaattttcaattttttctagtctaatctactcaaaacggttcagaattcgataaaaataacattcacggtgcgaacaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacgttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaatggggttttgacaagttttattgggggaaaaaaagactttacaaaataatacccctgggagaangggagtggngaaacnatgatttcaaaattttcaatttttttctagtctaatctactc

SEQ ID NO: 44409 - DNA, 996 bp, Heterodera glycines
  misc_feature (844)..(844): n is a, c, g, or t
tgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccatttttttctaagcttagatcacatgcgattttcggcactctgataattttagcgctcataatgggatgtataaaggcgattgtagaaggaattggaagcgttaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttgctaggcttagatcacatgcgattttcggcactctgataattttagcgctcataatgggatgtataaaggcgattgtagaaggaattggaagcgctaaaattgtttgaggagctttttgagcgtaattacgatttatacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattntagcgttcataatgggatgtataaaggcgattgtagaaggaattggaagcgctaaaattgtttgagaagctttttgagcgtaattacgatttttacttgaccatttttttctaggcttagatcacatgcgattttcggcactctgataattt

SEQ ID NO: 44410 - DNA, 963 bp, Heterodera glycines
  misc_feature (950)..(950): n is a, c, g, or t
ctggccctatcaaacaatcttacgatattgaaacgcaacaaaaaaaattcttgaccaaaaaatagctatctcttttttctcatttttttaccgcaaacttggtaccaacagttgccttcttttgtctggccctatcaaacaatcttacgatatttgaaacgcaaacaaaaaaaattcttgaccaaaaaatggttatctcttttttctcatttttttaccgcaaaattggtaccaacagttgccttctcttgtctggccctatcaaacaatcttacgatatttgaaacgcaacaaaaaaaattcttgaccaaaaaatgtctatctcttttttctcatttttttaccgcaaaattggtaccaacagttgccttctcttgtctggccctatcaaacaatcttacgatatttgaaacgcaaacaaaaaaaattcttgaccaaaaaatgtctatctcttttttctcatttttttaccgcaaacttggtaccaacagttgccttctcttgtctggccctatcaaacaatcttacgatatttgaaacgcaaacaaaaaaaattcttgaccaaaaaatggttatctcttttttctcatttttttaccgcaaaattggtaccaacagttgccttctcttgtctggccctatcaaacaatcttacgatatttgaaacgcaacaaaaaaaattcttgaccaaaaaatagctatctcttttttctcatttttttaccgcaaacttggtaccaacagttgccttcttttgtctggccctatcaaacaatcttacgatatttgaaacgcaaacaaaaaaaattcttgaccaaaaatggttatctctttttctcatttttttaccgcaaaattggtaccaacagttgccttctcttgtctggccctatcaaacaatcttacgatatttgaaacgcaaacaaaaaaaattcttgacctaaaaaatnggttatctctttt

SEQ ID NO: 44411 - DNA, 816 bp, Heterodera glycines
ccttccggaacactgatgctgtttatatttagagcgtaatgagctgatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcgtatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctga

SEQ ID NO: 44412 - DNA, 1197 bp, Heterodera glycines
tttaaatttatctctatcccagaaaaatggcttttctttttttgagaaattttatacctcacaaaagcgcttgcgtatgagacggagggctgtgcacaatcaccattttatatcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatataccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcacaatcgccattttatttcacagaggatttttatatttagaggttatcccagaaaaatggctatctctttttttgataaattttatacacatacaaatgctctcgagcatgatagggaaggcggtgcgcaataaaccttttatttttgagggaatttttaaatttatactctatcccgaaaaatggctatctctttttttgataaattttatac

SEQ ID NO: 44413 - DNA, 1376 bp, Heterodera glycines
  misc_feature (3)..(3): n is a, c, g, or t
ttntaattttggtttttttttattttcctaaatttgattttatgttttaggtatctataaaaattttatgtctaatcaactgtaaaatctgttcatccaaaattaagctctcctccatcaaggcggatattgctgttgacgagctccttcaccgtttttgtgcgcgaaaagtttaccaaattaatttagttttgtttttgaagatgccctaaaatgccgaaaaaagcgaatgggattttgtcgagtaacgaatcaaaatatactttgagtgcaaaccactcgacgccgcaaagccggccgcttcaggcgttgtccaatccagcgactccccatttttctcccatttggccattggccattatttaatggcttgaggtgacgtgcgcttaatgttatttgcaattattacgaaattggcagcctcatttatgattcggtcgagtttttgtgaagtcaaaattttttgtcactttaatactcccaactccgggttttcgattttgggcatttatttattagtgattttaaacaattaaaatttgccaaacaaagggcacacgatttctgctttgctatgtcacgaatagacgcaaatatttaaaaattttcttttctgtaatagatttttcaatttcaccgtaaattccttaaaaaatcgttttttccatattaaatgatcaaaaagatttattttattcaacaaacttataaaagcatttaataaattacaatgaatgaaactcaaataaaagagaaagaagaaatggtcataatgcaggtgatttattataatttttataatctaaacatttttttaataaagatgtgttctgatcaaaatccttgctggccaatgattggttatggcatatttttgctcattttgacaatcggtggaattttgtcaaatttttcagtgattttcatcacaattcgaacaaagtttaaaaatttttaataaatcaattaattacaatgaaattttaagatcatttcgtggttccgtgaatattttgttggcattttattctttttttgaaatcatcaatttttgtggcaattttttgtcaatttttacggcattttcaggccaatattttatgccatttaatgtaggaatttattttggcattattcctttaacaagcatcggctgatccctccttataatgcttttcattggcattgaacgattgtttgttgtgcttttttccgctaaagtataaaaattatatttaaaaacaattttttaaatttcttttttccataatgaaattcaactcgtctttttttctcactgttgtactgatggatactgtaattcacatgattgtaccgccatttgtttattggagttattatgacgagaaaatgaa

SEQ ID NO: 44414 - DNA, 1118 bp, Heterodera glycines
tccattttttagaaatcccgaattagggaaatgttttcttattatttagcaatttacaacaaattcttttaatttaatttacttaacaatttctatgctaaaacatttttaatttggactataatactttaaaaaacaaacaacaaacaaactgatcatcacctgatcaatcgttgcgcggacactgtacaccgggccattgccagttttgtgccgtcgtccccaaattgcgccctgtggaaaaattaaattttccgacgaaaaatgggtgtgtttttttaatttgtttcaattttcttagcaaataaatgcgcaaaattgttcgttaacaattagcacggtgcctatcggtcccgaacaatttaattactttaaaacaaaaaattttttcaataaaaatgaccattttttcgcaaaatcggctaaaaatgctattttttatcccacggcattccacactaatgacaaattttgtgtatttttagtccaaaattttaaaaatcggaattttggcgtccgacaatgtcgatgggatgcctcggggaagccttctatgttaacgggcttcagaccaccgtgtgagaaaaaaaacaattgctctagcgaagaggcctatttttttagaattttttgcgctaaaatatttctcagatttgcctaaaaatttggaaatttccaagcggtttcccattttttttttgaatttttgcgcccacttggcattggtatgggcgcaattcgcggaagaacagcgcgtcccacagggtcaactgttccgcaatttgcggcacattttcggtgcccgtgtcgaacatttgcgcccgctcctgcgccgaggcgagcgcccgcgcgtagcgctcgtccgcctcaatggcgccgggcgccgaagaaacggacgcggacggcgacagtggcgactaaaaattaaaaaaaattaattgtttaaaaaatttagatgatacctttccattttcaaatccccgcccgaataagttttcaaaataaatttaaaaatgtcgatactctaaattttccacccctcccccctcacccatgaaaaattgtgaatatttagcagaaattaaaatgccagcatatgaatatttccaggaattaga

SEQ ID NO: 44415 - DNA, 827 bp, Heterodera glycines
aagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgcaaccccgatgctaatccgatccggagagcctcttccaaattttttccattaccctaagagctgcggaaattgtgaattaattctcacaaaaatggctatctctttttaggacaattttctatctcgcaaccccgatgctaatccgttccggagagcctcttcaaaattttttccattaccctaagagctgcggaaattgtgaattaattctcacaaaaatgtgtatctctttttatgacaattttctatctcgcaaccccgatgctaatccgctccggagagcctcttcaaaattttttccattaccgtaagagctgcggaaattgtgaattaattctcagaaaaatggctctctttttatgacaattttctatct

SEQ ID NO: 44416 - DNA, 596 bp, Heterodera glycines
gcacagcaaagcactaatagggtgtttgattcacttcataaaataattccttacactaaagttttttacaaccacttattgtcaatctaatttcttgcagatttaaagccatccattgcctgccggttctcggcacaacaaagcactaatagggtgtttgactcacttcaaaaaataattccttacccaaaagttttttacaaccacttattgccaatctaatttcttgcagatttaaagctatccattgcctgccggttctcggcacagcaaagcactaatagggtgtttgattcacttcaaaaaataattccttacacaaaagttttttacaaccacttattgccaatctaatttcttgcagatttaaagctatccattgcctgccggttctcggcacagcaaagcactaatagggtgtttgactcacttcaaaaaataattccttacccaaaagttttttacaaccacttattgccaatctaatttcttgcagatttaaagctatccattgcctgccggttctcggcacagcaaagcactaatagggtgtttgattcacttcaaaaaataattccttacccaaaagtttttta

SEQ ID NO: 44417 - DNA, 942 bp, Heterodera glycines
  misc_feature (68)..(68): n is a, c, g, or t
caaaatttgtttacatttcgacattgggagaaataaattcaatttttttccttttcaacgatttcacnagctattatttttaaagttgttttggcatttctgaaaaagttatcaaatggtgtcattttttggttttatagtcgtaatttaaaaaattggctttgtaattatgccctttttaagtgcttttcatttcaggatttacatattaaatttggaccttttctcgatgaaaaagcagcagagtttgattctgatactttgaatcgttacaaggagcaacagagggtaagttttgctttgactatttcttaaaaaatttataaatttaaaatttcttactattttttttgaattttcttataaaaatttctacaatacctaagttttcttggaaattttctttctttaaatttttattaaaaaactgatttcatttggcagaataaaaacacataaactgttgatcaaagagggagcatttttagatggtgggaaattagtacaagtacttaaccatatcaacaatgcttaatttggttaacaatgaaaaaattatagtccaaaaattttccggcaatgttttgggatgcaccagaaatgtttaattgctttccataacaaaacacccaaaacattttctgcaaaaaaaatggcgctacttgcaaagagcgctcttttgaattctatcaaaaacaaaaggggggacccttttgttttgcaaaaaatttttgagatacaaatccatgaaaatttgttatccgggggttttagaggtcgctgatcacgaatctgacatctaattcgaggtcttggaccccaagaaccccagggaataaattttcatgactaaatattaaaaaattttgcaaacaaaaaggtaccccctttgttcttgcttaaagataatttcaaaagagcgctctttgcaagtagcgccga

SEQ ID NO: 44418 - DNA, 1617 bp, Heterodera glycines
cctcattcgcgcaatgacttgctgaatttgattcgctttcggagattcactctaaattttgtttgtttcattattattatttaaccaaggccccaaggggccctgtgaaagcgccggggccgctttcaacactacccacctggatttattggttaaacaataatcaaataaaattttgttcactttgattgtccgtttgtgagtcggcattccagatggagtttcgttgtgcaccgcctccatgttgaagtcggtgcggaaattgtgcatctcctcgtttattgattatactttaagtttatggaatgctaaataaggatataaaaaaatatttgtattttaaatactcattaatatattctctgccaatttgaattttatggcccgtttaattggatacaataaaaaataaaggaattttatatataattttaataaataatttttaatcaattattggctgatagtttcacgaaaaattatttatttaaaatatcttttaatttgtgtctatcatgtcatttatgtaaaaagaccttttagtctttatcatattataatttgggtttatcacagtgatttccgtctttttcaataaaatttttaacgatcctcaccttcttgataaaatcgcggcctttatccagaaattacttaattaatattttttataaattatttaaattcattttttgttgtatttgatagataaatgaacttttgactcaaatgcatttcttttgacaatttatacacaaaaatttatatttatgaaaaaagtacctttattattttggtcttttaattaacattttaataatttttttattttttacttttttttactatgagtaatataatataataattcatctaattgctgataaattgacgaaatatgcaaaatcctgctgtacagacttgatgtctcattaataaaagtagcgctatgacttattaatttattgtttggaattaaattttatgatataatattattatacaaacttttcgattgaatatatatattctttgttattcgtgaaaagaagtgtctgtcaaaaatatcagtcagttgtttgccaacattatatgtgaatataagtttaataattttaatagttattcatttatacaaattttttacattgcaatacgtctataaataaacaaaaattattatattttaatattgtttgccgttgttgctataatcatgatgttcgctacataaattagggacaaaaacgctatgattgtgataaatatttttgcaattgtctaaatgaaatttaactgttttttcatatttttggtagataggtttaaagaaaaatgaaagattcattatttattggattagttcatgaatcatgatataatataattaaattgtatttgcatttatttataagtattctattaaaagtgcacttttcattttgtatgttaatttactagcacagaaccgacagttcacgcacccgctattaaaatatatatattaacattttacgtattttactttagaagcaaaaatttaaaaatgaaattaaaattacaatctttaatttaaataaaagaaataaatgatataatacataaagatttagtaat

SEQ ID NO: 44419 - DNA, 1131 bp, Heterodera glycines
caggaaattgcaatttttaagattttttgtaaaattcttttgggacgcgggaaagagagaaatatagagagacgagagataatgagagaaagagagagggttagaaaaagaatgagtgagaaaaaaaagaggaaaatgaaagtgagagagagagagtacagcggagagggaagtgagagagagaaatagagagagagtaaagaagggggaggagagggagatgagagagcgggaaggaagatattgaagggagagagagggcggggtgggatgagggaaagaaagagagaaagtgagagagagggaaacaagagagaggagggtagaagaaatgggaaggagatcaacacctcaaaaaacccagctttgatagcgttgaaaagcagcaaaatgctgataaatcatcagagtttggagccctgtttatatggcatttaaaatccatgtgaaaatacactttagactttatacactggtggaaaaagtctttgaacaaacacaaaaacgatttcaaaaggctcttaaaaatttgaaataattcatgcaagcttatcttttgatgtttaacaaaaaagtcttttacacaaacttgatcagatcactccttcatagtgaccgggacacccaaaaatacactgaaaatcgggaaaattttcgaaaaaaattcctagggggttagaaaaaattttctggaaaattttagtaggcccattggaagagcacaaaattcccttccaaattgccctttgaatgattgggctgctaaatatggatttatttccgaaaaccgccgaaatgtggatttatatggactaaaaacctttaccaaatcaaaaaattttggctctagtgcactttatgagtccaatcgacttttatgagtccaatcaattgaaaatactcggtttttctagaataactttgttggtgctaggtcgtttcacaaaaaagctcagtgatcgataaaattaaataaatacatttaattattcaattcacaaaacacggtgccgtccggttaatactaataatgtacggcgggacgcaagtcgttttcaaattttttaatttttcaatttttacatcacttctcgcaaattttctccatttgtagtagacatagcctgacgc

SEQ ID NO: 44420 - DNA, 746 bp, Heterodera glycines
cctttggtgggtagatgatccatcgccgtctctcggggcaaaaatgagtatcctcgttccgccccgctcgatggatgtgacggatttttccccttttaccctcgcctcgttatttcttcccgttctttcgtttggtctgacagtgtcgcaatgtgatggtcgatggaaatttggggaggcggaggataagcacaaagaaaagggggaaaatcggagccatccgtcactaattattctttcatggtgcccttttcgaccgaatcagaaggaatcgaaactatgggctttagaggtttgattggaagtcgagttgggggggcgcacttgaaaggaagagaaaggggattcaaggtctgtgcctcagaaatcgcaaggagcttgtttttatgacaataaaacactcggctgacgcattttctgctagcgcattttctactgacgcattttccactgacgcattttccgggcgccgtgaagtttagtcccgtcatgaaatttggtccaactaaaaagaatatttgagttcatcattaaaagtaaggagttttggagtccggcaatgggtccgtatcgttttggcgccgatgttttggcgccagcccaagttttcggactataactttttttgttgttaccaaatccagcaatcttggtcttcacgattagacaattaccaaaaaagttataacatgaaattccaaaaaagtcgaaatttttgagattttttcttattaacttttttagaa

SEQ ID NO: 44421 - DNA, 1060 bp, Heterodera glycines
aatcagtacttttcacgcctataaaattcgggccgcttttattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgaaggcaaatcctaaatagacaaagacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggatggatgaattaagtatagaaggcgtcgcagaaatacattcatattttctaaattcgggttgcagaaaattaagatttaaaagaggctgaattacagatgattttcaaattttgggtgtatccgaatagaaagaagttggaaatcagtacttttcacgcctataaaattcggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattgaacaataggggcctttttattatgattacaacaaatcagcatggcgtctcgctgatatggtatgtttcagttaaggtttagccgatctacaaatttcggcactgtctattttgtaaaagcgaatcaaattccctttggattccaaagtggaattacagaatttgcgacgcaaatcctaaatagacaacgacgctttcatataaagctt

SEQ ID NO: 44422 - DNA, 1097 bp, Heterodera glycines
aagcatgcagaaatggctgaatgcttgcagaaaattgctgcggcaatgcgcgaaaataaggaaagagtgtatttagaattttgccaacgtttggatattgagacaaaaatcaatcaagcagagattaagaaaaaagaatgaagagttaaaaaagaacacatggaagatttaagtgacttattgccagaaagttcagtttggagtgttatttataccccacgcaatcaaattgaaagaatcaaaagggtcaaaatcccactgattcaacttaaaaagtttgatggatcggttgagagttggataccattttgggaaacatttcgagtacatgttcatgaagacaattcagtaacaaaaattgaaaaacacaatttgttggaatcaaatttagaaggggaagcaaaagacttaatagaaggcataccaatttctgaggatggctaccaatttgcgattgatctattgttagaaaaatttggtcgcgcattaaaccaataaataattttgattccacaaagtgacacagttgaagaagacgaaaaattatacattaaattcgaaaaaatttgcagactgttgtcaagcttaaaccaaaatattgatttgtctcctcattatttatttttagaagggaagttatcaccattagttttagacaaatattttgttattaaagacgcagaagacaaccaaaattgggacacaacaaaattcagaaatgccttatcaagagcaattgaacaaataaaaaacagacaagaagtaaaacaaaaatgtggaaaagaaagagatttaaattataatagaaatgattcagaagttactatgaattttgcagttaaatttcgagaagaatgggaaaagttgctgaatgaacaaaaaaccaaaaaattggaaaaaaccaaagagataacagaaggagtttagctcatcagaaggcccagaaaaacaattcaaaaacccaaaattcgaaaggttttcaagaaatcaaaaaagaggagaaaggggaaggaaaaatgggtccccatatccaagcaaatttcggtcgaattctaacagttctaattattccaatgattcatttattcaagcaaaag

SEQ ID NO: 44423 - DNA, 1122 bp, Heterodera glycines
  misc_feature (63)..(63): n is a, c, g, or t
  misc_feature (164)..(164): n is a, c, g, or t
  misc_feature (181)..(181): n is a, c, g, or t
  misc_feature (196)..(196): n is a, c, g, or t
  misc_feature (210)..(210): n is a, c, g, or t
tttgctccccataattgtttgagtaccccaacgggacacttgaaaaaatcgatttttttgttntcggggcagtccccccgaaccgatgcgcccagatttatggggagaccgaattcttcgggaatagcttccctattcattaattatttatatttgcaaaattnaattcataaatattttntagaacgtgctctgnaacgcaccaaatgnttaataaaagttaaataaggctctctgatgctttttctatcaaaagggagatgaataaatattttaaaaatgtttaattcctttttaaacaggccaaaaagtttaggcttatattttaaaaagtttcatcgaacctagcgcactaaaatcgataaaatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataaaatttttaaaaatttttaattcctttttaaacaagccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaacgtgctctgaaacgcaccaaatgttaattaaaagttaaataaggcactatgatgctttttctatcaaaaagggagatgaataaaatttttaaaaatttttaattcctttttaaacaggccaaaaagtttaggcttatattttaaaaagtttcatcgaacctagcgcactaaaatcgataaaatctctccgaaattttgcaggccttctccattgtaaaggactaacttaacctgaaaaaatgccaacgcttgttgtttttaaaattt

SEQ ID NO: 44424 - DNA, 1367 bp, Heterodera glycines
cagcgaccagcgagttttgagcgacggcgagtcgtcgagcgacagcgaccgaaagattttgagcggcggcgagtctccgggcggcagcgatcggcgagttttgagcgacggcgagtcgccgagcgacagagaccgaaaaattttgagcggcggcagcgaccagcgagttttgagcgacggcgagtcgtcgagcgacagcgaccgaaagattttgagcggcggtgagtctccgggcggcagcgatcggcgagttttgagcgacggcgagtcgccgagcgacagagaccgaaaaattttgagcggcggcagcgaccagcgagttttgagcgacggcgagtcgtcgagcgacagcgatcggcgagttttgagtgagtcgccgaacgacgccggcgactctggcattccctcgggcgtgctcgttggaccaaagcgttggcgtgaccttttggtgttggaggacagaaaatggcttcaacttgatctactcacaaacaattagctaacaccacacacttattacacttattcaacagaatacgggggacttttgttgcttgtgacggaaacactctattttttgtttttgtattaacattttttatttcttggcattttgcttataaactctgtgatctctgatctgttttaatcattagggaccgaatttatatggacaaaaaatacgaaaatatggacaaaaatttctgaaaattatctaaatttttgtaaaatctaaacccacaaaattttttatcaagagtataaaaaaatcatttaatacatgaattatagaatttgttaacggagacttacgaaaaattttgagacaaagaaaaaagattacaaaacttaataaattttgcaaacaattaatatttatttaattctaaattcttattactgataagaatgtactattttcttttttgattttgaaaagaccgtacacatcaatttaaaatacaactaaatcaagctaagaagcttttttcctcgccaaacttatagatcgaggcataatccatatttaacccgtatcctatatggcatctgattaccggtagacgtaccctataaatctggaggcactagtggaacaacttgagtagctttatgtctgttaggtggtaccctccctgaaacaaagatcaagagtggagacttttcggcgagttgactaatatagaacattagtattctaacccactacctaagaagtcacctgctcccacttgtggattctttttcggagggccctccaacagcaaaagtgccgcaaaaggtggcggaacgtttcgtcactaaacttttcgtcactgaaataaaatgaagaattttaaaaggaaaaaaattcaattttttaaaat

SEQ ID NO: 44425 - DNA, 862 bp, Heterodera glycines
  misc_feature (857)..(858): n is a, c, g, or t
tttttaacagattttcactgaaattttggggcattttacacacacgaaaatgaatcaaaatgtacttttttcaaattaaaattttttcaaataatcgcttcaaaaaatgatatgtagggctgcgacttttagtgacgaaaaatctcaaaatagttaactaaaatagtgagtaaaaattccaaaatagtgacaaaatagtggcaaaaagtgcgaaatagtgacgaatattgacataatttttagcccaaaattgagcaaaaataatttttattcactggttgcatttgcaaatgagtaggactgggatttttaagaccaaaaaacccaaaatagttacctaaaaaaaaaaaaaatttataatacaaaggggggggggggttaatctacctacactgtaagtttcattcggaagtcccaccgtcacttgggtacctctcctttgttaggggtgtattttttaggtcgattcttaggggtgtattttttggttttattcagggctgccaagtgtcctttttttaaagatttgtccttttttggaggggccggatctttaaaatttaaaatgtcctttttttaaagattgtcctttattttaggcttccccaaactttttaaattttttgtgcttaatgatttatttcgctgataaaaatgctacaaaaactcccaatttcaaaaatttttcccggcggcgcctttcggcaccgccggccccccaaaacttattttttgttttcttaagaaaatggcttaaaaccgtaaaaattggtcatttttggtgaaaatctgttaacaaatagtgtaactgctcaaacacaattttacaattttctgaaattttttttcctaaaaannatca

SEQ ID NO: 44426 - DNA, 1154 bp, Heterodera glycines
  misc_feature (86)..(86): n is a, c, g, or t
  misc_feature (94)..(94): n is a, c, g, or t
  misc_feature (102)..(102): n is a, c, g, or t
  misc_feature (269)..(269): n is a, c, g, or t
aaaagtgatttccgacttttgttcaattcgattcaggggttcgaaattggccgaaatgcgtgccggattcgtaaccagcgaccccngaaaaccntatatatncggtatgttttttgtttggaaattgaaaaaagatgaaaaattttgtgtggcctaaactgtataaaggtgccaaattgcaccgtgaatgcccgcccctcgctggtctgaccacgttgaaaagctcgggattcatcccttccccttgccctccctgccggtatgtatcncaaaactcacatcacgcatgtggtccttcaagtcctgccacgagccgctgatgggcagcccggacaccgccaaacggtagggaaagcgtccgcgcggtcggtcacgcggcggactgcgcccgtagcgtccgcctccaccaccgcggccaccaccaccaccgcctccaccacggtcgccacggtcaccaccaccaccaccgccgccgccgtacggtccgttgccacggggctgaaaatgccgttgtgggaagggaggggggcataaattagacaaatgcaaaatgtgtacctgaaatctatgctgattgcccattttctaataatgtaattagtgcacattaataatattgtacatgaaagcaagcaatgagatgagatatgtcacaaaacaaaaaattgttaacttaaacaaaggtactcgtatacttgtttcaagagggccaacaattttttggggaaaattacgaaattgcccagttacaggcctataattacatttgtctgaatacataatttggtctcgaccgtttctagtgcattaatgtcgaatttgaacaaaaaactgagttgtaaaccccaaaaattcattaaattctgcgactactttttttttgaatttgaatccgggattcaaagtaaatgtcaaactagaatacaattggttgaacaactctcacccctcaagaaaaaaaaaaacgttttacatttcatttccaaaccgggggctgtcactaaattggtatacaaacaccgctgacaaaaaaaacatttggagccaaccaaacattctctctcaaaaagtatacaagtaccatatccaccgtctcctcaatcacattagtacgatatacacctatacataaattattcactatttgttgcaca

SEQ ID NO: 44427 - DNA, 1655 bp, Heterodera glycines
  misc_feature (696)..(696): n is a, c, g, or t
aaaaaataggtgttcgttttgattattttgcatttcttttaattacttttttattgttacacagtattttgagtacaagggtctctcccttgaaatttgacatttataggttttaaaaaatctaattatgtaccacccaagtttagatataattcctgcgatcacattgtgaaatcgcccatgaaaagtctgttcctgcgcgtcgaaatcgccgatcctgttctgccggagagcagtgttgtcaccacgatgttctcgtacgtgggcgaaaattttggtgtcacgacacatcacagagtttgtgctgaatgccaacgttgaggaaccggacttagtcttgcgcggcgcattccaaatccttatggaacgggcaatccaaaatgcagagcagcaaagtggccggaaagttctcaaaattggtgttacgctacagggaagaggtttgattggtcggctggtagcccttttattccttacctattaaataggcttacatgatccaatcgtattgccgcttcgaccgccagaacaaaacagctgtgacacgctgatggctgagctggacaaactcggccaaagtgatggtgaagacggaggaattggtgttggagagaatagtggtgaagcgctcgacaaacgatcattgctactcagcgaaccggtgcaaatcactgtgacctgtttaactccacctanccggggcgggccgaccgcgcttctacccgtatcagcattggggctacaatgaggcgcatcgcataaggatcagagattgggaagacaattattgtatgttccacgcgcttattggtgctcgagcgtaccacgaccctgtgctgttcaacgagtggatgttagctgatcaacagccacaacagcagaatttggcacgactgatgctgatgcaggatttttgtgaaaccaaagaagctttccgccgtcttatcatcaatcgagagttgatgtgttcctcagtgcaccgcctaatgcatgcagctggcgtacccgaaggccaacacgcatatggcatggaccatttgcaaaccgttcaacactattgggttcagtgacaaacaacaactgctaacacgtgaatttctcttttccaaaacaggaccagcggtttcccgctctgtatcgcattgtactgttcgaggaccatccagaggagttgcctaaaccaatttggaaaggtccatcagggcgtcgtttcgatgtagtgctctttttgtccaacgctcactatgatggaatcagaaaaattaactgcttcttcaagcttggcaatttttattgcgttgattgcgaatgctcgtacgggcgcccattgaagcacacgctggaatgcattcgccgttgtccgcaatgtgcaaaaagtccacgcccagtttttttttcgcttatcattgttgcttcagttgggccggagcacccatgtgcaaaggaacctggtgtaaaaatcctttgtccggcatgcaatcgattcttcttctcgcaacgttgctatcacgaccatcaggggcagacatgttcactgctgaagcgatgcaattattgttggcgcgtttatcagcgagacccaaaacgggcacataaatgtttcaccaaaatattgcacccgttgctggggggctgtactgtttatttcttttttt

SEQ ID NO: 44428 - DNA, 998 bp, Heterodera glycines
ccaaaaagttttttggaaaaccgcgccacaaaaagagcaatttaaaagcaaaaaaatttaagagatgaagtgcaatttggatcttttgtggttagacttccataaaatgcttataaatgacaagaaattgatgaatttgattgtttcaagcgaaaaatatgatagttaactgatttgttcgcaattttatgatgtttaaaaaaatgaggatttttcattccaaatgagtattttttgaggtattttagtggcaaatgggatttttatggctgaaatgaggatttccaaaattttgagaccgaaacgttgctataaaaggtatgattttccttctttttttcctgcaaaatatgaataaagaaaggagctcaaaatttagggtattttttgatagataaaaatatttaatcataaatactgggcaattagcttctaagaaccatatcggttttacccaagttcaggcacttttggtgctggaattccgcggtgaagattccggtaaaattcaaatgttagatttttaagatgtgcttcaaaaaaaaaattaattgatgccaaaatttggcgaaaaagagtgtcctcatctaagcgccaacgccgttcattctagacagtccaagtttaggcgacacgcctacaaacattcacaacacaacgtagctggaaaatttttctttgaaatgggcggcacatgtattaaatgcggcactctcttaaagggtttgattacccctaaataaggggaaatgagagtgattactttcgcctacttagctcagttggaagagcgcggcaccgattgctggggtcgcgggttccccaccgcgggttggaattttactaaatcctcaccaagaacacgacgtaacatgaatccaaatgaaatgtcaaagtattggttttataaaatcttttttcctatataaaaaaaaattctactggcgacacattgctttaaaaccttcttgaaaccctagaatatattcaaaaaaaaa

SEQ ID NO: 44429 - DNA, 550 bp, Heterodera glycines
ctgccccttctaatgataaacaaatgctatagtgtaccctctaggaggataaatatggcatgaccttcaagggctatggttgcctaattaactaactaattagcaggaaggaaacgaatatatactcaacaaatctcaacaacatagcagcaaagcaagcaaatcatgcgcattgctctaatgtgtttttcccaatgctaatcgcccagaaaataaaccaaaaagtgagatgaagcattaaaaattagccccgggcgaaatgcattctcgcgcaacacttttcatgttcaagtgcccattgcccagcaaaaaataaataaataaatgtgtgccccggggggatgcataccgcctttctgctcccggctttaaatagccccctggcgccccccccccttccctccaccctttgatgagggcggagcttcttaactacgcttttcggtcggctttatgttttggtgtctctgtttggtgtcgcgcagcactctcacccaccccccgccccttggggtggtgggtgattagtgggtgggtgggcgagaagatg

SEQ ID NO: 44430 - DNA, 969 bp, Heterodera glycines
attatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttaaaattattttttgcattttatcacccaacgttatagactgatcagaagctcaccaaattttgcagggaaactgctgagaaccctacaaatgcttataaattttcttagaattttttgcctggaggaacacagttcttcacacttaccacaccagcattattttttttaaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaaccctcaaatgcttataaattttcctaaaattttttgcctgga

SEQ ID NO: 44431 - DNA, 1220 bp, Heterodera glycines
tgccatttttcgtcaatattttccgatttgaatatctccttagtgaaaaaatttgattatgcctaaaattaaatccaaatttgaatggatgggcgagtgggtaaacagttagtagcttcactgatgaaaatcttgagaaatttttgattttcaattgcaaaaacaaccgatgaggaaaattttttaaaattatttgcacccctaattttcaagtttttttgtgcatatttggtgcatatttcacgactttatttgcatatttatgcgcatattttggccatttttcgtgcatatttttgacagccctgtttattatggttgcaaatatatatatatttttcgatttttgaatgcatttttccaaaataaatagtttaaaattttggtcaagaaaaaataaataataaaattaaaaaaacgtgaaaaaatttgaatttttgagccgccaaaaaaataataattttttattgcattttcattaaggaatttttaaattttatatgaaaaatttgaaaaatactaaatttcaatctctttttcttccttagcaaatgtttttttaattaaaaaatgattttcgtttagaaaacggactgaaaagagtgaacaaaaaatttaagaaaaatgaaaagattgtcttaattgaaaaatttgaaaaaatgaaaaaagaacagttaatcaaaaaaagaaatataaacaaaaaggcaaaccaaattgaaaaggaaattgccaaaaaactcgacgtaagtctgacgtcaatttacacttggaagagacaatttgaagaagaaaacaaaaatgaatggaccaaaatgaagaagttgatcaaagtatttgaagaagtgaagcacagattcattttggaaaagggaaaaatgacgagaaaagtcatgaaaattgttgagcaaaaaattgcaaataaaattggaacggatcgccaacaaattttcaaatggaaaaggaagtttaaagtgaaaaatgaggcaagaaaagatgacaaaagtgccatcatagcggaatttgaagcaatgaaaaaggaatatttgagaaaacatggcaatttaaacaaaaaagcaaaagaaattgaagaagaaattgtcaaagagttgggcacaagtcggacaacgattcgcagatggaaggcacaaatggcaagtcaaaagaaaaatcataacaaagggagacaaggggaaattattgaaaaatattgaaaattaaag

SEQ ID NO: 44432 - DNA, 730 bp, Heterodera glycines
  misc_feature (714)..(714): n is a, c, g, or t
acaattttttgacaaaatctagttaacaaaacatactcaaattttcaaaaatttttcccggcggcgcctatcggcaccgccgaccttccgccccgcttgtcccaaaaagtctttgaaaaaatgcgccgcaaaaaaaaaattcttaaaaatctgatttttttgagcagtttgcatttaaatgtacgatttgctaatctcctccccaaaattgttaaaaatgatcatgggaggcgaaaaatacgaaattttatactattttaattgattaaattgttacacaagcagttttaagcaattttgcaaaatgttcttatttttgaccctaaaatcttattttttggccttgatgttcttattttgaaaattttttgatcacatccctgtattaaccatgtgatggtcggaataagcacaattgatttaattaaatgcaaaatcatttattcaattaaatgtaaaatgatttaatcttttcagcaagttttctttgttcgattttgaataaattatcttatgctaaaaagttaaattaaataaaaagttatgcactaatttcatttttattttctcccgccccatttttggtaattttccggaaattttttgcaaactaaattttgatctaaacttgatttcgaattctttattgcattttgtttgatttcactgtgcttagtatttaaacaataatataccgtacttcttcgattatangcccccgggggatcta

SEQ ID NO: 44433 - DNA, 1121 bp, Heterodera glycines
  misc_feature (36)..(36): n is a, c, g, or t
  misc_feature (47)..(47): n is a, c, g, or t
  misc_feature (980)..(980): n is a, c, g, or t
  misc_feature (1006)..(1006): n is a, c, g, or t
  misc_feature (1052)..(1052): n is a, c, g, or t
  misc_feature (1075)..(1075): n is a, c, g, or t
cagaaaagcacaccctgatcaatgccttgcatcgtntggccagcttntcgtctttgattttcctgcgaaaagcattcaacacagtgccaatgggagttttctaaaaaaaatctaagaatttttgaaaggatattcggtgctaactacatattcaccagagcttttcaaaaggtgccgtcaattttgttgtacgcctcgcagtacaaattgtactgattgttcggtatctaaaaaaaaatcaaaatcaaaaccataccagggaaaggaatttaccacgcttttttcaaataaaaataattgacaaagcaggtgtgcatgtgtttgaaaatttcgcgcatttggaattcgccatggcacaccggacatccgaccagctgaaacatgaaccaattcatttccttacaattagcagcagcagtgctatggcgtacaaggttgagaattaatttaaaccaaatttggttagcatttaataaatgtaataacactgttcattagaatagggtaaggggccgaaatttaaaaaaaaattcccagacggcgtctgtcagtatcggtcttggtcaattttatttctcggaaaaaacccgcagaaaattttcaaaaaagcgtagaattttatgaaaatgagtggttagtttcaacaatatgccgagaaagtctctggcagaatattttgacagcctgccaggtttgctggacgacgcaatggcatcgtccccggtttgccatcaaagacgcttgggaggattttctcgaccacccaaaagccgagaaactcgcgcagcgccttgccatattttcgtcctcattcttcaccgccgccaccgtcgttgtcgtcattgttggctttttctcctcgcttccattttctgcagcatgacaatcatttcctccatcaccgtcgtccccattggcaccggcaccaccatttggcgatcgttttgtcgtcgtcgttgactgttgttccatggcgatgnccgtcgttgtccttggcgatgggggntgcggtgtgtgccgaaggtgttgctctttcacaccaccatgaattnggtgcacattgttcttccactgntccagctcgccccagcgggggatgttgatgtccgccatttgctcct

SEQ ID NO: 44434 - DNA, 1311 bp, Heterodera glycines
caaatactaatgctacggtactaccgctaccgtaactctacacttcacatcaaatccgacaagatttattataaattaattttaaaaatatttgatttttttgtttaaatctaactaaaaaataattttggtattgtaataattaaaattattgtactataattcactattaaaacattgcctcaaatacaacgggtggccttttcaagaattaatttatgtattgccataaaaatcagtgaaacgaaacaattcagccttcccaaaacaattaagacttttaattttacttaaaagaggagggaagaacagaaatgcatttgctttaaggaggatcagcagaatgaatttgaatgaaattgattactacggtcgaatgactagggtcgacacttttagttactaaaaggctcgaaatcgttaattaaatagtgaggaaaaatgccaaaatattgactaaacgtccgaaatagtgacgaatagtgacaaaattttcagccaaaaattgagcaaaatataattatttttttttcccggcggggtatgttggcaccgcctgatcccaaaaacttttatttttcttaaaatatcggcttttaattattttgtgacgcagtgccaaatagtgagttcaagtgatgggtaatggatgacatcagaatagaaaaaattacttttttgagctcctttcttcaaaacaattgagcaaaaatttttaaatcactaaaatcacaaccctagttatgacgtcagtcaaaaacctttaaaataatcgtactcaaaaaatcctcaaaataaagatttttgcttgtttgctaaaagaggtttctgtgttttggaaaaaaatctacaagatatgaatatgaatgcttttgaattcaataatttggtaaatttttttttgcaatttttgcttaattcttgagggttattgtcgtcttcttgaaaaatcctcaattcttcgattgtctccttaaacatataaaataatgtaaatgaacactcatctatttctttttaaattttgagttaattattaatattcttccaactataaaacttttacagtgataaagctgtatattcaaaataaataattttctaaaataaaatttatattgaaattaaagttaaaaataatattaaacaatatatatattatgcaaaaaaataataatgataataataagaatatgtttatctatctaatctaataatttactatttagaaattactcttaatttggttagatttcgaagtaaaaataaaacagtagaaaaatacattctgactttaaaaaatataggaat

SEQ ID NO: 44435 - DNA, 992 bp, Heterodera glycines
  misc_feature (894)..(894): n is a, c, g, or t
  misc_feature (914)..(914): n is a, c, g, or t
  misc_feature (921)..(922): n is a, c, g, or t
  misc_feature (952)..(952): n is a, c, g, or t
tgcatttaaaaataaaaaaattcttgaatttgcttctgaattttttaattttaaatagaaaattactttttcgaaaattttgcacaaataagaggcgaagaaattcaattgctctgcccaccagggatgggccaaattgaaaaataaaaagcgaaatgcgaaaagcgaaatttgcgaaactgaaaaatgcgaaatgaaaaaaaagcgaaatgcgaaaagccaaaatatgcgaaaatgcgaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagaggaggcaggcggcgccggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaaaggagatttgggggcgcggcggtgccgataagcgccgccggggaaaaaattggaaattttgatcatttataaacaggttttcactgaaaattagccactttataggtaaaattttgaaaaattttatgggaatttaatccaattcttaggggggtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgctgcccacccagcgccacacgctgccgcccntgcggcgatgactttgctgnctgatgnngaggaaaagcggcggacgacggcgcatcgngccggttgagttccccggcattatgtctctgcccgacgac

SEQ ID NO: 44436 - DNA, 1122 bp, Heterodera glycines
  misc_feature (983)..(983): n is a, c, g, or t
  misc_feature (1027)..(1027): n is a, c, g, or t
  misc_feature (1042)..(1043): n is a, c, g, or t
  misc_feature (1083)..(1084): n is a, c, g, or t
  misc_feature (1088)..(1088): n is a, c, g, or t
cgacaggttggtttcctttctccttaatttaaattaagttttgtatttttagatttttgattttattgctccgtttgaaatgggccaaaataaaaaagaaaaaataacaaagattaaaaataaaattggtgcattaattgcggaatgggcagcgaagcacaacaacgccatcatcagttgatatgcacttaattgacccttttctgatttgattatattaattagtgattcctttttcaattaaagctccaacaaaatattattaatatataaaaacatgaaagtcaattataaagggtttttccttttaaaatttatcaattatttactaatacaacctttaaaaatgtgtttgcttgcgcagagctgcactaatcaaacctccatctatttccattgaaacagaagtgctcttcaatgggtcattggacaaatccaaaacgaatcaggcatttattcgttagggcacaaagaatttgcgaaccttttgaaaaccataaaaatttgggcaaaaagtcgcttatatgtttgaattttgctttccaattttgtttttcagctcgactcatttgttccggcatttttggctattttaacggcgttactttggcaattatggcaacaaaaatttgtctactctttcctaatgcgcctttatcatttttactgtaccaatttttctccgtttattcaaaatggtaaaaaaaaataataaatgaaaattatttaaataatttaaatccaaaatctactcggaataaatatttcatggattggatcaatgcttcgattttgcttggaattgttaacgccaatgacaattaatgcaattgtgtcacgttggcccccattaattggccaaagtgtaatgactgtaattaccccaaaatttccggagcaaaacgcatctttaaatgtgaacaaattcacactccaaacaattctcgaagaattagccatcggtaaaaaaggatattcattanagcaaaacccaatttaattattcaaattcctggtaatttagcanatgaaattctttccnngagaccaaaaaaactggaaagcaatttttgaagaaattannattngagcaaaaatttgaactttttgcgctcattgtct

SEQ ID NO: 44437 - DNA, 1020 bp, Heterodera glycines
  misc_feature (64)..(64): n is a, c, g, or t
  misc_feature (71)..(71): n is a, c, g, or t
  misc_feature (948)..(948): n is a, c, g, or t
agagtcaggcattgccgtgggaatcggtggatacataaacaaaataaaccaccaaattattttntagattntcattcggtttcgaacgtgatcaatttcgattttccgctctcaactgatatgtctgatttttattgaattttttatactaatttttgcttgaggtatgtccatcgagtgggcagaacggcacggggatttaacaaaggcacagcaatttcttttgcttcccaggaagagttgaacctttttgaggtggttcgaacggagatcaatgaacgaagtcaaaaaaaaaaattttttttttcgtttcttcgatggttttttatcaccttttttcagtgggccaggcggttatccaaccttatgaagtgcgtatgaaagactttgaaagtttccaacttcgagcaagggtacttcctttgtttttgttaggcttttaaaaaaatatttttataggatgttatagcggcgtgcacaaagacggtaatccgtgaaacgcgaatggctgagataagggcggaactgctcaagtcgaaacgattggacgcatattttgagaagaacccgcgggagaagcgtgctctggagcaggaccggaagcagttcaagctgaatgtgcacagtgctggcattgccgacgtgccggattatattggtaaagaaaagcgagcaaatttgtgaatttacaatcgttcagttccgaaagcgcttcgtggacaggactttaacagtgagcaaaaacggacaaaaagtgaaaggaacaatcggaagagaaaacggccatttgagaaggcgggggcaaaacggaagcacgcaaaaatgttatccgatccgttgcaaagcttcaaattttaaaaaatttgttttgttaattgtttaccatcttttcataaaaaaataaaacaaacaatatgttgaaaaagaaaaatgaatgacatttattanaaattgagttggttttgtaaactcgtcatagaattgaaggcgtatctcgtagaaattcaaatcatctaaaaa

SEQ ID NO: 44438 - DNA, 763 bp, Heterodera glycines
tagaatttcaaaaagctctattcaatacttcataaatagctgattcagcatggtcttcaaatgttcgggtgtcataacttttttcaatatgagacaatctcgaaaaaacccattagattatttagattcagacgcataaactttagctaaaccaaaatttttaaattttccaacaaaataggaaaaaattcagaaaatccccatttctcgagaacctctctagggacaataattttttgcctctaatttattcttctatctttgtttttttttcgggaaaatgtttgttttaggcaaataaaatttggggctgagaagtgcctcctgtggaatgtgagtgggtttacatagccaaggccttggccaattcatggggccataactttatgaagtcaaagagtaaaaccctaatcaatttttttttcattaaatataccattttatgatgacagaacttctacatattacaccccaattaaatatatgcatataaatttcacaaagcttgaaaaagctgagttttctaagaatgacttggttttgcaggaaaatattttcgtataagggctatgaaaattttcaaaaaatttgataattatctttaatatttttttttacaaaaagtctcatgttcttaaaaatgaaaattttaagaaaatcaactttttcaaacttcatgaaataatgtgtcaaataatcgcccaccatagtaataattaataaagtaaagggcgagaatatttgtaaattaatgttcaagtat

SEQ ID NO: 44439 - DNA, 1593 bp, Heterodera glycines
  misc_feature (83)..(83): n is a, c, g, or t
  misc_feature (1562)..(1562): n is a, c, g, or t
aaaaaatatttatgaaacaaaaaaatcgatttttcaagtgtcgttgggggtactcaaacatttatggggagcaaaaatccacngcagaattaaagtacaggctatagggaagctattcccgaaggattcggtctccccataaatctgggcgcatcggttcggggggactgccccgaaaacaaaaaaaatcgattttttcaggtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaaaaaatttggagcgatttgaatgagaatagaaagagccaggttcgatgaagttttggtaagccaaaaaaatatccaaatatttaaaaatctataaaaaatttaaaaatgagaattcatgcgagattttctggaaataagcttaatatggcatagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggtttgatgaagttttggtaatccaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttatggtaagccanaaaaaatatccaaatattaaaaatctataaa

SEQ ID NO: 44440 - DNA, 929 bp, Heterodera glycines
acctattccccgacccgcacccccgaccatgtcgtccccccggaggtcccccggcaccccgactttttgccccccgtaccccccgacacgaattcggggggattggggactccgagcgttgtaaaaatataaaaaattaattcaacaacgaagagggggaaaggttgaaaattttagaatttttttaataaaattgattaaaaattacgaaaaactttccggcggcgcctatcgacaccgcctgcccccaaaaacaccaagttttttcttaaaaattggctcgaaatcacaaaatttagacaatttttggacaatagtctcttaacaaattatactcattttcaaaaattttcccggcggcgcctatcggcaccgccttaccacttccccccaccccaagtttccaaaaaagttttttgaaaatcgcgccgctaaaattgttcaaatttatgagattaaaatttttgagcctcgaaattcgattttcagtttctgaaaatttttggagcctgggatgccttgttataaaatgccaaattggacgcatttttagttgattaaagtgaaaaaaggaagatttacgagcattgaaaaagaaaaattgggtttttcgttaaaaaatttcgttgatcactacccgatcggggtccccgacccccgacaattgagctcctccccgacccgacccccgacatgtccccgaggtccccggcccccgacattttgccccccgaggggtcggggaggaaccctactttgtattattgaaagatgaaaaacatcctctgccgaaaatcacaagtgctggccaataaaaacaactcaatcgattgcctaatttgctggttgcccattgaaaacttcaaaagactcattttcatgtaaataaacattcgattattagagatcgggtttttagttgctaaaaa

SEQ ID NO: 44441 - DNA, 1049 bp, Heterodera glycines
taatttagtaagataatgtggcttgaattacaggttacacaactggaaatggaagcgcaaaaaattcgtggcatttatgacgccacccgtttggaagcacaccgtgcaattgaggtattaattactaattgccgttaattacattgcaattagtaattagcaatttttataactgtaaattaggtaattaattttactaaattgaacaattaatgatttaggcggcgaatgcgttcacgcaaattgcgcacgggttgctgcaggcgcgcaacaacactcgcaccgcacaacaactgatgaaggagacgcaagggcatctgcgcggcgttgctgaagcggcaacaaacgcaaaaagtgcaagcaaatcgatgggcgcaacaattgacacggctgcaatggaagtgtctgcggcgaggtaagaggaaaatttagcgatttttttttgagtaaaattaatgatcagtttaaaaaaaataaaacttagaaatgtttcaaaaaaattcaactatttttttataagaaaatttcaagaaaaaaaaatttttaaatttttctggcgaattttcaaaattttatgatgaattactaaaaagaatttttctttaaaattttctccaaaaatagcttaaatttctttctttcttgaatttcttataaaacaaataaatgatttttctgaaaaatttaaaaatatatttgaataaaaacatttttttgatttgcttcatttagatcttcaaaaaacgattattacattttaaaacttaaatttaaaaacaatttaactaaaaattaaacattaatttttgattataaattttattttaattgcacgctttttttattgtcaatccctcagggcccagggcgacactttggacgtgcgtttggccaacattcagccaaggctttctcaggccaaagcggacctggccaaagtcagccggacaaacggggagctgaacgcacgcgaggacacagttgccgaaattgacaaaatcatggacaaagcggagaatgcctatcaaaaagtggaaataatgaaaatt

SEQ ID NO: 44442 - DNA, 683 bp, Heterodera glycines
caaagggcggtcaaatgggggcgggggagggcacctaccgtaaacgacgacggattggctcacaagcaatttttacgaattgccgagatttaattgttttactaaaacaacgtaaaactgcgccaaatttcctccttcatttctaatggcataaataaaaaatccccaaattggggtgaggaaaaacggcggaggttggcacttagaaagaaattgctaaaaattgaatgcattaatcaatttttggccacccattgcccgttttttcgctgcccccagcaaaactgatataattgttcacttccttttcgcattacacacatttgatgacaatgtttacagagcaaaagaggaggaagaggctaaaattgtgccacccaaacagtgccgtcgatgtcattttggtttttaaatgcaaaaatataactaataattaaattatagaattcaaattcgtttttttcgccccccccctctttttctgttttctgttgattcatcctccttaatttcttaaccaccagtttggtcttctccatttattctctcgagagttgctcttggctcttttgccacctctctccccccactccaatgaaatgagtgggggggggggatttgtaagtgagaagggcgggggcgggggacagatgggacgacgagggaaaagcacggggggtggg

SEQ ID NO: 44443 - DNA, 803 bp, Heterodera glycines
atttccaaaaaagttagaacatgaaattgcaaaaaagttgaaaattttgaggttttttcctaataccttttttagaagctaaaatttttgtttgttttttgtaaggttaatagagcttgtgaagggctttcgaatgataccaagattgttagatttggtcaacaagaaaaaaaaagttataataaaaaaagtgaggctggcgccaaaacggctgcgccaaaacgaccgattccctgaatgtacaactacccctggtgacaaaacaaaattacgaaaatttccttgacattttgtattttctgcgtatgaattgggagtgcgaagaagtgatgaagaaaataaagcaggttaaaaccatccgataagaattctagtaggaaattaatttttatttaatgctttttttaaatactttttggaaaagatttaaaagatctaaaaattccaatttcatataattcagatatttcaatgatggattcgggaattaagggttttatgcaatggattaaaattatagaaattttatctgggttctataaattgtctagaggcaggaattcttgacttggaatttttcaatccgaaatcccggattttgcaaattttggaccagctgtggactacctagaaaaaaatatacaatttttaagacacgttacgctccggtgccggtgcctttcggccaaaaaaattgtttaaaaatttggacgtatcaaaatgttcaaattttgacaattcgtatggccccattcgcgaggtagttgatgccaaagatgcgcgaacaaaggaagaaaattagg

SEQ ID NO: 44444 - DNA, 1027 bp, Heterodera glycines
aattcgctactcacagacaccaattccagaattattttcctacaatgtgatacatttgagtcaatttttcacgaaaattgaatttgattgagttggtcaacaaattttcagtaagagaatttataaaaaatggataaatacccttggaattaagactaaaccgaaccaatcatatccagcaatatatcttgaaaaatcacgtcagtttggacccttctgtacaaggccagagcccgtggtcacggatttgttattagtatttgaaattggcaaaacttttccattctttgggcagctggacaacaatgacaaagtacagtaaaataaaaaataatttttatgataccgtatttcttgaaatatagcccccgggggcttgatcttgggggctttgtttcaggggggctgtattcagggggtatctaattctggaagggggtctctatttctaaaatttttaaaagggagtctttatttcacggggtgtctgatttagaggggggctttgtataggaaatgccgtatttatcgatttaatttttatataataattcacattgaaaagattgccttgtgcagtaatattgcgatgccattgtatgtgttgtgcaacagtttctattcggtgcaacaaaactgtgaagttctgtgcacaccagatggcctaatgccaattaaaatggccgaaaattcattttataagcaagattcagtgtgagtgaattattattataaacttattactaaattaagatttaatttttgataatttttaatagggttcgagccccgtgggcgggggtgcttagaacatgggctcccaccggctctaacggagatcctataggtcccggacagaggaaccggaacaactgggataacaatgcccaaacctcgagaggttcttttaatacatcgaatagtcatccccaaaatgacagaagatggaccaatcgctcttccagaaatgacagacgatggaataatcagtctcctcaatatgatcgaagctggtcagagaactgac

SEQ ID NO: 44445 - DNA, 1227 bp, Heterodera glycines
  misc_feature (504)..(506): n is a, c, g, or t
  misc_feature (510)..(510): n is a, c, g, or t
  misc_feature (522)..(522): n is a, c, g, or t
  misc_feature (524)..(524): n is a, c, g, or t
  misc_feature (529)..(529): n is a, c, g, or t
  misc_feature (537)..(537): n is a, c, g, or t
  misc_feature (540)..(540): n is a, c, g, or t
  misc_feature (542)..(542): n is a, c, g, or t
  misc_feature (565)..(565): n is a, c, g, or t
  misc_feature (573)..(573): n is a, c, g, or t
  misc_feature (578)..(578): n is a, c, g, or t
  misc_feature (582)..(582): n is a, c, g, or t
  misc_feature (587)..(587): n is a, c, g, or t
  misc_feature (594)..(594): n is a, c, g, or t
  misc_feature (609)..(609): n is a, c, g, or t
  misc_feature (611)..(611): n is a, c, g, or t
  misc_feature (617)..(617): n is a, c, g, or t
  misc_feature (619)..(619): n is a, c, g, or t
  misc_feature (632)..(632): n is a, c, g, or t
  misc_feature (639)..(639): n is a, c, g, or t
  misc_feature (642)..(642): n is a, c, g, or t
  misc_feature (651)..(652): n is a, c, g, or t
  misc_feature (658)..(658): n is a, c, g, or t
  misc_feature (663)..(664): n is a, c, g, or t
  misc_feature (681)..(682): n is a, c, g, or t
  misc_feature (689)..(690): n is a, c, g, or t
  misc_feature (692)..(693): n is a, c, g, or t
  misc_feature (704)..(704): n is a, c, g, or t
  misc_feature (718)..(718): n is a, c, g, or t
  misc_feature (725)..(725): n is a, c, g, or t
  misc_feature (738)..(738): n is a, c, g, or t
  misc_feature (745)..(746): n is a, c, g, or t
  misc_feature (749)..(749): n is a, c, g, or t
  misc_feature (752)..(752): n is a, c, g, or t
  misc_feature (775)..(775): n is a, c, g, or t
  misc_feature (784)..(784): n is a, c, g, or t
  misc_feature (794)..(794): n is a, c, g, or t
  misc_feature (810)..(810): n is a, c, g, or t
  misc_feature (812)..(812): n is a, c, g, or t
  misc_feature (824)..(824): n is a, c, g, or t
  misc_feature (830)..(830): n is a, c, g, or t
  misc_feature (832)..(832): n is a, c, g, or t
  misc_feature (839)..(839): n is a, c, g, or t
  misc_feature (841)..(841): n is a, c, g, or t
  misc_feature (845)..(845): n is a, c, g, or t
  misc_feature (848)..(848): n is a, c, g, or t
  misc_feature (853)..(853): n is a, c, g, or t
  misc_feature (857)..(857): n is a, c, g, or t
  misc_feature (866)..(866): n is a, c, g, or t
  misc_feature (869)..(869): n is a, c, g, or t
  misc_feature (884)..(885): n is a, c, g, or t
  misc_feature (887)..(887): n is a, c, g, or t
  misc_feature (890)..(890): n is a, c, g, or t
  misc_feature (893)..(893): n is a, c, g, or t
  misc_feature (895)..(896): n is a, c, g, or t
  misc_feature (905)..(905): n is a, c, g, or t
  misc_feature (910)..(911): n is a, c, g, or t
  misc_feature (922)..(922): n is a, c, g, or t
  misc_feature (929)..(929): n is a, c, g, or t
  misc_feature (953)..(953): n is a, c, g, or t
  misc_feature (967)..(967): n is a, c, g, or t
  misc_feature (1020)..(1020): n is a, c, g, or t
  misc_feature (1061)..(1061): n is a, c, g, or t
  misc_feature (1064)..(1064): n is a, c, g, or t
  misc_feature (1078)..(1078): n is a, c, g, or t
  misc_feature (1110)..(1110): n is a, c, g, or t
  misc_feature (1119)..(1119): n is a, c, g, or t
  misc_feature (1173)..(1176): n is a, c, g, or t
tagtcggcttttgtgtggatttatctgctcatctctcgatttcactaagagtccattttcctgaaaattttaaaatatgcaaaaatctaaaaaaatatctaaaaaattagatacaatttttttcttaatttttaaaaaattaaattattaacgttatgcagaataaaaagaaaccttcctaagctgttgaatgacaaagaaaaattttatataattatttggtgtattattgtctaaccaaaaggaaaaatttcaaaaataaaaaatgaaattttataaaattttcatcttgatcagtgcccaaaaacgatattggcatcattattttagatttaattatttcgtttgaattgcaatagacaaataaagaaaactgtacggatcagggtggggcgcggaattcattattaaataatttatcagaattgcagattcggatcaatggcaactcgtacagaataaatttgagtctagtgcacctcaggcgtaaaaaaattacataannncaanaataattttctntntattnctttttanctnanaatttaatataaaaaaattatanacttcaantttcntttnatacnaacaatntaatacttcttaaantncactantntcaaaaattttanaaaaaanccnaaatcttanncacaancctanncctaccctaaatcttanncataacnntnnaccaaattatntatcacttcttccnaatttcnaaaaattaaatanataattnnatnaanaaaataataatttaaatacaaanctaaaaaanccaaaaattnaattaaataaattaancnaacaatcatttnaaaatnanttttatnanaaanctnatcanaatntttcttctnctnatcacacaaattctnntnatnatnannattacaatnacaanntaatataacanataaaanaccatttattaatccaaaaaatanattttataaattcnctaaatttttatattttttttctttaaaaatcaattatttctttacaatacanaaacaacaaaacaaatcaaaattttccataaatttattttnatnaagaagaaattccncaaacaaaatttttataaaaatttatcaaatnttcaatttnaatcctaaatttcaaaaaaccttgtaaagaaatcccacccaaatttataaattnnnncgaaccctctggagaaaaagagagagaacggaggaggaaagtgaagaaaca

SEQ ID NO: 44446 - DNA, 1212 bp, Heterodera glycines
aaacagatgagccgaaatagggagacggagtagggtcagaggcccacagaaagacgttatcggatggcgaattgttgtctccttctccgttttgattatgtttttgaatttcattggggccattaatcagccgattccttgacaattgcgtgagaattggcggaggaggaagaaaagtgccaaagtaatcagaagagttggagtcgaatgaattgaggaattgggcaccggacggaagagcagtaacaaaaggagtaggaggaacagaagtggcggactaaaaaatgggcgaatggaagaaaagcgggggggggggaatgcctggtgaaagggcgaaaagcatggcgaagagccggaggaaaaacaaagtcgaggacagttttgccgaactcggttggcacaacaaaagaccgaaggtatacgacggcagtcgaaaaacgtctgcggagtcagcagagggggagggggagggggaaaaagcggggggacggacaaacgcttggaaggcacagaatggaaagtgagggacaaagagcaggacgaagaagacgaaagaggacggaagagggagcattagctgaagatggggaggcactgatcagtcgaaggaatatctgcataagaaagggaattttggctgcaaattgcgcaatcaatcgatgatctctgcgcaaaacgcaggaaaacacttcggctggtttttgggccgctgtgagcgaaatgcaataaaaagtccataaatctgatttaaatggataaatttgtgagcaaactgctggcctttttggaagagaattaaatgtaaagagagagagagagagagagagaaagagaagcacagacggaataaaagtcggatcagatcaaacaaaagctgatgggaatgggggagggggagggaggcgatcagcggatgagtcaccctcccccccccccccggggggggggattgatcagccgtagctcatctacagcaaaactgagaggctatgtgttcttagataagcagttatacagcagaaaatatatagtcgttcataagcataaaaaagagaaatggcacaataattggaagaaaatagaagagaagggaagagaatggcattccaaatttggccaatttccgattgatttgaatctcatttccttgtctgctgatggcattaagttgtcctttccaagatgacttctcacaacggtgcattctttgct

SEQ ID NO: 44447 - DNA, 984 bp, Heterodera glycines
  misc_feature (973)..(973): n is a, c, g, or t
ttctaaaaaagcccaaagattatttttagcgatttggtgccttttttggcgttttttccgaaaaattccattaaaaatacaataaaatcgggaaaatacacccctaagaaatgaactaaaaaaatttcagaaatatacctttaagaattgaaaattttctcaaaaattgttcgccaaaatttcattttttttcttgataaaaattttaggtttaaaaatttccttattgataaacattataaaatattgaattatcattaaatcagcaaaattaagtcttttggttaagttttacgtgttttgttccataaaaatccttaaaaaattttttaaatgccttttttcatgcctttttcgggattttcgtgccttttttcaattttttggtgcattttatagtgcttttttcgcgattttggtgacttttttgcggtctctagtcatagcacgcatattttgttgaaattcatcaaaattttctcaagctggtgactttcggcatccccgttttagttttctcagccatgaacaaaaaaattttttttttttttgcaaaaatctcgttaatctaaataagattttaaaaaaatccttatttattaattacttatactttcacaaaatgtgaatttctttaattaattaaaaaataataattattatttgagaattttctcattttaatttaaccattaaattttttcttatctttttttctgtaaattttcaatcaaatttaaatccatgtttaatttttctgtaaaataaattttaaaaaaaaacatttttagaagttcaaaaaaacgctactccaaaaagtttggcctgaccaaacaaagcacaacatcagcggcggattacttcaatttttcgtcgtccatcggcgaagaaattttggacgaaaatttgcgccaagaaaaattgagcagtgaaagcagttcaaatgtgacgggatggagatgaaaccgaaaantatacatctaa

SEQ ID NO: 44448 - DNA, 1184 bp, Heterodera glycines
cgatatttgaaacgcgaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttgtcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttgtcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaaattcttgaccaaaaaaatagctatctctttttttctcatttttttaccgcaaacttggtaccaacagttgccttctcttgtctggccctatcaaacaatcttacgaatatttgaaacgcaaacaaaaaaaaattcttgacc

SEQ ID NO: 44449 - DNA, 1246 bp, Heterodera glycines
  misc_feature (1146)..(1146): n is a, c, g, or t
ttggctttctgtgattttgtatacaccaattttttggactttatgcttaatgttgttctattctcgtctgatccttcaatcaataattttgataacattgttttattaacacgcagtgggatttgaacccactgaacccagcaatctgtgccatgctcttaccaactgagctacgcaatcgcacttttccttgcacttatttcgcgcgaaatcacacattatggctcttctgtcgtataggcgcatggagagaaatatgtcacatttattgtacacagtttgttgaattataatgttgattaataggtctcttgattaattcttattatttgttctttttattttatgtatcaaaaaataggaacgaaagaaaattaaaagttaaaacagttaacagaatacaggacaatcgaacgcttagcgtggctggcttaatgaccagataattaattatacacagtttagttgggcatagaaattttgctggagatagcgtaaatggatggaaatagttgtttggattgttctgaatcgtggaatttttccggcggattgttccattcttttctttttatgactgctaagacattcttcatgccagcgtaggataaatagtgatttacacggattcttttttatgtaaatacatgtttttttcctggattctccatagcctaattagtaggaaaaacactttcttttttgtgtttgcgaacaaaagttgggacttttatttacatatttttacatatttcgggatttttctacatattacatatgtacatatttttatacatattttggactttttcgcattttttcgaacatattttgaaatttttgaggattttttaaggaaattttcattaaatgtccccaaaaaaaaacccaaaatttcacaattttttgtacatatttttaggatttttgagaagtgatagaaatttcatatgaaaaatttaaatttttttttgaaatatacccctaaaaatcgtttttttcaaaaaagagatagtaaaaagggtgcttctaagcctatttaggtcatttttagggcattttgtacttatctcacccctttacgaagattttttttcaaaaaacaccatttaaaaaattttatttacatattttagtacatatttnggttctttttgtacatatttcatacatattttagcattttttatacatattttatttacatatttttgcgatttttgcttacataaaaaaagaatccctg

SEQ ID NO: 44450 - DNA, 1097 bp, Heterodera glycines
ttctgtaaatttgaatttgaacaattgaataagctaatgaattaattaattaattagtcataataatccgatcagaaatctgatcaaaaaggaggatggatcacttgatcatgaactgatcaatgagacaagaaaattgagaaaattaaacagacagaaaatgatcaatgatcaactcaaatcagtggatgatcaaagaaagccgagaaaagtttgatctctgatcagtgaaatccattaaaaaacgatcactaaggcagtgatcagaaaataccatgaaccatacaaaaaatcacttattaatacatagaagaggaaaagccctgctgaaaacaacaaaacaacaacaacgagttttgtgtgctgtgtgctaatgccatccatctcattttggcgaattttgttgctgattgtgagcaacttgttgctgttgttgttgttgttgttgttgttgcggcacagcagcgatttgttgcagttgcaccagttgttgctgttgttgctgctgctgctgctgctgctgctgctgctgctgctgctgctgctgctgctcggtgaagccgatgccgccaaatgagtgttgccggaacagtccgttggcggtagcggcgccggcggcagcgactgccatcgcggcaagccgttgttgttgctgttgctgctggtgttgttgttgctggtgttggagcagttgctgaacggaagacagtgcgttgctcagtgcgaccgccgcaaccgtcgctgacgcgttcgcggcgactgaggagggcgactgttgaggcggttgctgcgactgcaaaaggttggcaaccgcggcggctgcgggaggcggcggtcgaaatgcgctcggctgctgatagtcagggacgctgaacagatttggagtggaccgcctcatatgtgccggcaattgggctgaaatatttggaggggaattagttactactgatcagtcgggtgatcggaaaattggcagtgatcgaaaaagttgatcgaaaaatattggttccaatacgatatacaataaatgtgatcagggaatttgatcaagaccacgcgatatacaaatggatgtgttcagggggaatttgatcagc

SEQ ID NO: 44451 - DNA, 1125 bp, Heterodera glycines
  misc_feature (125)..(125): n is a, c, g, or t
aaagttttttcccagaaaccggatggtcaaataaaaaactaaacatctcacatgaccaatttaaattccctacattttggggttacttatttatgctgccccataaaaaatgggagtttttccgntgccaaatttttgtgaattttcttcgggcccgtcataagcggtttgtttgggggcaaatgaaaacaaattttgtgttattcctttgcgctaggagagctctagattttcaaatgtataaaaaaagtgtctatctcgactctctataaagttatgtgcagccaaagcagagtggaccataaacacgaatttttttatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggg

SEQ ID NO: 44452 - DNA, 777 bp, Heterodera glycines
aatagagagtgcagagaaaaaacatctctctttttgacgtactatttctttatttctgttaatagagaaaaactgaatttacttcgccacatataactttttttctactcatacaatttacaccaaattttgcatgtcgatagagaaaaaaattacgaacaaaatgtaagggtttttaaaagcaaaaaaagggttaactaaaaagttattcgagaaacaaaatttcgaaccctcatatctttttcctaatcaatccaattgcttagcatttgcttagaaaaagcttctccacatcaagggctttcgaatgatgtcaagattgtacaatttggttggtaaaaacctccaaaaataattcccaaaaatggtcattttttaattttttgcacaaaaataaataaaaatattcatgttgcacaacggactcgaaccaacaccctttgtccctttactatcttacaaaaaccactgagccacacatgcaaatctttttggaactgggaggccaaaattgaaacggtgtgtaaacagaaagagcacaaaattctctacaaatttagaatgagccattaagcgtatggaaagccaaaattttagaaaacaaaaattttcaaaaaaaaatcaagtacttgacgaaaaatcatagacaaaatcaataatttttcaaaatcttagctcggattcgttatcagtgcagtttttaccttagaaaaagtgatttgtaagaaaatatttatttatttttttcggtcgggacaccaattccgaaggattacc

SEQ ID NO: 44453 - DNA, 557 bp, Heterodera glycines
tcggtaccagcccaacaacaacagcagcaacaacaaaacgtctgcattggcccatgccccagcggcgaattgcccctcgggggtaaaaacccggtgttgtgcggcgatcggtcggactcaatcggctgtccttccggctttttctgcgccgatgggcccccgtcggtgtgctgtcccggccacaaaagtgccgcttctgtcggcgatgtccgacgaaagccgtccattggggcgcccggcggtgcggaaaagcaattggaggtcaatccatcggatgacgaggaggatgacgcggcacggacaacgccaacgaccgattggccgccaatctgtccggacggatcggacccactaaaaaataaaagtggcgagattatggcatgcggatcgggcatcgagatggacggacacgcgatgtgcacacagggcttcttctgctcaattaacagggagaaaaattgtacgaatggcggggagaggggggggggggggggtgggggagtgccatgggattggtagggagtcaattgggaaaggcattggctcatgggatggaa

SEQ ID NO: 44454 - DNA, 1168 bp, Heterodera glycines
  misc_feature (1130)..(1130): n is a, c, g, or t
gggtaaggacacaacaaatttggcgcagtcagcaacaaaagcctaagcggctttcatcggacattttaaaaaacatcacctgggtggtgtaagtttccgctgtgagcggtttttcaactcaacaaaaaaacatcacctggggcgtgtaagtttccgcttggtgcggtttttcatcgaaaaaaactgatcacctgggggtgtaagtttccgctgggtgcggttttgaaaattgaacaaattttcgacaaaatttgacatgaacgcggcacaattggaacaaattttgaacgctgtgcttgcgcaatccgagacacggatgcagcaactgcttggaaatgcagcaccagcgaacaacaacctcagcaatgccaatttggcaagttcaattgatgcccggatttcgaaacacggattaggaacgtaaaatttttagcatttttgaaatatttttcactcatttttggatagtcctttttatcccctactttcattgcaattttgatggccagtagagtagaaatataattattcaaattaattcttatttacaaatgccgaatatttgttttttttaatgtgcaatgtaaaatcccgaagtaataaagaaaaatactgagatttaaaaaatcatgcaaaatttgtttcaaaaaattaaaaaattaataatttcttgtaaattacaatttttaaaatttcaacagttttttttctttgaaataaagcaacggtttattacagaatttaaataaaaatcatttaagaataaaattaaataattaagcgaaagattagtcttagtttattcaatttaaaatttttggtcaaatttatctaattttttagaagcatcaattcaatcctccaaaattttcttcgacaaattgtttcttccatcttataatggtattttggtgaattttcaatgttttggcaatttcattatcactcatttttgtattttctctttttatttgcgaataaattttcattttctcctttttttcttcctccgttattcttttcttgctaatgccaaattgtttcttccattttattattgtagttttgctaactccaattttcttacaaatttcggcataattttgtttccattcattttttgaatattntcttttttgcttatatttctctgtcatttcaataaatt

SEQ ID NO: 44455 - DNA, 1030 bp, Heterodera glycines
ggatgtagcctagctgcagctgacgaggaagatttttttgaaaagaaactttattttgcatgacgaattaatccttccaaaatttagcattaagcatttggatttatttgcatccagcgcttttaatttatttgtggtcgtgggaagagtcaggggccctatgtatcctataaaatattaatttgactatttttatgctgaaacttccaatttttattccattatgccgataggcaccgcctgggcattttgaaaatttattgtttttatttgatttttgcacaaaaaatgacgaaaatatagacatattcaataatagatttttcaaaaaaaaaaccatttgtctgggttttttgggcgaattgtcaaaatttctggagaataggcacagggatgttgcgaatcggaaattaaaacagaaaaataaaataaaatatgaaatacgaaaaaacacgaacacaaacgccctaaaaacacgaaaaggcgaaacaagaaatttttttacggaataatttaaaaatttttatgatcattctcaaaatttgatcaaaaattttttacttttctcacaatttcaaaaagatattttctctcaaccccatcccccttcttagcagtgtataaaaatttcgtgtttcatgccaaaatacgaaatacgaacatgaaaagccctaaaaacacgaaaatacgaaaaacaaacgatcaatatccctgataggtagggagtaaaattatatggaaatccatatttttttcctggactgtgggaggcctgaaacgtacgaaaaacatgtttttagcttggtttgaagcttctaggatggatttctatatccatatttattttttttgaaaaattgaatgaattgaaattttattaaaaattgttaaatttatatcaaaaataagcaaaaaaatggaaactttcggttttttggttgatgttctcttaaaaattgtttttttttcttctaaaacgagttcttataccatattcagcgattttagatgtattttacttgaatttaat

SEQ ID NO: 44456 - DNA, 1804 bp, Heterodera glycines
  misc_feature (819)..(819): n is a, c, g, or t
accctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaagtgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctggcctcaagaccgagctcacgcagctactccgagcatctcagcgcactccgcctgcaaatgccccattcgccactgaacagaaggacagcaaaccccagtctggaggctagcagtacaacgtacagcaacaaacgggtgaatgcagaccagatacgccangctctgtccgtttccacctcatcggtttcacgtcctctttactctctcttcaagtgctttgcactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaaga

SEQ ID NO: 44457 - DNA, 1687 bp, Heterodera glycines
ttacccataaatgtcgcgttttttcgttttgtttttgtccacttgtgcgacatgcgagtcggcatttacctaattccattatacctatctattatacatagctacaaataagtatatgttgcatgtgattaaaaatttagcaaaataaaaaataaaataaatttggatgcatgagcgggtaaacacaaacattctttgtcaacagtaactcgtgaaaaatggtatagattgagtatttctttaaaaagtctgtgtatttattatggttgcttaagggtaccactgcgtcctcccaacttgagaaagaactcagtgcggaccacgtattttcgaacgagcatttctatggtctcataaatgtaggcattattttattactttaatttgaagattgtttttcaatcattcacttttagttcggcaacacttgttatgcaaattcagtgatccaagctctgtatttttgcaaacagttcagagaaaaaattttggcgtacaaacaaacacacaaaaaatcaggttttgtgcattagtgaaaatgccatttagaatttttcagtttagtcttttttaatttgtaaatgtttaagggatgcaacgcgataatttgctcacttgccttgccgatttgttctcaaacatttcgagtcagaagagaagggttggaacaattgctcccaaaagattcgtcacaaaattaaagcgagaaaatggtagtttcaattaaaaaaaagatcaaaatttaaacggttctaagattttttgcttttttaagaattgttcgacaactttatgcagcaagacgcacatgaattttttaattatttgttgaacgcaatttctgaagttttaatggaggagaaaaagaaggagcaattgggcggaagcctaaggaaagccaacagcgcaatggcaccaaacaaacggtcgttttccgcgaatgcaaaaggccaacccaacgatttgtccgcaaagcaattgaccaggtactatttatatgtaaaactatgttgtatacatgttatatcaaaaaactaaaaaaatgcataaaatgggttaggagattttttttttgcttttttactgtttatttttgcaaaatgtcgattttcaagaagtctttctttttaatgggtttttgttaaggcaacatccctaaaaggtattaaattacgtgccgagcattatgcattattacaaaaacttatttttttcttcgtattggccaaagaacattagcagaaaaacccgccctaatgatatttttaagcacttctgacatcactggtcaacaggagttgacgtggattcaagaagttttccaaggaacgcttacgaacgaaacgaaatgtctgaactgtgagacaatcagcagcaaagacgaggactttttggatttgagtgtggacattgagcaggttttggccattcgatgtgccattgtcaagccgaattggctctttttcagaatgtttccattagccattgtcttcgcaatttttccaacatggaaacactgtcgggtgaccagaaatatttgtgcgaaacatgcggcagtaagcatgtaatggaaaaagaggggaaatgccacgaaaaaacagttacctaattcatccactgctccccattaggaagcccagaaaagaatgcgcattcgcaaattgccccaactgctcgccctccatct

SEQ ID NO: 44458 - DNA, 1065 bp, Heterodera glycines
  misc_feature (120)..(120): n is a, c, g, or t
aaataaaacccgctcctaaaagtgccgattttttctgaccacagctttttgtagagctcgagctgctctttccaatggtctatcctcggtctcgatccatgcgggactcacaagatattnaagagaaattgaaaatttgttttcaaataaggaaattgttctacaaatttggaattttctcagaaaataaaaccgctcctaaagtgccgattttttctgaccacagctttttgtagagctcgagctgctctttccaatggtctattcccggtctcgatccatgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattcccggtctcgatccatgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattctcggtctcgatccgtgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattcccggtctcgatctgtgccgaactcacaaagacattaagagaaattgaaaatttgtttttcaaataagggaaattgttctacaaatttggaattttctcagaaaataaaaccgctcctaaagtgccgattttttctgaccacagctttttgtagagctcgagctcctctttccaatggtctatttccggtctcgatccgtgccgaactcacaaagatattaagagaaattgaaaattgtttttcaaa

SEQ ID NO: 44459 - DNA, 1120 bp, Heterodera glycines
  misc_feature (1051)..(1052): n is a, c, g, or t
  misc_feature (1058)..(1058): n is a, c, g, or t
  misc_feature (1071)..(1071): n is a, c, g, or t
cgcatatatatgcaataattattctttattatgcctttattacaataaataataaattaatgaaatccaattaaataaaatcaaaaataattatgtatcacagaaaaggaaatcaaattgtggaagagttggaatggattaattaattgtgcatgctcaaaaatgaattatgcgacaatttaagcaaaaagtaatgggaaaatagaagagacgaaggcttaaaagtcgtccacaattatgtccaaattacacctgcaacaataatttacgctcagcggcaaacttttggccattgtatgactccgcgagattcgaccaccactcagccaatttcgcgtcaaattgctttttgtttttcgtgtacacattgaggtaaattgccagaaggaccaccaaaccgccccacaaatagcccaaagtgaagggtttggcgaaaaagtaaaaggagaaaacaatggtaacggcctttctcattgtggtgacctaaattaacgaatgggaaaagaaagtcggactctgttcggctccaaaccgtaacggtgaccaaagcacccgaagttctgaccattgtgagcacaacattgacgccgaaatagccgacgatgccaatcagaacggaatagccgtaagtttggagagggcgctataggggcggggaagggggacagaggaggacgaagaagacaaacttgggcaaagaaaaggaaagcctcgccaatctgaccggaaaggcaaaggccgaccaaaatataggcgaaaccgatggaataggagaacagcaccttcaatttaaccatcaaaatggacattagccatagccataaactgcgaacggaaccgaacctttaaatgactatcggttcgattttagggcatgaaaatccccaaaaaatttaaaaattgtcatttttcgctttattcaatttgtcagcgccctatccccgtccattcaccattttcgtcgtttgatgcattatattccctcatcgctttctcctgcacattgccaataatcgcatccgccaccaaagcgagtgaaatcattcatagnnccgcgngggtcgaaattgngcaacactttgctgtcagccaatgagaaaaacacgagtcccaggctcat

SEQ ID NO: 44460 - DNA, 971 bp, Heterodera glycines
  misc_feature (790)..(790): n is a, c, g, or t
cccctggcctgcagaaaatggcaactgaagcgtgctcaaaaagtacacttcagtaccaggcgaataccgcgtcggcgtttgatctgagggaaaggtgcccagcagacttattgtagagttttggaagctcgattttctgaaatttaaaaatttcgaaaattttcaaaatttttcgagctaggcctaaaaaacggtttttgggtttttgaattttaagaatttttaacgaattttcccagaaaaacgaagaccacttccaaaacatagtttttcgagctctatcgactggtatttttttcggaaaaatttcgattttttcccggaaatagaaaatttttttggcctcagcgggacatttgagtcccgggcccataactcgtcaggggttgattttagcgaaaaattgtcttagatcaaaattgtagagctttttaaactctatcgaacggtgtacttcatgttcggaaattttcaaaaattttcgagctaggccccctagaaattttcgaaaattttttttgggttgaaaatgggggtcaaaaatatttttctggggtattttggggtgctgaatacgaatatgacctttgttttttgtttcggaatttttggaattttttaaaaattctttattttttggcaattttttggccctcgggattttggcctaatatttgaaaattcataacaaatcgaagggttgatcaattttacaggaataaagccttaaaaatagagaaaaatcatagaattttatggggtttatttgggatttctatcccccaaaganaaaaagttattccagaatttctggaattttcgatttttcagaaaaaattcataactcggttctgaaagtcatactgtaaaagtaaaatactaaaaaaatccgcaattttttgctctatatataattttattttacattttatcacttttttaagaattttataaaaataaaagtgattttg

SEQ ID NO: 44461 - DNA, 1146 bp, Heterodera glycines
  misc_feature (66)..(66): n is a, c, g, or t
  misc_feature (97)..(97): n is a, c, g, or t
  misc_feature (1053)..(1053): n is a, c, g, or t
taattcatgccacaataaatcggccgcaatttttcgtttgtttttcattggcgaaaaggcggtcanaacgccaaggtaatggttgagcagccaattntcatttgaaaagactaatttttgtaaatgataggggagatattattatttattaattttgtacttttgaggcttaatttagattttaattggaattttatggatatatattttaatcatatttcatttttggattgttttttgcatattttatagtttttatcgtattaatgatttttgtccatgtaaattagtcactattaatatttttaaattaatttttcattttaattaattgtgattaattagttataaataaataatcattttacattttttattcatcagttttagttgcatttttggcctttcgcacagtttaagtatgccgtttaggtacagtaattgctcaagtttcgctaccgtaccgcgctgttcgcgtacgataattaaaaattcggcgttttcttcagtcccatcatttaaaagcgtgtcgattaattcaaaatgtttatttttcagcattttgcgttgctctctcacagtttttgccatttccgcaccataacattgccaattcgctggccatttctctttcgcgttaaacgttcggtccgtcaaatatttcaaatagtcaatcagcggacaaacgaaacgccaagtttcgtttttgccgtttttgaaatgggcgatgattcggaggatggcaattgtttcggccttcgctttggcacagtcgcgcattatttgcgaattttccaacgcgtcgttggccaaaatttgttctcgatattttatggactgagttaacaatttcaatgacagaatattttccgcggaaatcgcttctgccgaattgccattttgaagaatttttttgtacagcgaaaagatttcgttgtgctcaaaatttgctaaagaaaaattcattcatttttaaaattgccaattaacaaaccaaagtgactaaatgcgggaaaatctaacgcattttcattgaaaaattgaaggaattgnggaaattgttggaataaaaagcgcaaaacgaacgaatgaatctgctcgaatttcggggaattgagcagcgaccggcgcataatatcttttgct

SEQ ID NO: 44462 - DNA, 887 bp, Heterodera glycines
tttccgaaaatttctagggggcctagctcgaaaatttttgaaaatttccggccatataatacactattcgatagcattttaaaagctctacaattttgccctaaggcgttttttcgataaaatcaacccctaacgagttatggacccgggactcaaatgtcccgctcaggccaaattttttttctatttccgggaaaaaatcgaaatttttccgaaaaaaataccagtcgatagagctcgaaaaactgttgcttgaaagtggtctccgttttcccaggaaaattcgttaaaaaatcctaaaattcaaaaaccccaaaacctacttttaggcctaactcgaaaaattttgaaaattttcgaaattttaaaatttggaaaaatcgggcttttaaagctctacaataagtctgctggccaccctgcgctcagctcaaagcctaatgagttattcgcctggtactgaagtgggaaaaaaaaattaactgagtctccgtgtctgtacaggtccgggatttggtctgatcaaaaaataaaaaataccggattatagaggacacttctgcggagtgccctcacagcgggcactttttgattcgggttttagaaaaaaagttaggggccctaaactgcaagaaaaagtgagaaatcgcttctcgggactcagtcgtccgcgctgaatttttttctatagttttcccggattctcctcaaaaagttgtaagacccttccaccactttcagggcgctcccggccttcggccgggagattttgttttttgaaacgaaactcaaaacctatataacatatatataactagcgggtgcgtgaaccgtcggctctgggctggaaaaaagcgcttcgcgcttcttgagcttcgctacctaga

SEQ ID NO: 44463 - DNA, 1241 bp, Heterodera glycines
agcagaagcgtaccaaactttgcagggatactccccggttaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttataaggagtccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccatatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctcccccataggaagattgagtaccccagaacggacactgaaaaaat

SEQ ID NO: 44464 - DNA, 1120 bp, Heterodera glycines
tcgggggttggttttagccaaaaaatggccttagagcaaaattgtagagctttttaaatgctatcgaatggtgtactatatgtcgaaaaatttcaaaattttcgagctaggccccctagaaatttttgaaaatttttttgggtgaaagaatggagtgaaaaatatttttctggggtattttgaggtgctgagcacgaatatgacctttgtttttcgtttcataatttttagaattttttaaaaattcgaaatttttttcaatttttttgaccctcgggattttggggtaaattttgaaaattcatatctagcctaagggttgaccaattttacaggaataaagccttaaaaatagagaaaaatcaggagaattttatgggttttatttggattttctagcataaatatgaaaaaagttattccagaaattctggaaaaattcgaatttccagaaaaaaattcagaactcgcttctgaaaagtcattctgtaaaagtaaaatactacaaaaatccgcaattttatgctctattatataaattttatttggtatttttatcacttttttgagagatgttacaaaaataaaagtgattttgggattcgggaccataggggggtgaccaggatttttgggtggaaaattttttttcacaaaaatcttccaaaaacatgtctttaggggttatttgggccgctgatcacgaatacgtgatcagattttagtttagacatcgttaagacctcagaatccctgtgtgattggggattctgaggcatcattttgagtggggggaggggcgaagttcgaatccggacggtgtacattatttttctatgcatttttgcgttatttttaatgttttaattcatttaaaagagtgtttttttcttaataaaaataaaattttttaatttaaattaaattgtttttttgtgaaaaatgttttaaattaaaataataatttatttacttttattaaagaactcctgtattttttaaattagaatttgtaaaattaatttcaatttaaataaatattcaatccttgtacatttcaaactttctttttaattaataaaaggaataatttattttattttttaaaatttattaatta

SEQ ID NO: 44465 - DNA, 338 bp, Heterodera glycines
  misc_feature (187)..(187): n is a, c, g, or t
  misc_feature (189)..(189): n is a, c, g, or t
  misc_feature (193)..(193): n is a, c, g, or t
  misc_feature (195)..(195): n is a, c, g, or t
  misc_feature (205)..(206): n is a, c, g, or t
  misc_feature (222)..(222): n is a, c, g, or t
  misc_feature (224)..(225): n is a, c, g, or t
  misc_feature (234)..(234): n is a, c, g, or t
  misc_feature (241)..(241): n is a, c, g, or t
  misc_feature (248)..(248): n is a, c, g, or t
  misc_feature (260)..(263): n is a, c, g, or t
  misc_feature (270)..(273): n is a, c, g, or t
  misc_feature (277)..(280): n is a, c, g, or t
  misc_feature (289)..(289): n is a, c, g, or t
ttttgaaaaactttgaatttttgactttttgttcgagtttgggtccgggattcgaaattagttaaaatgaatgtcagattcgtgatcagcgacccagaaaaccccaaggaaaagcgttttacacacgacttttttaaaaattggggggggggggaacaaactgcactattaccttgtttaatttatntntttncncagcggcccnnttttgggctccccgtncnnttatgcttnttttttntttagtnatcagaaaggcnnnnctttgcnnnncttnnnnttttccggngctttttacgagcaaaaaaagaagagccgatctcgagttaaaaactaga

SEQ ID NO: 44466 - DNA, 1084 bp, Heterodera glycines
cgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgagacggagggctgtgcacaatcgccattttatttcacagaggatttttatatttagagggtatcccagaaaaatggctatctctttttttgagaaattttatacctcacaaaaacgcttgcgtatgagacggagggctgtgcacaatcgccattttatttcacagaggatttttatatttagagggtatcccagaaaaatgggtatctctttttttgataaattttatacacatacaaatgctctcgagcatgatagggagggcggtgcgcaatagtccgattatttttgagggaatttataactttatactctatcccagaaaaatggctatctctcgtttgaacaacgtctaaagcatccaagacctcctgcacagagtcgcggttcgagtcggcctgaaacaaaattgaaatgtccgcgcaaaaaaaaacagaaattccgggtgcaccccaaaatttagccgggacataatttcaccgaagaaattttttaaaaagtttttaaaatttcaagaaaaaatctaacaataagaaaaatttttatatgaaaattccagaaaagaaccattgacaaaatttttcctcaaattttcttgtaaaaaataagattttttgaaaatttcaaagtttaacggcaaaattcggtgaaattttttcccgtccctaaaattccatgatcttccaattcaaaaaacgaatttctaatcaattccaaagtaccttgaatgtagccgaaagtttcttccgaatgattttagactttttggtctgcggtaacggcgtgtcatccgaagagccgcacaaactgtccatgaag

SEQ ID NO: 44467 - DNA, 1048 bp, Heterodera glycines
  misc_feature (775)..(775): n is a, c, g, or t
  misc_feature (815)..(815): n is a, c, g, or t
  misc_feature (837)..(837): n is a, c, g, or t
  misc_feature (864)..(864): n is a, c, g, or t
  misc_feature (879)..(879): n is a, c, g, or t
  misc_feature (888)..(888): n is a, c, g, or t
  misc_feature (901)..(901): n is a, c, g, or t
attgaattgttgacgaagtgcatgcagcagcagtgaaagcactagtatgagtggacaattgacctggaccatcagcttgtttggacgtggaagagactgtgcaggcgtacgatgatgaagttgtgcttgcagcgtaatgctgctgctcgtcaatctccgcctgacgtattgtgctgttgctgccaccagcatggtccgctgcagctgaatttgttgcagcgtcttcgccgttcgtttgattgctcgacgtgccaaacatgctggagacgatcacgtcggctaacagctgtcgctcgtcctccgtcaactgcctctttgctgtcgttgttgttgatgttgtcgtgtacgtacgctgaagcggttgctgctgcggttgttgaagtttgtcatgcggcaaaattgcgtcaaaaaatgcctcggccgtttcgtcgcaacaaatatttgttgaggacgatgtgtcgcttttgcgctgcatgcggtcagacagtgtgatgtcactttccgttgttggcgttgtgctcttctcgctgttctcctcctgctccatttcgttggttgtggtcggttcggatgcaatttgttttgataaacttaaaattaaataaaaattaaaacaaaaaacaatataaaatgaaattctttttaaatatcaaaaaattttaaatatataaataaaggaattgtgaaatgttttgaaatttagtttgataatcaattaatgaaattttacacatgtttaatttaatttttaattattttttaaattattacttanatttttaattattttttaaattattaatttatttttttanattattaattagattttttaanttattttgttttcacccgaatgccctnggcgaagctttcgtncattgcctncacttcgcgctgncatttttccacctcttccgccgccgcttctcttccccgccgcttgtcgtgtagtcaaagggtgcacccatcgcgcggtcagaaacagcggcgacggatccggcgccgtcggcgtcagccgtgccagcatcaaatggacgccgttcaa

SEQ ID NO: 44468 - DNA, 1552 bp, Heterodera glycines
ctttggcatcactttgcccaacgaacattcgtttcggagcattcgcttcaaaaaagactaaaaaagtgaaatggcaatggaaaacggtacgggacaaaataattacattgaaaagggtcgaaaaaacaaaattcactgatttttgattctttgccattttcttttttgtttattaattattcatatatttagcaatttcgaggtatttacggagaatcagcgaaggtgcggatccgactttggtggacattgagagtttagacgaggaaagtggggacggggaggagcgggacgaagacggaccaatggtcggacaaacggtggccgcgtcgtgcgaagcattcgccaacagtcgaatgaattgtggtaagaacacagagatggatgaaggggtgttgtcagagagagtggcgagctcaaaagtacaaaacacagcagatagtcataaccacaaaaacaaacaggaattctcgcttttctatgacgaaatttttgttattttggggttcaattttcaactaatgataaaatgggtggtccagcggtaccgtcggaaagcgccgccggaaatttttttaggaaataaaaaaggttcacatttttttgaatttttaaaaatattataaataaagaaattttcgataattttttcgctgggttggggagcaaaaaaatttaatcagaaaaagaacaattaatgcgtgctatttgtgagcaccgtggcgcagtggaagcgtgctgggcccataacccagaggtcgatggatcgaaaccatccggtgctatcatttttttctttttttactgacaataattgttccattaccactaaaattattttattgtataatttaggaagacgagcaaaaccgaaaaggcaattcattacgccgaaagtacggcaagcagctccaaaaggggtgatactaaatgggtaattgttttggaatcattttaaatttattttgccagagtaaatttgtgtctgccattacccattcgcattggaagtgcaaattgtgcagtgccgacatttacgcggcggttattagtgccggcgttataaaacacttcaaaaaattccatcgttcatttttgtccactgttcaatttgagctttgcaaagtaaacattttattggacacataaccgtaaaattctactcgaaaattaaggcgagactcgagaaaataagcgacggaaaaatggaatttgttggagaaaagctaatcgaatgttcaatttgcagccaaagttttcccgtgacacctccgttcaacatttgtagagccatcagacacatcaaactaaagcatccggaagtgatgccggaacacagaggcggacagagtgcccgggtgggtgggaaaggtgcaatacgtttccatccctcttcatcgtattcaaactccgcccgaaaaaattaaaaaatttttttaatttaatgagattttctagtaacaattataaattttgttttttaggatggatttcaatgccaagagaagcagcagaacggtaatggaacagaagggccatcgaagggagaaga

SEQ ID NO: 44469 - DNA, 1393 bp, Heterodera glycines
  misc_feature (50)..(50): n is a, c, g, or t
  misc_feature (1358)..(1359): n is a, c, g, or t
ccggacccgaattcgaacaaaaagtcgaaaattttctcatctctcacttntggttccaaaattgaccaaaaaatctaaatttggtcataaaccattggaatatcaaagaatgatcattctatacagctacgaacataaaagtgaatttcctgggaatgcaaagaaaatggtcaataaatgaattgtttcattctttcaggatttctctaatatggggtgggcgataacaatttacattttaaaaagtaaatttttaaattttgctttgaattggcatgtcgattcttttttttgcttctcttcccactctcatagctatggtcatgaccatggtcatttttgtcaaaatctttataaaagaaattttcgatccgtcatttgttgattctatcttttcacacacaatatttcatttttatatttacaaaccgatttttttttttgccttttttttcgtttgcctcagtgaaacaataaatttttgtttcgaaattccaagttcatacataaaaatataccaaattttatcgaccctcgacccttataaattatggccaacgtgcgcaagacgggaatcatttgcaccataagtattgaagaaaatgaatattcactaaggctggccaagaactgttttcccttttcagggccgcccgtttgtcgttctgtggaaatgcttgtccaaatgatcgaaaatggaatggacgtcgcccggatcaacttcagtcaagaggaccaagaagtgagttttttcacttctttgaatttttgagggccatcttttagtaaaataataaaattgcagtatcaccgtgttaccatcaaacatgtacgtgaagcagctatcaaatgcgacggaggacgtgaacaagcgcatcgcgtacggcatcggagtgggcaaggagcgcgggttcatccacaacggcgactttgtggtgattgtcaccggatggcaagcgggtcagtgtggttgggaagtgacgcatttactcattcatcccccgtctttgcctccccaaaatttcaaaaaatagagaattttgatcattgattgggcatggcctaattagagcattccttgcttatctttttgtttaattgacaatgagtatcccaccacatgtaaatgattgattgccccatttgttctcaggtgccggctccacaaacacaatccgtttgcagaaagtcgaataacagagggacgtgtccaatgagcttttgaagacttcgcgtgaccgatgaaaactttttttaggaatttacgcttttgtgacttttgttttcatatttttgttgactcggtgtttatgctcaaataaagaaccttaggctctttttattggccagcttatgannaatgacctgatcagcgaagggccttgcgatcggc

SEQ ID NO: 44470 - DNA, 1455 bp, Heterodera glycines
gtatatgcagcgagcaataaaatattttattgactattatgcgctaaatgatataactcagctgtacgctctcctaaaatccgaaatagactctaaaccgtccaactattatccaaatcctttgcaatcagttccttgtgtacaccttgtgaacgaagagtacgaaaatcagcctgttgttgtagaaggaacacttgatctgataggcgatctgttcttttcaacatgttatcccaagaagagacagaggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacgacataacagaaggagcttggtgaaagagctatgcttgtttaataaatgtcgaccggaatatctcgcgatgatgcttcgaagaaggaagaaggaaaatatcaaatttataggcgatcggaaaatcgaaactgtacatcttcgacagaatttacaaatttatccggaatcatttactctttttggtgctaatcgtatgtacgcctatcgtggtatgcttggtgtcacggtagagcaacatttatacgctaagcatcgtgtccgtctaaaatttcccaacctcccatgtgttgtacaagatggcggcaacggccatcaaagttatttcccacttgaacttttgaaaatatcttcgttagctatgcaagatgaaactgcttaattatttgttgtatttttttaatggctgcaattataaagaaattaaatagtaaactgaaaattttatacattcaaaaagatcattcatatccaaacggtaaaacctcaagggtttgattaataatgcctttctgacagacaggtaaatatatattattttgtttcctagttataattcgatattccgtcgtctgtattactatatgaaggtcgcattatcatgtcccctctttacgtagggatctcttgcgttcaaaatgatcaatctgaagctcctgagaattgttgacgttcgatatgtaatgcctttgaatctattcgcacaaaatttgttctgcttttgtgtgcttatgccccattctcattacatatgtcttcgctccaccacatgcaaaagttaaatgtcgtaatcgggtttcccgctcaaaatccaatctcgcccggcgactggacaaggtctcgtatattccgaacaattacactgtctgtgtcagtgtatagtaactcggtgtccggtgtattatcacattgcagcatatagtcaagcagtttcagcatagctagattcggtgtccaaagccttaggccaatattgcttgacgtaagttatacgacgaag

SEQ ID NO: 44471 - DNA, 876 bp, Heterodera glycines
tacatcttaattaccctcattaattaccccctcccctcctaattagacaatgtctttctccccccgggcgtccgctccttccgttctttgttggtcaaccaaaggctcagttccctttacgtcggctcccgtgaccatttcttccgtttgtggctgttcaatgtcaacgacacttcctccgccgctttggtccctccctttaaaacgtttctctttttgaacttttttcacagtttgcccatcggtcgctcaatgtgcgggcggaagagcgcgaggaatgccttcggttgggcaacagcgaaagggaatgcgacttttgggtgaattcggcacaaaatcacccaaaatgctgccaacaaaagggtttttaggtgagaaacatttttgtgcgcagcgacaacaatttgctggtagaaaaaacataaaaatgaaggcaatggtcaagaattggtgtttcgacgaaaaaaaatgttaaaaatttcggaggtattttttctaggcttaaaaaatgcgctgatcacgaatctgaactcagattttgaaaatcattgatttttatctaggatttttcatcaactacttgatttttttccaaaattttaagaaaattagtcgggcttaaaagtcacacacagatgttgtagagcctaaaaagagctttcgaatgagctattgaatgtatggaaaagtcaagttttcaattttttacgattttttgaaatttaattattaatcgagacgatggtctggggttcgagtccgcttggctgcggtttattttttttatgacacgatgaaaaaatcttagataaaatgaaggttcatgtataatcatagctcagactcgtgatgagaatatttttaaccccaaattca

SEQ ID NO: 44472 - DNA, 1059 bp, Heterodera glycines
  misc_feature (13)..(13): n is a, c, g, or t
atattggtaatantttcggggattaatttttcttacatttaattggcatcctaataattaattgttctccaaatgtttttaggctgctcgggacgctcctatgaagtgcggcagtgcgccgccgcttcgtcctcccactgtccgacgacgcgtccgcccgtgccgccctcgcgccggaacaccggcgacactgccgccgctgctccgccgatggcacaatcgaacggcatacttcgcctacggcatttgttgtggaggagaagcaaataaaaagggagaggagaagcattttagcgatgccatttttcgatttgattttaaatttgttggaacatttgccgatgaaaaggccacacattttgaataataggtgcacaccctctttacattcagatgtattttatatattgccgccaatttctattatttatttttatttacatattaaaaatttttgcgaaaattaaattaaatatgtattctggaagaggtaatttggatttgtttttaaaaattttaaatttgagttaactgttttagggtaagattttttaaaatcacaatatcttaaaaaatgcatgcttgcgtccatgaaatggttagattcgagtgaattttcttgatttagccgagccatccccaattttacctaaatgccgttcgaatggtcaatgtttttctgtgccaaataaattaaaagttaaattttaatttttaaattgtttattccatcggtcaaatcagcgcatttacaatcatgtgaatgaatttgaaatgattttagcattcacaatgagaaatgcgctgatcaaaacggcggagaacagaagcaaaattaattaattaccaaaagaatttgaaggaatacctaaaaatgccaaaggcaattggacttttagagccaaattcgaattgtgccgagataatgaagacgctaattatgcaattagcaattccatcggttaagaccagcgcattttcatcatgtgaatgaatctgatcattttcacattcacaatgagaaatgtgctggtccgaacgttggagaagcagcagaaa

SEQ ID NO: 44473 - DNA, 927 bp, Heterodera glycines
  misc_feature (882)..(882): n is a, c, g, or t
  misc_feature (894)..(894): n is a, c, g, or t
tttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctcgaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttctttgggaaaaatttggaaaattggctatctctttttctgctcaacagtaataggaattccaaccgcattctcagaataattacgccgatactaatttgtctggaaattgttnctctgcgcgttngttgggaaaaatttgaaattggctatctctttt

SEQ ID NO: 44474 - DNA, 866 bp, Heterodera glycines
tttaccattgctatttgcaaatagttatccaaattttttttagaatcaaatcacaataattttcaataaatgacttcgcagaaaccggcggaagacgatccgattggtgctgaagaaacagttacgacagctgcagattgtgtcaatgaactgctggaaacaacagaaattcaagcggaagttgatgaattggtaaagagtgtcgttgaatttgtttcggaagcggcctcagcagcggcggatgatgttgaccatcagcagcagcggaatgcggcggatgagtcggcaaagagtcgttttggcatttcgtcacatgaaattgccattccctgcaaggaattcgaccgtctgttgcgtaaaatcggtttaaaatcgggggcaaagaggcaatgccctgggaagaggatgtgccctccgcgcaaagtgaaggcatcggcatcggacggagtcagtgcgaaaatcccaaaactgagtgagaatggcacagctggtgggaagcagaagaagaagaaaatgcaaaacattgtggaatttgaccaaggttatttggggactcacgatcagaattaaaaaaggaaacgagcagggattttgatatcatattcttgtctggcataaattccgaatttaacgaaattactgatgattgaaaatattccttattataagggtaaatcgctaatttgttttgttctttaagtgatggcttcccttttgggcaacttcgaagatgacccaatctttctgaagtgcaaagaagttcagggaatgaccaaagacttggctcaactcacctttcaaatcaaccaatttttgtgccatttcattacgttcatacccgtcgagatgttgggcaacatcaaaaa

SEQ ID NO: 44475 - DNA, 1100 bp, Heterodera glycines
  misc_feature (1050)..(1050): n is a, c, g, or t
aaaaacttttggttaatgaattattttttgaagggggtcaacccccttattagtgttttgtgttgcggggaaccgcaggcaaatggttggctttaattttccaggaaattgaatggccattagtggttgttaaaaacttttgggttaaggatttttttttggaaggaatcaaaccccctttttattgttttgtgttgcggggaccggcaggcaaatgatggcttttaatttgcaagaaattagattggcaataagtggttgtaaaaaacttttgggtaaggaattattttttgaagtgagtcaaacaccctattagtgctttgctgtgccgagaaccggcaggcaatggatagctttaaatctgcaagaaattagattggcaataagtggttgtaaaaaacttttgggtaaggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttaaatctgcaagaaattagattggcaataagtggttgtaaaaaacttttgggtgatgaattattttttgaagtgagtcaaacaccgtattagtgctttgctgtgccgagaaccggcaggcaatggatagctttaaatctgcaagaaattatattggcaataaagtggtgtaaaaaacttttgggtaatgaattatttttttgagtgagtcaaacaccgtattagtgctttgctgtgccgagaacccggcaggcaatgggatgggctttaaatctgcaaagaaattaatttggcaataagtgggtgtaaaaaaacttgtgtaaggaatttattttttgaagtgaatcgaacaccctattagtgctttgctgtgccgagaaccggcagcaatggatggcttcaatctgcaagaaatagattggcatatgtgngtgtaaaaacttttggtatggattatttttgaagtgagtcaacaccctat

SEQ ID NO: 44476 - DNA, 1071 bp, Heterodera glycines
  misc_feature (29)..(29): n is a, c, g, or t
  misc_feature (52)..(52): n is a, c, g, or t
  misc_feature (71)..(71): n is a, c, g, or t
tcaaagggaaaatggcttaattcaggccncaatgtgcgcctgaatcgctatntagcttggcactttcgaantattacatataaattagccctctcaaattttccttcgggcctcagaaaatggctatctctttttcggccaatttcgtaccgatcaaagggaaaattgcttaattcaggccccaatgtgcgcctgaatcgctaattagcttggcactttcgaatattacatataaattagccctctcaaattttccttcgggcctcagaaaatggctatctctttttcggtcaatttagtaccgatcaaagggaaaatggcttaattcaggccccaatgtgtgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaatttagtaccgatcaaag

SEQ ID NO: 44477 - DNA, 1569 bp, Heterodera glycines
  misc_feature (1331)..(1331): n is a, c, g, or t
aaaaaaaattttggatataaaattttgggccatactttaattctaactttgattagaattatgagatggcccttcgctgcgctttgctcatcaaacaaaaacggttaaaaaccgttatgagtccattctgaacatggccgaaattcactttcaaatggcaaaagcattcatacaaaaccgacaagaggaagaggtaaccgaacgaacagtcattttctgaagtcaaagcaaatttcaaatttaaacccttaggcattgcgttgcctcgaggaagtgccacaaacggagataacgcccaaaatattgttcacaatggcacgactcagccacaatttgtccattgcactgctgcagagcggcagaacacagctgagcaaaaggaacaacaacgacggaccaagccaacggaccatcaaacacacaaagtaacgcaaaacggggggggggtggttaaggacttgagaaagcgggaaggtcaacggcttgaggggggaacggtaacgcccttcttttaccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgagctataattagagcaatacggtattccctcaccccacccgaatttttttaaagaatatttcaagaccaatttcttttagtttaaagtttttttgtttttgttttttctcaaatgtttatgatgaattacttagttttttcaaatttatccaaacaaaatcgctgtgaaaattttctaaaaatttttttgaaaaattcctaattgtggatagggcttgtctaaatcttctgtgtaatgttaagaaaactatcgtttcagggcgctgatcaaagaagtgcctgaagcgatattttgccgaagttttctcctctccaatggctcgctgaaaattgcttcttcaattctgaacgcaaaaaaggccgtttctgcttcttctgatgatgatccgtccttcatttcggagttcgttttgtgcggcgaggcgccgcgcctttgggcaaaagtgaaacaattggagggccaaaaacgctttttggaggcggcgcaacttttggacggtgtcgaagtggagaatttgcggttgatccatcaattcttggccaatcaaatgacagattctctcagacttctactggaccaagcccgtctctaccgaattgcgggaaacacaaaaaggcgttgagctgttaccaacgagcgcacactttggactgcacanatgccgaaggaatggacgcatttgcggcacttctcggcacagttagcgaaaggtaaggagacgaatcgaaaaaaggttttggacagcacaacagctcacgaacggagagcagcgggagttgggacggatggcacacgcatggcacagcacacccgcgcggggcgagccgttcctttggtttttggatgggcggccgacagtgcatcggacgcaggaaggcgaagcattcgcgcaaagg

SEQ ID NO: 44478 - DNA, 1047 bp, Heterodera glycines
tttttgagagaaattttgcatcgaacaaatgctctgcagcatgagtagaggggcggagagcaatggccatttattgttccgagaatttttaaatttcacgattaggccagaaaagtggctcctcttttttgagagaaattttgcatcgaacaaatgctctgcagcatgagtagaggggcggagagcaatggccattttattgttccgaaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagatttttaaatttcacgattaggccagaaaagtggctcctcttttttgagagaattttgcatcaaacaaatgctctgcagcatg

SEQ ID NO: 44479 - DNA, 929 bp, Heterodera glycines
ttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgctaaattttttgcagacaccaccattttgcacttaaaaaaatttctaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgtggtgtgcct

SEQ ID NO: 44480 - DNA, 355 bp, Heterodera glycines
cttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgtggtgggccttcgccgcaggca

SEQ ID NO: 44481 - DNA, 365 bp, Heterodera glycines
atcacaaataaaactacttagtcactcaatttttatattttattttttttttgtttttttttttttgacagttcaacccataaatagtggtccacaaaagtcggtccgcaaatgtcggtccacaaaagtcggtccgcaaatgtccgtccgcaaaagtcggtccgcaaatgtcgcactacgattttatgggattttattcaggggttgcgccgtaagggggcggctgtataaaaggtgggacggggaagggtcgttggtgaagaggaaaagagggaaatgcctgaaaatattgactttttctctacaaatttcataaaattttaaagtttttatcggcggcctctgccggcaccgccgcccccccc

SEQ ID NO: 44482 - DNA, 934 bp, Heterodera glycines
ttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgcgcttgagcatgatacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgctcgagcatgagacggagggctgtgcacaatcgccattttatttttgagggaatttttatatttagaggttatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcaccaaagcgcttacgtatgagacggagggctgtgcacaatcgccattttatttcacagaggatttttatatttagaggttatccccagaaaaatg

SEQ ID NO: 44483 - DNA, 903 bp, Heterodera glycines
  misc_feature (87)..(87): n is a, c, g, or t
  misc_feature (118)..(118): n is a, c, g, or t
tttcgaatattacatataaattagccctctcaaatttcctttcgggcctcagaaaatagctatctctttttcggccaattttgtacncatcaaagggaaaatggcttaattcaggccncaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatagctatctctttttcggccaattttgtacccatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcataattcaggccccaatgtgcgcctgaatcgctaattagcttggcactttcgaatattacatataaattagccctctcaaattttccttcgggcctcagaaaatggctatctctttttcggcaattttgtaccgatcaaagggaaaatggcttaattcaggccccaatgtgcgcctgaatcgctaattagcttggcactttcgaatattacatataaattagccctctcaaattttccttctggcctcaaaaaatggctatctctttttcggccaattttgtaccgatcaaagggaaaatggcttaattcaggccccaatgtgcgcatgaatcgctaattag

SEQ ID NO: 44484 - DNA, 264 bp, Heterodera glycines
ccgattttataatggttggcgtcataaaaaaaatcgtcattgaataaaggaagaaaaatgtttttttttatcttaataaaattttaggctaaatttttgcagaaaaatagaaaaaagataaagccaccgaagaattccaaaaatgcttaatttgtttaatattgaatcattattttttttttaatttggcgttttaataaaaagccaatctttaaaactcgacccattctccccaccacccgcccccccccctacgtttgcggg

SEQ ID NO: 44485 - DNA, 931 bp, Heterodera glycines
cagaaaaatggctatcttttttaggacaattttctatctcgtaaccccgatgctaatccgttcctgagagctctttcaaaatttttcccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgaggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgt

SEQ ID NO: 44486 - DNA, 785 bp, Heterodera glycines
gcaaattccaaatcaaaatgtcaagcgatgtgaagccaatttttgttcacatatttacacttaataaacaaaaagtaatcttaatgaattgtcaaaataataaattcaaatagtattttctgaaatttttgggaccgattcttagaggtgcatttttcgtttttagtgcatccgtaaaaacttaaaaatctcagccgggattttgcggggtcctagcatttcatagaaattgcgggattaaccccgcgggatcccctcccacaaaaattatgagttacaatccttcaacgggatccgaactgctagataggggtcgcacctgttatgatttatcagaaatcttctaatttggatttatcataaatagggatacgatttttaggtgctaaaaactgctaaaatagttaggttttaggttctaaaaaaccaccaaaataggtgctaaaaatgggaaattaggtgccaaaaatttcggaatttatgggtgtaaaatcgaaaattttttcaaaaagcaaaaatattatgccaaatcataaatgagatacataattttaaaaatcaaaaaaatatataaatttttgagatgattttttgagaataataatttgttaaatgccgtgaaaaaataaaaaaatttcgtaaattttttttatttctgaaaataaagaatggacactgaaaaaaaataaataaaactttgtttttgggttttaaggcctaatatttaattttcactggtcaaaaagtgtaatgctggtctttaaagggatcaaagtagagttggt

SEQ ID NO: 44487 - DNA, 963 bp, Heterodera glycines
ggggtttgacaagtttattggggaaaaaagactttacaaaattaatacccgtggaagaaggggagtgggaaacatgatttcaaaaattttcaatttttttctagtctaatctactcaaagcgggtcaggaattcaataaaaataccattcacggtgcgaaaaatggggttgacaagtttattgggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagacttacaaaataatacccctgggagaagggagtgggaaacatgatttcaaaattttcaatgttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggaacagaattcaataaaaataacattcacggtgcgaaaaatggg

SEQ ID NO: 44488 - DNA, 1433 bp, Heterodera glycines
  misc_feature (93)..(93): n is a, c, g, or t
  misc_feature (1325)..(1325): n is a, c, g, or t
ttcaaaatttggcgaaaaaatacattttcaaatccaattttgatttattattcaaaatgagatttgagatccggtgcgggagaggcggcggcncaattatcattaattgtggcggcggtggcggaggtcgtgcctatttaaattttaaaattcaaattttattttatttttatctatttaggaggctgtagtggtgaggttagcggttgtaagtacattgaaaaataatattttttcaaagttttcccgatttcaatccattttttggttttcgggtcaccctgaaggagtgatacgatcatggtggtgcaattgactttttgatcactaaccaatgttatttattcttaatcttagtcataaaaagttgtaccggatgtttttttcgatacaaaaaattgaatttttgttcgagttcctgtttgtaattagtaattagtcaaaaattgattcaggtttgtaattagcgaccctgaatgttctctttaacaattttcacaatttattatcacaaaaaattcttgcaaaccaaaagggtccctcctggtattttaataaattaaaaaaggggaactttgtaagtaataccaattgttttcccctgttttcaacactttcttagcgaaggataataaattaccactgggtcattaaagaggtcattgtgtttttttaataaaagggcggcgcaaaagttttttttttgttcccgggaaatgacccaattcctttttcgacagagagaatttgcaagcaaaaattcacttacgttaaatgataaaacaataaaattttcttttttattattagaaatgattttcaaactatttatggcatttttatttatttttatgctaaattgcttttactgcgagaagctaacaacatttgcaacacaaaaagcggaaagaaaattgaacacacgccgacataatgtgtatggaaaggcaaattacaaataaattattatgggaaacaaaaaaattttaaaaaattatggaaaattttttatatttcataacttgattgattctcaagccagaattaatgaaccttatttcatttagattttaagcaccaaatcaaaaatgggagacaaaaatatgcactagtttttctttttcttatctcaatgaaataagttcgtgataactttttttcctgagacttcacactttcgtcattgattgtacgcgtaaattagactaattaattgtgcattaattaggccatcggtttcacttttttgacaccagaatcaaccgtcatcgtccgcaacacacgcaaaagcgtttgatcactgcgccgatcagaaacaacaatgngagcagctccaacaaaaatgtcatgctcaaaacaaccaacaaaacacataacaagcagttcgtggttattctcccacaccgcccccggtcaaaatccccgttccaatt

SEQ ID NO: 44489 - DNA, 982 bp, Heterodera glycines
tttgaaaaaatgggtcctaatgtgagtaactttatactattcatactacttaagccctaacatttttgaatcggattacgcattagaacagatatccgaagttttctgaattttataactgattgtttgaaacttttgttcaaattacattaaaaaaaatcatattcaattttgaattaaatctttaatttgataacttatatttctatttttttaaattgaaattattttaattctaaatatattttttctggaattgaaaacctttttgtttgaaaagaatttatgcaaaaagaatgaatgtcaaaaaaatctctcttttgaatttaaaaatgcttctttttctttaatttctgtttttagttgtgcgattccaagcccaaaaaattgtcgtcaaaaggagaatcggtaagcgataaagcatgctttgactctgaaatgtctaaatttatgtttccattaattttaattaagtattcatattcagaatcgtttaaattttaccctttttaaattgctgcttccatttgtaaatgtaattgtaatttacttttaatcgttttgctaattgagcatttgtcaaatttggctgcttctctttttccttgttaaatgttctaataatttccatctttttttctttcgtgtaatgagtttttgctaaaggaacaatatgaaaattaaaaaatttggcgtttttcacagagctaattattttgagggttttcttcattaaaacggtcagcaggctaatgataagcataaaatattttaattgattttcagtgaaaacctataaaataatttaaataacaaaaaacaattcttcaaactgttacggacatttggacagaaccggacaattttgtccaaatcactttactgtcaaatgacatcactgtccaaatgtccgggagcccttcaacatcccgcattttgtgcatttaattttgaatccgacttttaaactcgctttccgtgc

SEQ ID NO: 44490 - DNA, 1542 bp, Heterodera glycines
cgacgaatcggcgtcctccaacacatggttgcgaaatctcccaagcactctaaaaaatgaaaagaaaaaaaagaaagtgttaagaaatagtcgagaaaaacactcgacaacgaaaaacattttacaaatttctcacaatttccgtgttgttcagctctgacttaacagcacttcgctgatccaatgatactttcagccgataaaattccacagcaatttccgcgataactctaaatatgaaaggcgtttgaatttaatttacttaaatattttttggcatcctcgaatttgcaaacaattaagtacaataaaattaaaacaagaacaaaaacaatattaaaaaaagaaaataaaaacaaaaaaataagaaaaaacaataaaacgaaagtttaaaaagaaaggaaaaaatggcactttcctgttttgagaccacaccaaataattttataagtcaaataaattataaaaaaacacctcctaatttggaatttctaaaaaagaaaatagaacttaaatcaaatttttaaaatccaaccccccccccccccccccaaagccaagggttttccgcccttgttatagacctcagcaaaagttcgagctgattggaccagagcaacatcagatcccgaatgggactaggccaaatgtcgggcagacttttgagcataagaacagccaaacccgaagaaagtttgttaatgacagaatgagacagagaacccgcaccaacggtcaaagtttggatgtaaaaatccttcaaggcggaaatcttgaaattaaattttagctttttatattcaaataaaattcgcacattttcgacatcttctacaacaatatcgaagtgatgactgatggtattgtgaaggagtttagcaccataaaattgaacattggttggatttggtgcggtgacgagggacactaaattggggataaataaaaatagaggaaacatttaatacagccgtacttgcaacattccaagaatatggagctgattgggaagataaaaagccgatattatattatacaccgaacacttaaaaaaaactaactttccaaaaattggtccaatattttttgcaattccatgcgtctaatttcgctggtggcattgtaaaactcggtgacatttcgggccaaaagttcgctatcaatatttatcatttttgcgatttttgcattgaaaatgggaaaattcaaaacgctttaaatgtatttaattagaatttttgttggcgttatgtcctgaaaatataattcaattgcaattgtagtaccaatcgataaatcgcttgggcaccgcttcgcggcgccaaccgctctgttttattttaaaaataaattaaaatcttgataaaatttaacgctttaatttattttcttcccaatatcatttctcttctccttttctcctctcactacttctctctttctgttccattcactttccccccctctccctccctattcttcctcctgctcctctctctctctctctctctctctctctctctctctctctctctctctctc

SEQ ID NO: 44491 - DNA, 1097 bp, Heterodera glycines
  misc_feature (47)..(47): n is a, c, g, or t
  misc_feature (80)..(80): n is a, c, g, or t
  misc_feature (130)..(130): n is a, c, g, or t
aaaatgggaaagaaaaagagaaagaaaatttggaagaaaaaagaganataattcaaaaatattataaaataaaagaaaanataaagggaaaaggaagaaaatattcacaaaaagaatggagtaaaatacntcaaaaatagcgaaaaaattggggacaaatcgaatgaaaatttataaatggattaaagaatttggtcttcaaaaacaaacacagaaaagctacaaatcaaaaactgatgaagaaaaaatagaaattgttcaaaaattcattgaaatgtcaaatgaatttaaacgaaaaagaaaatattcaagaaaagaatggaaacaaaattatgccgaaatttgtaagaaaattggtgttagccatggaacaattaataaatggaagaaacaatttggcattcgctgtaaaagaataacggagaatggaaaaatggaaaaaataaaaatttattggcaaataaaaaaagcaaatcaaaaaatgagtgatgaaacaattgcaaaaacaatggaaataaatcgaaatatttttttaaaatggaaaaaataatttggggaaaaaattttggaggattgaagaattaacgatcggaagaaatcaaataggaaaaacaaatgaaatagtgaagcataataattattttttattcgtaagtgattttattttaacatctataataaaccttggttttatttaaaaaaaaattgtcgcaagtttagataactaatcatttagataaagtaattgaggctttggaaaaaagatcaaaaataaatggattagaaattctactgaaaaatgttttgttctttatttagggaaaaataacaagaaaaaagaatattttattaactcaaaaaagatttcataatcggataatgttcgagacttgggcattataattgactcaaaacttaatttctcaaaacatattaataaaattgtacgaaacgcatatcttagaattttccaaattttgagagtgttgaaaagcagggagagaaataaaaactctaacagcagcctataaaactttcgtaaggccccaattagaatatataacggaagtttggaaccctaatcttaaaaatgacat

SEQ ID NO: 44492 - DNA, 1395 bp, Heterodera glycines
aatagatattccagaaaaatggctatctcttctttcgagaaattttctatgcagcacacgctctcgaacatgaaacgaagtgcggtgctccatgcccattttatcgttcaaataatttttatatataatagatattccagaaaaatgcctatctctttttgtgagaaattttctatgcaacacacgctctcgaacatgaaacgaagtgcggtgcgccatggccattttatttttcaaataattttctatatttaatagatattccagaaaaatggctatctcttttttggagaaatgttctatgcgcccatcgctctcgtgcaagaagcgaagtgcggcgcgacatgcccattttattaatcaaataatttttatatttaatagctcttaagggggatacaaacgccaatgagtcccgaaaacttcaaaaagggtctttcataaacttatccttaaaatttctctgtactgcctcaaaattatttataaaatgaaaagtgaccatttttcccactaattgaattctatttttcagctcattttatgccaaaataaaggaaaaagtagaaaaatttaaaaaatccgattctttcaaatgtaaggaaaacatattaaaagaaaaatgacatcacaaaataggttttaaggaaatctaaagaattgtaaaaataaaaaccatttttttatatctcttaatgatttttttcgaaattttctttcgatttcgaaaaaaataattcattttccacccaaactttgaatcgaaataatatttactgttaataggaaggcaaattccaacaaatctttgttgcaccaaattttcagaatatcatgaagtacttcaccgtaacgtgtccaccataaatcagtaccaacatcgggcactttataattttcttctcttaatttgtatttttaatttaaaattgtttttaaaaataaaatcaatatttgttgttagaatgattaaataaatactaaaaataaatttttaatctatactttagtcataggaaatcatatggaaaattaaatctcggttcttacccccttttttgtgatccccagacaaaattttttaattagcgttttatatgaatgatcatcaccagacgaaaattcaaaaaaatgattttatcttttttaataaatatttaattcaaaaaaaatttaaatcaactcttttttgagttataaaatgacctgatcgagctggacaaaattctcatattccttgctagttgtttcttcaaattttccaggcttttcaacttttaatggattggctctgattaaaaaaccgcgataaaactcggcaatatttccgactttcttttggagggctttcttaacttaatttattagatttttcatttattttagacttctaga

SEQ ID NO: 44493 - DNA, 1064 bp, Heterodera glycines
tttcgggtccgtgttgactcgagctgggggtcggtgtcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtggg

SEQ ID NO: 44494 - DNA, 1519 bp, Heterodera glycines
aaagaaagtttttttttgtggtttttttttacgggaaattaggaaacaaggatttgttctggtttggttcgactcggataaaatttccttagggacagggaagattcgagaaaattggctttggaggccttaagagtttgatagaaccaagttagttagaaataccaactttactaaaaaaccaaagcaagaataaatgtgaaaaaaacaaggaaaatgatcaggtgaaatgaacacaaaagatcggtttgatcgttttgaaggcggtagagagaaaaagcgatgaggccggtgaaggtgaagagcatcgaagaccgtccattcttttataggctcttcggtccacgtgggcggtgcagggggcggttccgatgaggcggcaaaatgggatatatgcgggattaaggggattttagggaatggggaaattggcccgatgggaaaaatttaaattggaaaggctgggaaaagggcttatgagagaagaagggataaaaaattttgaatttaagcctggagaggaaaaaggaatttttaagaaaaatttatgatgatcaacgatgaaaattaacaattctgtcagtgacagcgacagagatccccgccgaggaggaaattcaatcatccttctgtccgttttccttttcgacttccccctcctcctggtccgattctgcttcttcttcctcctcttcgtcatcaccgtttagcaaaggcggagggatggtgttcttcttcacatgggcgaagaagcgagagaactgaccagcgaagtgcgcgaattgaccagtgaagttgtgcacttcacccaacaactcggtcaggatttgttcgactcgcggagtcggagcgcgggctgggacagccttggcacccggactggtgggcatttgtggcgtttgccggctgttgaccgcagttgcggttgttgcggcggtaaggagccgcgcctcggcgctagggaaaggaaaaatgtttggaaaaagtgggtatggaaagaaaaaaggtggaggaaaaaatggttataagcgggagaaaaatttggtaatgagggaggggggtacaagcaacctgttgctgttgattgccattggcattttgttcaacattgggacggaccggacgaggaacgtgacccccaccggacggctgttgcatcggaggagcggcattaggtggcaccaccatttgcatcaacggctgtgccggctggtaagcctgtccattcgccgccgaatgaaaaggagaactggttggaaatgaaatgtgggtggaaaagccttgcttttatggcgccgtttggctccaccttttgatcattggtgatcagaaatgtgcggattatgtgggtatttgggaaaagttaatatacaagggaaaaatttacatatacacaaagtctcgcctcgctctccattcccacgactaatgccgaaagtcggcaattctacagttctgaggctgtattctgtcacggcggatcagtaagtgccgcagccatccacgtctccatagctgc

SEQ ID NO: 44495 - DNA, 1051 bp, Heterodera glycines
aagttttgtacaatttctgttaataaattgaactgaaattttaaaaaattccccggcggcgcctatcggcaccgccggacccttaaaaatccctatttttcttgcaaaatttgctcaaaatcgcaaaattttgtaattttttggacaaaatctgttaacaaaattttcccggcggcgcctatcggcaccgccggaccctaaaaatccctatttttcttgcaaaatttgctcaaaatcgcaaaattttgtaattttttggacaaaatctgttaacaaaattttcccggcggcgcctatcggcaccgccgtaccctcctccaagttcccaaaaagtttttgaaaaaatcgcgctgtataaaacgtgtaaaatagtcactccttttcccaaaaatgttctaaaataatgaaaaatgacaaaaaaaaaatttgataaaatattgaataattttttcaagcgtatactaaaaacatttgtgaaataccttttacttggttaagaattaaaaaatttagcctattaaaatatttagaaattttttattatattgtatattttttaaaaatttccgatttccgacgtttttgggatcggaattccgatttccgacttccgaaaatttttggggcctcggaatgccatccctgatagggaccggcggaccccctgttcctagttttttgaaaaattgcaccgcaaaaaagtggttttgaaaagaaaaaatagtcaaatttatgaaccgttaataatttgatttccgatcaactttttaccgtcggatccaatcgaaaaatcttagtcgacccatcaaccccttttaatgcatcccgccagcccttaaaaatttatttttcagcattttttgatttttggaaattttttgaatttaattgaaattttttcgaattttccaaaatcccgcaatcccgcgcgggatcccgcaaattttaaatgcgggatttgcgggattaatcccgcgggatcccgtcccgcaaagaattttcagtaccaatcccgcagcgggatccgcaaatttgaaatttccgggctcta

SEQ ID NO: 44496 - DNA, 1089 bp, Heterodera glycines
  misc_feature (12)..(12): n is a, c, g, or t
tttaagtgagtntaagctctaaaaatagagaaaaataaggagaattttatggactttatttggaatttctatctaaaaaaggaaaaaagttattccagaatttctggaaaaattcgaattttcagaaaaaatttcataactcggttctgaaaagtcattttggaaaaataaaatattctaaaaatccgcattttttttctctattttataaattttatttcacatttttatcgcatttttaaaaaaagatacaaaaataaaagtgatttttggattcgggaccaaaggggggagcacatggtttttgattgaaaaaattttttcaccaaaatattccaaaaatatgattttaggggttatttgggccgctgatcacgaatacgtgatcagattttacttttgacatcgttaaggcctcagaatccctgtgtgattggggattctgagacatcattttgagggggggggggcaggttcggatccagacggtgtacattaatttactatgcattttttgcttacttttacattttttaattaatttaaaatattttgttgaattaataaataaaaaattatatttaaattatttttttttgatgaggttcggacccggacggtgtacattatttttctatgcatttttgggttattttcactgtttttaattaatttgaagattcgttttaatttatttaaatttatttttttataaattaaaaaaattattttttgtttttattaataacaaaataattttaattaaatttaatttttcttttgatgaatagatttatttttaagcaaaattagatttaaaaatttggatgcataataattcatttcaaaataaagtaaaataaattattccgtttattaattaaaaaataaacttttacattttttattatttagtttttttaaaatttttaaataaacctaattctataaaattatatttaaaattatgaaattatttttgtacatctcataaaaagttagacttttgtacctcttttaatcactgttgtacctcttctaatcacagtgaacgctcctaatcgctgttgtaccacttctaatcactgt

SEQ ID NO: 44497 - DNA, 139 bp, Heterodera glycines
ccccccccccatttcgcccgcaaagggcccaaaatgtcggaccatttcgcatcgacgggggccggtgtaaaagaggtggggggggggtcgccagcgaaggggaaaagaaggaaatgtctgaaaaattcggcttttttct

SEQ ID NO: 44498 - DNA, 991 bp, Heterodera glycines
  misc_feature (821)..(821): n is a, c, g, or t
  misc_feature (921)..(921): n is a, c, g, or t
aaaaggtaaaataatcatttgcaaagttcagcatatatgccgatttggctgcactatcatttaatgagcaccaaaaaagggattttgggaaggaattttagaaaataaaattaaaataagtgccaaaaaggtaaaataatcatttgcaaagttcagcataaatgccgatttggctgcactatcatttaatgagcaccaaaaaagggattttgggaaggaattttagaaaataaaattaaaataagtgccaaaaaggtaaaataatcatttgcaaagttcggcataaatgccgatttggctgcactatcatttaatgagcaccaaaaaagagatgttgggaaggaattttagaaaataaaattaaaataagtgccaaaaaggtaaaataatcatttgcaaagttcagcataaatgccgatttggctgcactatcatttaatgagcaccaaaaaagggattttgggaaggaatttttagaaaataaaattaaaataagtgccaaaaaggtaaaataatcatttgcaaagttcggcataaatgccgatttggctgcactatcatttaatgagcaccaaaaaagggattttgggaaggaattttagaaaataaaattaaaataagtgccaaaaaggtaaaataatcatttgcaaagttcggcataaatgccgatttggctgcactatcatttaatgagcaccaaaaaagagatgttgggaaggaattttagaaaataaaattaaaataagtgccaaaaaggtaaaataatcatttgcaaagttcggcataaatgccgatttggctgcactatcatttaatgagcnaccaaaaagagatgttgggaaaggattttagaaaataaaattaaaataagtgccaaaaaggtaaataatcatttgcaaagttcggcataaatgccgattntggctgcactatcatttaatgagcaccaaaaaagagatgtttgggaagaattttagaaaataaaaataaa

SEQ ID NO: 44499 - DNA, 1575 bp, Heterodera glycines
  misc_feature (18)..(18): n is a, c, g, or t
  misc_feature (31)..(31): n is a, c, g, or t
  misc_feature (42)..(42): n is a, c, g, or t
  misc_feature (61)..(61): n is a, c, g, or t
  misc_feature (75)..(75): n is a, c, g, or t
taagaaaaaatgaatatntattgtatcaatntactaatttanatattcaaaaaaggaaatnttattttctttgtntaatagatggttgctttcattaaaaattattaattacggatatgcggaaagaaaggattcatttgttttaaactggctttggctgaggcggcgacaattttataaattgatagccatgggaaaacaaaacggcgatagaatttatttcatcaaatggttttgtttaaacaatttattttataatttaaaatataaaaatgatggcgtgggactggtccatttttatgaaaaatctccgctcaaaaatttgttgatgacttttgaaggtgaaacaaaaaataagtttttgcaataagatttctttttcagatccctaaaattctcaaaaatttaaaaatttttaaataaatccaaaaatcccgtgaaaatggcaccgccgccctgtgtttcttaaacaaacaaacccattattatcttatttatttttatttttaaattttaaatatgtgtaatgcactgtaaacaaaaactattaaacaaaacctacaataattaatgatgactcactcccaattttcattatttcattcatcggtcaccggcttttccatcgtccgccgctgggagcggaggaattggattcgtaaaatgggggagaaaggagatgagacgggctaaagtaattaagcagatgcagcggcggtggaaagcgaatttcgcaacggagagaaatgacggaaaatattttttttgttttttttgaattggattttgcattaattttggagacggactttggcgatggttgtccaatcgaatgaaataaatttagacaaaaaattgacgaaattatgaaatggaaaactttaaaaaatgttattgcattaaaatgtaatgaattgatgaatttagtgcgcttcatggtgcactttatgcttttttcaagaaaattttcaaaacaagtgatttttttcagaatttcccaatttttcccactttccaatttatgcacacatttgaacgcgctgaaaatgtcttactaagtatttcaatgccatggcattgaatttttgcagaaaaaacatttcgaattttcgataagaaacaaatttttcaaaatcgggtaatactagtaaaatttttaatttaaaaaattagttcatattaaaaaaatcaaaattttcctatcagccaatatccatcttatgtatatttcacatgggcaagaaaaaatagaaaaaaatcacattactttgattttctattattttcaagagaccaaataaatatcctatatattaaagttgagtgtttgtatgtatgtatgtatgtatgtgtccgtgtttgaatttgtgtggtgttatgaaatgttttgcgttaaaaatgaatttgaaaaaaagtagagtgagagaaaggtgggaaatagtgcactgtctgactgtctgttgatgcgggcagcggcgggtgggaggggtagacggtgaacagacgcgtgctgctgtgcagcagccagtctgagagatgcgtgcgtgtgtgtgggagagggagggagtgggaaaa

SEQ ID NO: 44500 - DNA, 1467 bp, Heterodera glycines
ctttaagatccgctttttgttgcttaaatttgtgagacacaaattggatggagtgatattttctcttaattccctccccccttattcttaccagtgcataaagatctcgtatctcgtgccaaaatacgagacacgagaactagaaacgagaatacgaaacacgagatgagtaacatccctgctatataaatataaaaaagaaaaattggcagaattcttcagcattttttttcgtcgtaaagtaaataaaagatgcttattagagcccggacgggaccggggccccgccgggattttgccgggacccccggccccggtcccggtttttttggacaaaccaccgggaccgggagtcccggaaaaacgggagtcccggggcccctcccgggtccattttccaagtcccggtcccggccatttgggtcggaaaaacgggactaaatttcaccagtgaaactgccccaaatgtgaaaaatttaataattatttttggcgaaaggtcttttatttaaaattttgaagatggaatttgggattttctacgatttaaactgttaaaaagatcataaaatccacctaaaatattcaaaattagatctaacatagcatttttggggaaaattacttaatatgagtgtaaaaatctataaaaattcttacgccgggcctataaaaatccttattctcttaaaaattgagttgaaatcgcaaaactttgtcatttttttggtgtaaatctgttaacaaatcattcacaaatttttaaaatttttcccggcggcgccggacccccccccccccccccttgtacccaaattcttttaaaaaatgcacagtaaaaaagggttttgaaaagcaaataaggacgatttacatggcttgatataattttaatatcatccaaaatcacaacttttagagtttacggtacatttcgaaagtgttctaaaagcacatctgcttttgaatgacattgtatagtagtaaacaaaataaatttattattgaaaaaaataaataatattaaatatttagataaaaaatccgatcaaattttcacaaaatgctcgaccaaaaattgaaattcttcaaaaatattgtaaacgcgaatttctgaacaaaaaatatcggcgaaaatgcaacaaattcgggtgttttatcgccacccacaaggtttcaatgttttgttttaacaaattcctttttctgataacatgttaataatttcgtatttgagccttaagaatgtaatttttaattttttttttcgctaatttttgttggtgtgatttcgactcattttggttaggcgggatttcgactcggcgggattttgacgcgacgagatttcgacgccacgtgattttgacagcgccgagataatttgctaaaaaatgttaatattaattaattttcgctaaaaacaaatttactgatgtttatgcattaaccaaattattcgatcga

SEQ ID NO: 44501 - DNA, 988 bp, Heterodera glycines
  misc_feature (842)..(842): n is a, c, g, or t
  misc_feature (918)..(918): n is a, c, g, or t
  misc_feature (937)..(938): n is a, c, g, or t
tttaattcaactttatcaattaattcaatttttggaattttggttttcgcggtgatttgatcaacttctatgaatttgttgtccaagcgaacaatttggtactgtgactcagaacacactctcttttcggaagtttctcttatttccatgctatacgtgtcgataaaggcaagcctttcaactccaccatgcctgaatttgatcggtaagtgtacaaagcattcgcttttgccttgaccagcttgactgatttcccctaagggaacaaattcgaaatctttttgcttgatctcaacacatggccagactcttataagccctggagtaacgctcttagcatgtaagaaggaagaattgaacaaaatacgagctaatgtcgaaggatcagaagaaatagctgacattgcccaccttttgatttggtcaaagtgttcacaaagactttgtattgtatggctaaacgaaaaacgcatggagtgagtgacctgaaaacttaagtaggaaagttcagattgaagttgagagtctaccaccatactttcaacagcacgccttttcctctgtttcgtcggtgtcggtgatttgagactttcaaccccgtacccctgctgagaaatggtgagatttttgccacatgacgccacaatttttgggttttcctcaaacgtgagaagaagagggtctttattcgctacccaagtcctacccattatttgcccttcaaaaacgtgtgttttaatatattcacaattttttgtactctttgtttgccataaaattagggtactgtcatttagtttacaggagccaaggttaaatggacagttctcagagcttcccanagtgctctcgactcggtccgttcaaatcttacaacattttcgttttaaataagtagcagttttcactgcttacttngaccatgcaaacgaccaanntcaacacatgcggggggataaatcaatcttgttaagagtttggaaaattt

SEQ ID NO: 44502 - DNA, 962 bp, Heterodera glycines
aatgaaaatccaaaccctccgaaatgatcattttccccacatgtaaaggttgttgtggcatccgcggtccgcgagctgtccttcatcgttgcgggcctgttcagcgggcacgagtacgacttccgggtcagcgcatgcaataccaacggccaaggaccgccgctgatgtcggagaagccaattgtggcacggttgccgtttggtgtgccgtccccgcccgtgctgcccggtgttgtcgacgtgggctgggactacgcggtgctgtcctggcagcggcctgagcgtgacggaggcggacgcctgcgcggctacatggtggagaagaaggaggaagggaccggtgagggtgactaattagccatatggcaaattgggcctaattatggcatatttaattggataattgaagactccaatttagtttttggtccgaatataatttgaaaaattttctcgggttaagattttaattcttcgatttttcagattttctttcaaaaaaattttcttattgatttacaatttcaaaaataattagggtttttagaaaaaattccgacaataaaaatttaaaaataaaaaatttcgtgaaagtctttttaatctaaaaaaaaaattctttaataaatcatattcgacagaatattggcaaaaatgcacacaagcaccatccccgtcaacatcgctgagcgtcaccaatctgatcgacggccgcaaatactcattccgaatcatcgctgtcaatgatgccggcgactctgagcctgcgctaatgtgtgtgataaaaaaaattaatttatatataacaataaataaaaatataaagttgattttgtatttactaaaaaaaattcgggaatcatattttttaatcagtttcaatttcataaataaataaagctctctgtgcttgagggttatatgtataacaaaagatttaataaatgtactttacaaaatgc

SEQ ID NO: 44503 - DNA, 1568 bp, Heterodera glycines
ggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgccagtatttttggcaattgaagttggcgggtctggcaggccaaaatggacacaactgtagccaaagttgtggagccgccaatcaatgtcggctaaggctctatcctctgctactttatgctgtgccggagtaataatgccttgcggattgtacatttggtctttgtacttgttccacaattctatggcattactcggctggccatagagcaggatgctcacatagagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccaataggctgaacactgcgtttctggcagttcgccttgctggatttgttgagctttgctcaccagctggaatgccctatatacaatgggctgttggtttggcaaatgaattgccaatttgacaacatgatgcgaaagacgggcaaatggcattgaatgaacaatggcatatgcttccgttgcaccacggaagttcatcttggcatattgagccggctcgtcaattttgattttattgccggactcttctttgcactcgacataacaatgtcctggccctttaaaagggtacttgagtgcgtatttaatatttgctttgttaccatatgcaaacagtacattatggtgtactcggtaacgtagcagaatataaggattatacggcacgacatgtgagttgtcgtatattaagccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtaggagcatctgtgcagttgcatatgcattgtttcgcggatt

SEQ ID NO: 44504 - DNA, 960 bp, Heterodera glycines
ttttattttgtcaaccaaatccaaaactattaggtatcattcaatagccctaagtgtcctctattagcctgcaaaattctgaaaaacctcgttaaggttcaaaaaagttatggttagaagaattcaaaaaacagattttccaagttttttggcttgaactttttttaaacttaatgaatttttttggaatttcgcaggctaatagagcatctgaagggctctcgaacgatacaaagatatttggatttggtttgcaaagaaaaaagttatagtccaaaaacatgtgctcgtacgaaaacgacctggtccgtctcgagacaccccttgtatatgtatgtctcagggtgtttgctatttgtttaccgtagcttttggcttcctataggcgtctatactactagaagtggttttgtccctccgtaccgtaaccttagtgcgccctatttcattactatgatttaagtaatccccgtaataatgttaatcactaactccattccagcgctggtaaacctcgaggaccaatcgctgcagtttctcaaccagtctttgcacgacgcggagatggtaattgcggtgtacggtggacatgacgaggacgaccatgatgatgcggaacaacaacaacagcagcaccagcagatggccaaggagtacttgctcgtcttccaaaagctgggcatttacgtggatggccaaggtcaacccgaacagtgatgaacatgaagcggacttataaataataaatttcaaattttctcaggaaatcttaaatcgttatttctcaaaaaaaaatattatgaaggaaacgatgtagcccatccatctttaatgctaatccccatccaccacttcctttctcaggccgtcgctcgcgtgcccacgaaatgatgttcccgtgccggctgagcgcgaccggcaaattcgccttccggcgcccatttctgctccacttctctg

SEQ ID NO: 44505 - DNA, 756 bp, Heterodera glycines
  misc_feature (47)..(47): n is a, c, g, or t
  misc_feature (60)..(60): n is a, c, g, or t
  misc_feature (68)..(68): n is a, c, g, or t
  misc_feature (93)..(96): n is a, c, g, or t
  misc_feature (103)..(103): n is a, c, g, or t
  misc_feature (105)..(106): n is a, c, g, or t
  misc_feature (108)..(109): n is a, c, g, or t
  misc_feature (111)..(111): n is a, c, g, or t
  misc_feature (114)..(115): n is a, c, g, or t
  misc_feature (128)..(128): n is a, c, g, or t
  misc_feature (130)..(131): n is a, c, g, or t
  misc_feature (136)..(136): n is a, c, g, or t
  misc_feature (139)..(139): n is a, c, g, or t
  misc_feature (143)..(143): n is a, c, g, or t
  misc_feature (151)..(152): n is a, c, g, or t
ttcgcaggattctcaacgaccatcccacacatcgagcttccagcggngctgcgatccggntacagagntacccatgtctttcaaaacggacgnnnnggccgcngnnanngngannggagcaacggccncnnccacnccnaccncaacaaanncctgttcataaaatttgagggtaattttatcagcaatcaaaactaaattaatcaataatcatttagcgagtggattccctgctgattgtgccgttgatgacattgacgaggaggagagggaacgccgaaagcagcagtacattgacaacccatggaagggctgtacggtgcggctcgacgccaacaacatcaagccgaatcccggcatgcggtacctttcgaagctgtgcctcaactcgctgtggggccgtttcgctctccggaatcggctgacgaaaacggagatcatcgactgccacgctgatttggccaagtttctgaacgacgtcaaaatcgacatcagcagcatcgaccaactgacggagaaattctggatggtgtgctacaaggcgaaggatgagcacgtggtggagcacgacaccagcaacgtcgccattgccctatggactacggcagcggccagagtgcacttgctcaactcacttcaattggtctacaggcagcaagatctggttcagcgctacgacacgcgcattttatacatggtaagagtgtgcaattaaaatgttcataataaaatattcttttttcacgacaccgacag

SEQ ID NO: 44506 - DNA, 861 bp, Heterodera glycines
  misc_feature (782)..(782): n is a, c, g, or t
  misc_feature (789)..(790): n is a, c, g, or t
  misc_feature (798)..(799): n is a, c, g, or t
ttttcagtcagtttattttgaataaccgcgatagatctttggaaatcaaatgcattggcagtgcttccgagcttccagatttgccgttggcacaaattgttcaatggcaatgggatgggaatgggcaacaagtgatcaaaacagtgagtttattcgtattaaaaaatttagttttttaaattaataaattatctacctatactatgattatttattcgattagagtaaaatgatcaaagctcgtgagacatttaaattctacgtcaattctctgtgttccattgtgattagaattctcaaaaagcgggaaaaaagtgccaagaagtaatgccaatttttgtttggcaaaatataaatgtattttcttgttttagtctgtgcccaccgatcagtttgccagacgaccaatttacggttctcattggtgataataaggtgaagtcatacactgtttatcagatcacggcacctttaggctaggttcttaaatccgccagaaaggtcggatcgacaaataaaaaaataaaaataaaacttgcaattttaaatgatcaagaaattttaacaaatacatttttatattataacaggcttttaaaaaattatgatttttaaaattttagggctaatagaataatatgtgaactgtagaatgattttaaaattgaaaattcgttgtttttgacaatttttgatttatttaaggagttttcgcaagataaaatcatcaagaaaagtaaaagacgctcctccccaaaaattaaaattaactattttattanattcaannttagaatnnttgaaattttttagatcgatctgtcctccatttttctatgtccgtttcgccagtgatcaatc

SEQ ID NO: 44507 - DNA, 1029 bp, Heterodera glycines
  misc_feature (16)..(16): n is a, c, g, or t
catatattttacgatntgtcatgggaagtatgggggtttggaatttctatttcttcttaccattggcttaaaaatgccaaaaattacataaatatttctccccgacaacttctaaatttttgttcgaccttgtttctgatctatcaagaatggttgaaacttcggactttatatgtcccaatgattttgaacaagatcaaagcgagacgagatccagttttcaagactctctctcgagtttacaaatcaaaaatttgtatttttgcccaaaatcacaccataattcagcataaaaattttatggtgtgtatatgcaggcagtaaaatgtgtgcacttattgcaaaatgtgacgagaggggaggaaccataaaagtgcatcagtttttcgcggaaatttgattagagagaaacggtgggtggttactggatggttagttggttgtttagtgaattgtgatgaatgggatgggatggatgatggaaatatgatgggggaggggcaccgaaattgatataaatctgtgtgcgtatcacataacgccaacaactgcagcggcgcggggacggacgaagggtggcggtctgttcagtccccaacctttgagtctctcgccggaggggatttaggccttcattgtaatttgcctattttagatattagatacctaaataagcgcatccttattatggcatttttggcatttcgccctttttttgcggctattttggcaacgccggaaaacccagattttttttttgcaattttcattttaacaaattacagggttattgcagtggtttttattttggaaggctatagagcttcaagggagtattaagcccgacccggacctgtgcccagcagaccgggattttcctcgatatattttggccgggctggatttcattgccccagatttccctggattgttgtccaggtaaactgtttagcttcacaaaaaaaacaaaacaagtctagaccttttcaaactattgactgatcaaacttatcacaaattgatcaatag

SEQ ID NO: 44508 - DNA, 663 bp, Heterodera glycines
tggattttgcatgtgaaaaagcgtcacaatttaatttctatggtggagaaaaaatcaaaaaaaattcggtgcaattggtgtcatgaaccccgagggttcgatttttttttttttttgctttatgcccaatttttttcactgtgccatattttattaggttgtccataaatattgtcactccataaaaaatggggtaacttttgaattctcacaatttttcttggcataattagtgtcattctctagagtcagctatattttaattacgcgttttcggaaatttatttaacttaaaattttacctaaatttttggcttgaaaaagcgcgtaaaacacacggaaaatttaaaattgaaaaatttacgaattgaatcagcttcatttgattcaaactgtttttcttttaattctaaaaatttgacttcacttttttagggggtgccaattattatgagacaaccaaatacaaaattttgcaaatcggattgaaaaaaaaaacaaatttagccatttaacaatttgtccccgacaaataacagattttgaagatttggggtcaaagctagaaaaaattctaaatgtaagaaaaagtcaaccggtgggaaaattttaaaaattgtcgaaatttccaaaaaaatttgcacatttttctcgaaacaaatg

SEQ ID NO: 44509 - DNA, 1111 bp, Heterodera glycines
tggaggaccaccgcaaatgcgcgggggtggcataacgcagcaacaacaagcgattggcaatcatccacagcaaatgctctgcgcgggcagcggcggtggacagccgcaggaatcggtgaagcgcaagctgatccagcaacagttggtgctgctgctgcacgcacacaagtgtcagcagatcgaacgggtcggtttttatcctaatttccattggtttcattcatacattagtagtgtctttttttatgttcgtgagaactgcaatagagccgtcgggtcgatccccccccccccccacatttctaaaatctctattttcagtctgaactgcgacaaaaccgtgcgccctgcacattgccctactgctcggtgatgaaggccgttttggagcatatggtcggctgttcggccgggcggcagtgtcagtacgcgcactgcgcctcctcccgggaaatcattgcgcattggaaggactgtcacaaggacgactgtccggtgtgcaacatggtcaaacggtacaccaacggaacagcggctgaccggcgacaaggcatggcaaaacatcgaactaaattcaagaaacgggaaaaaaatgtccctctattttcggtgtcttttcaagccactaactttggtagctgtctaactgaattttattattttaattttccgacttttcgttggtaaattgctcccatttagctgacattatgctgggtgctatcggttttccctctgtgactttgcctcaagacgcggttgggcaacaggtcaatttatttgccaaaaatttgaaaaaaaataagaaatttatgtgcgtggacattagagctatgtttaaaaattaaattttctgaaatcatgtttcggctgattttatggttgcatttataagtcaaaataaaaaattagtcacaaaaaaatgagaaaaaacaaatttgacctcctccctttccaagtatgatcaaacaattcttgcaatgggtgcaaataatcacttaatcgaattgtttccttgaatttacgaccgtttccttttagcaaccctcaagttcggcaagtgtttgtagtggaccgttctctgtcggaagcactcctattttattgaaga

SEQ ID NO: 44510 - DNA, 724 bp, Heterodera glycines
caaaaaattgcggattttttgagtatatcatttttatcatatactttttcagaatggagttaggaatttttttctgaaaaatcgaatttttccagaaattctggaataacttatttatattgaaagataggaattctaaataaatcccataaaattctcctaattttttgctatttttcaaactttattccactaaatttgaccaaaagcgaagagagttataaattttcgaaatttcactggattttccagggcccaaattgtgacgatttttcaaaaaattttaaacactttccaaaaaatctgaaacgcaaaataaagcgtatatacgtattcagcacctcaaattatgccataaaaatgcattttggctaatttaggagcaaaaaaatttttcatgaaatgcaaaaccatggggtcccccctatggtttttaatttcaaaatgcatttttattttataactttttttaaactcatggtaaaaacatgagataaagcacattatattgggcttaaaattctctacaaaaaagctcttagacgattttttgataaaatcaactcctgacaagttattgcgccagaactgaaattgaggcctactaaccaaaaattttctatttccaaaaaaatttttaaaaatttttctgaaaatgacaccaatcgatagagcatgaaaaacggttgcttgaaagtggtcttcgttttgcccggaaaaatct

SEQ ID NO: 44511 - DNA, 812 bp, Heterodera glycines
tattgccaatctaatttcttgcagattgaaagccatccattgcctgccggttctcggcacagcaaagcactaatagggtgtttgactcacttcaaaaaataattcattatacaaaagtcttttgcatccacttattgccaatctaatttcttgcagattgtagagctatccattgcctgccggttctcggcacagcaaagcactaatagggtgtttgactcacttcaaaaaataattcaatgcccaaaaagttttttacaaccacatattgccaatttaatttcttgcagattgaaagccatccattgcctgccggtctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgattcacttcaaaaaataattccttacacaaaagttttttacaaccacttattgccaatttaatttcttgcagattgaaagccatccattgcctgccggttctcggcacagcaaagcactaatagggtgtttgactcacttcaaaaaataattcattacccaaaagttttttacaaccacttattgccaatctaatttct

SEQ ID NO: 44512 - DNA, 864 bp, Heterodera glycines
aaaaagcatttcaaattcgcgatatgaggggaattcctgtgccatcgtcatgtcaaaaacactaaatgaatttttgagatggggtggggtggtgctgatctgattctgtccgatcggaattgctctccttaaaatcaacctcctaccgtatgcgcttttgctgctcgtcttccgacgagttccaaactcacattccccccccccccctctcctgttgttcttcagcactccctctctcattaatcagcgtcggtttgtccgtcggtccgtgcgttgtttaacgtcgtgcccctcccccccccgtcccctcccatttttggttttccccacaaataccatccatcatctgatctgatcaacatcccccgcccgcctgcccgaccgcaaatggtgttcaacaacacgcgtgagcagcattagagcagctggcgcaccccgcgccataccccgcggcgaagaacgaaccgttagttcacgcttgatcgaactgcttgctaatgaaattaggggggcgggggggaaacaccactctctggtgagcgaacaaagctccctcacccatttaaagttactctaatcagagttggcacttccgcggggggggaccttcgtgttcaccacaaaaagtgatggatggagcgcggaagaagaagtgagtcagtcattgagcaaataaagggatggaagatgttttcaacggaaatgcatgtaaaaatgggctggcagagatgttttgtgcgttcggcggtgatcagcagaattcggatgatttgtgttcattttgctgattatcgtacagtaccacggcacggcgaaaggaaatgaaacgaacgaaacgcaatttaatgcaaaaaatggacgagt

SEQ ID NO: 44513 - DNA, 1135 bp, Heterodera glycines
ttaacggcaacgcctgaccctaagaatcctttgttttattaaaaattggctcaaaatcacaaaatttggacaatttttggacaaaatctgttaacaattatacccaaatttaattttcaagcgaagtctacatcggtttgctcttcgtgtaaatggcaacatttaaacactataattttggattataattttttaatttttttttatctcattcagttttgattataagcaaaagagacatttaactattttatcattttaaggaaatccaaattttaataaatgtatcctgattaattaatatatataaattttgttttcactttgtaagaaataattattatttttgaatttgagataataaatccatcaaatttaattttagaatgaaaagaaataaaaattgattattcgcctggtacttaattgtacacttttgacaacaaaaagttgtaggagcacccaggccagagggttagagataggggttaggggtcgctggcaacaatgtcaggcatagtccaacttaaaatcctaccagcaaaaattttttgatttgagcaaaagaaaaaattttaatcatagaactcccttatatatagtacgattttgattatttgtgtagtaaataatatttcaatttgttcttactacgttccttcgaactcttccgttgatccatcgtatcttttgttaatttttatatgctttatcaaaccgttatcatatttaattcagtactttgtgttgcgctttagctgatttcgcttcatacatatttcttattccttaccgaatgaggaattttgatttctttcaaccaggtatggctaatttaatttttaatttgaaatactaaacaatttaaactattttggattattttgcagatccaatattaatttatattgccttgttttgaacataaaaaatttttagtttagtttttatttttttgtgttggaatttaaaggatttttttctaagtatattttcttttattttaggtattattttgttggatttttaattttttctattgttttatttttaatgctctttcagaccatgtgaatatcattaaaagtataagttaaaaagtacagagttttagttttataaatattggtttaag

SEQ ID NO: 44514 - DNA, 1256 bp, Heterodera glycines
  misc_feature (25)..(26): n is a, c, g, or t
  misc_feature (35)..(35): n is a, c, g, or t
  misc_feature (165)..(165): n is a, c, g, or t
cgattatggcaaaaatgaagccccnncagtgttcnttaatgaaaaaaatatggtaattagtttttgcaccagtaaattaaatgattttgtgttgtcattaaaaattattcaaaatttaattgcatctattccttttgacagcgatttaaataataaaattatttntaaaaaatcatttaaaattattttaatatttataaaatggatttaattttttacatttcacatttttgttccgtgagaattgctgctcctccgttttcagcttatcctttgctgtgtatgtttgtttgctgggacaacattgttgatcgcattgaaatcgacacattattaattgattatgtattatttctataattttaataggcaattataaattatatgaatttaattaattaagaatgggaaaataaaaaataattattatataaattgattttattaattgcaggctttatgtttaatttatttccattaaaaccatgagttttcccattcaatttacatatgttaaaaaataatatttattaatttatttgaattatgaaaataaactaaaaaattttcttcagttgcaatttttgttttgcacgcactgataatgaaacaaaaataattacttaacattaccggttaaaaacaataataatataataataatattttgtgtgatcttttaaaaacggtagaagtgattgattatgtacacattagaaaatgacgaaaaagaaacaaaatgtttcaaaatatatttattgtacatatattagtgaaaaaaaagtaatttgaaaaaacaaaacaaaaataggtattttggatgggtttcaaaatgttaatttgccagaaaaatatatttgtgaaattgaaaatgcctattaaaaaaaaaaaaattcttttcaaaaatattaaaatttaattgacggtaatttttcgcaactaaaatttgtattaaaatttaattaattaattaattaattaactcccaaaaatatcacacaatttaattggccatggctatgcccgcggtatatcaaaaagcctaacatcagcagaaggtgcccattaaaaagataaataaatatcactactttttcgtacacacacacacacacacaaacagcagcagcagatgagagttaagagatggagaaaatgagcggggaaaataatgaatgtttgctactcgtgatggttttagtgtggcggtggttgctgctgttggttggacaactgactgctgacaaaatgagaga

SEQ ID NO: 44515 - DNA, 1665 bp, Heterodera glycines
gcaaaatcagcgtgcttgtccttccccgaaaggggttcgtaaaccggtgataatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcacttgaagagag

SEQ ID NO: 44516 - DNA, 601 bp, Heterodera glycines
  misc_feature (596)..(596): n is a, c, g, or t
tttgttggcatttagtaaaatgcgaaattttgccggccaacgaaagcaattggaattatgatggcctgaaattgtcgggcaaaagatcggattgccgcatttgcatttttatttggccgagaaaatgagcgctgagaggggacacgggacaccgaattgagtctccttttccccgggggggggatttaaatttggagacaataaatttaaaaagattacccaaaaaggaatgaaaaaaatggacgggttactgtataattatggtacaaaacacaatttaattacgttatttaaagtagtcaaagtgtggaatacaaatgaaatcaccctcttttgccggtttgaataattaattaataattttaattacccttccgctgattaattgcctaattttgtaattattggccaaggattggcttggctttgccccctccccctacttctcccaatttgctgtttcttcctctgtttgcccatcggatgagctttctccgccgtgctccgctgtccgggcacaaactgtgcgatttgggttgtcattgtcgcatttttgggccctctcaaaatattatcccctaatgggggaggggggnggggg

SEQ ID NO: 44517 - DNA, 1243 bp, Heterodera glycines
tttggttttttattaaaaaaaaaccccccccccccccccccccccccccccccttggcgtccctaggccattttttacgctgggattgttgctattattcgcggcttcgcccgattcttatgttggtctttaaaaatggcacaactcactttgtaggggaacatgtcctcacattcgacgagcactccgttgatgcccaactgacgaacaaaacggagcagttcaatgaagtaagggacctcaaaagatggaaatactactcaaaacagtgttaaatggatggaggcgtactttgaaaggtgctcccttcaggtcgaaatgcacccaaagtttggggggcacaaaattcccttcggacgttagcatcggatagccgtcgtaatcctttgccttaattgcatttaatgatgacccagttaagcggtcacatcttaaaattccaatgttcaaccaacccgaacattccctgggcttttcgctgtgtctttttgtttctgctggacaccgttttggacaaggaacatcgaatgaggaaatgacaaatccgctttggctgtaaaagaaatgaaatatttcatgaaattccatccccaattttatggtacaaccgccaagtttccgttgctgcaaattggcgagttgcgattggcacacggattcactgttccgcaatgtttccaatttgatgctcacatctaattgtgaggcaattattggcagaaatatgtaaattattttgggtccgataaaaccccttaaaaattcaataatgaaattttaagggaattagcaaaagggtcaatttattttgaacattttcgaccaaataccctccgtttccatggatagtctctccccgataatcccaccgatgagttccgtttgcattcggcccatttgaacattttgtgagcgcaatttttggcgtaatgcctccgaatcggtgatgggaccaatggaaatgttcaggtagaaaatgatgaggaagaacagcaacaacaaacagagggcgacgcagaaaaaacgaagtctttgcaatgggaaagaatgggcgacgaccctttgggggaggagggtaattagtccattgaactaattagggataggggaggaattggacaaaatttaaaaattaattatgcaaggaattaaaaagggtgggtgcaaacactttgctaatttctcatgctcacctaattgtcctgcggcagagagacccggaagcaattgccatttcgcttac

SEQ ID NO: 44518 - DNA, 1264 bp, Heterodera glycines
  misc_feature (748)..(749): n is a, c, g, or t
  misc_feature (755)..(757): n is a, c, g, or t
  misc_feature (760)..(760): n is a, c, g, or t
  misc_feature (763)..(764): n is a, c, g, or t
  misc_feature (768)..(770): n is a, c, g, or t
  misc_feature (773)..(773): n is a, c, g, or t
  misc_feature (775)..(776): n is a, c, g, or t
  misc_feature (779)..(779): n is a, c, g, or t
  misc_feature (781)..(782): n is a, c, g, or t
  misc_feature (784)..(785): n is a, c, g, or t
  misc_feature (787)..(787): n is a, c, g, or t
  misc_feature (792)..(792): n is a, c, g, or t
  misc_feature (795)..(795): n is a, c, g, or t
  misc_feature (797)..(797): n is a, c, g, or t
  misc_feature (802)..(803): n is a, c, g, or t
  misc_feature (809)..(809): n is a, c, g, or t
  misc_feature (822)..(824): n is a, c, g, or t
  misc_feature (839)..(839): n is a, c, g, or t
  misc_feature (844)..(844): n is a, c, g, or t
  misc_feature (846)..(848): n is a, c, g, or t
  misc_feature (853)..(855): n is a, c, g, or t
  misc_feature (858)..(858): n is a, c, g, or t
  misc_feature (863)..(865): n is a, c, g, or t
  misc_feature (877)..(878): n is a, c, g, or t
  misc_feature (891)..(891): n is a, c, g, or t
  misc_feature (895)..(895): n is a, c, g, or t
  misc_feature (903)..(904): n is a, c, g, or t
  misc_feature (909)..(909): n is a, c, g, or t
  misc_feature (911)..(911): n is a, c, g, or t
  misc_feature (916)..(916): n is a, c, g, or t
  misc_feature (932)..(932): n is a, c, g, or t
  misc_feature (938)..(938): n is a, c, g, or t
  misc_feature (953)..(954): n is a, c, g, or t
  misc_feature (967)..(970): n is a, c, g, or t
  misc_feature (976)..(977): n is a, c, g, or t
  misc_feature (984)..(986): n is a, c, g, or t
  misc_feature (993)..(993): n is a, c, g, or t
  misc_feature (1000)..(1000): n is a, c, g, or t
  misc_feature (1003)..(1003): n is a, c, g, or t
  misc_feature (1008)..(1008): n is a, c, g, or t
  misc_feature (1015)..(1015): n is a, c, g, or t
  misc_feature (1017)..(1017): n is a, c, g, or t
  misc_feature (1022)..(1024): n is a, c, g, or t
  misc_feature (1043)..(1043): n is a, c, g, or t
  misc_feature (1048)..(1048): n is a, c, g, or t
  misc_feature (1056)..(1056): n is a, c, g, or t
  misc_feature (1071)..(1071): n is a, c, g, or t
  misc_feature (1083)..(1085): n is a, c, g, or t
  misc_feature (1096)..(1096): n is a, c, g, or t
  misc_feature (1111)..(1114): n is a, c, g, or t
  misc_feature (1125)..(1125): n is a, c, g, or t
  misc_feature (1128)..(1128): n is a, c, g, or t
  misc_feature (1143)..(1146): n is a, c, g, or t
  misc_feature (1156)..(1157): n is a, c, g, or t
  misc_feature (1200)..(1200): n is a, c, g, or t
  misc_feature (1203)..(1203): n is a, c, g, or t
  misc_feature (1211)..(1211): n is a, c, g, or t
aatttaatttcgggaacattaattaatatacacgttcaaatgatatcaatcagaattcaactgcgcggtctactgccttgaaagaattacgtattcattgctttttaaaaataaagtgaaaatagagcgaaaatattgctttaagtaagaagaaattattctactcatatttcataataattattaatagatttacttcttgattatttattatctcattttctcgaactaataaaatttataaaatttctttttatttttataaaaaaatataataattagatattttagtaaattatcattttaatataaagaaatattaatttttttttaattatcaatttaaaaattgtcattgtgattttctacagactttttcttaaataatcttcgtcaaatgttttaacattttttgaattgcggcacttaaaatttcgcatcgaatattgtgaaagattaaatcttattcttaaataaatatctcttctataaattgtttctctagtgatcctcaggaccttagtattttctcctttttttggcttcgtaagtacattttattttacaaaacgttgtaataaataaataaatttgcagtcttcttattttaaaaattttttgtattaattaaaagattttgaattactttcattatttaaaaatttccttagcctatcagtattttaccgaataaaacaagaaaataacttttagatttatttatgttttatattgaatatttgcgccnntggccnnnggnttnnccgnnngtntnntgncnngnntnttggnggngngttgnnccgtgnttgtttcgtttgnnncttttttggttcgcnttttntnnntttgnnnttngcccnnncgttggtttttnnttggtccctttcngggntgggcccnnttggncncttgnttgcgtcgtgcgtttngcgttntttgcgctcctgccnnttgcgtccttccnnnnttgcgnngtgcgcnnngctttcntttgcgnctntgcgntgggcgntntgcgnnngcggcgttttttctccctncttgntttgtttngttcttcccgcgcgngtcctttttttnnntttttttcctngttttggggtcgttnnnncgcttttttgnggngcgctttttccgggnnnnctttttgggnnttgggggctggcgccgccgggaaaatttttgtctgtttggttnttntttgttgnctgcttatcttaaaagaatgatcaaattttgtgatttttatcatttttctaat

SEQ ID NO: 44519 - DNA, 745 bp, Heterodera glycines
  misc_feature (727)..(728): n is a, c, g, or t
  misc_feature (730)..(730): n is a, c, g, or t
gcgggagtgtaacagtgccatatgggcccatgtatttgccataggcaattcaaatccaccatttcatcgcttttcacaccaatgcaacggctatttattggacaacatttgtgccaaaatcattcataaccaaagcattttcccattgattttgccgttttagctccttcaatgcctttgcctattcataactcccattagaactctttcgcgcattaatatatgtacctttattgttcgcgtgatggctcagccggaatgccattaattgccggttggtgccatcctttgcgtcggcatcccttcggaagcgttgtcagcgtcggttgctgcctgtggcagcagcgacaacggcggttacccctcgggcgactgcgctatctgacaaaaaatgggccatttacaataaattccaaattggtcaatgttcaaaatattacatttaagcaatcgcataaaataatatttaattgcttaaaaatgtgaccgcaaatttcttcttcggatgccagtcctgagaatgttattgccttgccaatttgcacctcatttttcgtaggtcgcttttattatattaaaatcttgttgaaatattttgttttaatttaaaaaaaaatttaaaaaaaactttattagactttcacctgaatattaaattttcattgaaaatcccattaaaattagaaatgtgctgtgttctacagtatagcctatttcaataaatcgnngnattttgtaaagaaga

SEQ ID NO: 44520 - DNA, 1280 bp, Heterodera glycines
ctcaattagcaaaaatatgagtgatcgaattttcactaaaaaagttaagcctacattttttggcatatttaaaaagcaattaaaaaattaaccgttttgagtagattagactagaaaaaattgaaaatttagaaatcatgtttcccactcccttctcccaggggtgttattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaatccaacgcagaataaagtacag

SEQ ID NO: 44521 - DNA, 1348 bp, Heterodera glycines
aaaaactggcggatcggatgaaagtgttgttggacacgtccaatggggcggacattcactttttggtgggggagaaaaaagaggcaagaaaaatttgaaaaagagaaaaagcatttttatttagctgtttcgagcccacaaatgcattttgatgttggcttcggatgtatttaaagcgatgttccgttttgatgagaaaaatgcgacggataaaggcaaaattgaaaatagaaagttataattttatcgaattttttgaatttagtcccttctggcgaactgccaaagcctgtggaagtacccgatgttgaagcagcggcgtcaaagtgatgctgagcttcatctacgcggacgatttgagcgaattggacggagacaatgcaatggcagtgatttacgcgggtcggaaatttttttattggaatttagggactttaataaataactgcaagcgtggaaatgcggtgcttatttattttaattatctcaaataaaataaactattgatcaaaataaagtatcgttgaataagtgaaaaatataaaaattggatgatcaaaattataaaaacaatattctgagtgaaacgaataaaattatgccaaagtcaaactggggttaacaggcagagttgttccgggacgagaaaaatggcgggtttcagaattcgggtgacccggaacaactccggtcgacaatatttgttttattcatgtttttccggtctgtcttattaccctaatttgtaagataagttttgttttaaattgatttaataaattgttttattacttctttaacgagttgattccacaaatttgctgctcttctaatgcttatattattgttgggaaaggtttgaattttttgagaagctcatttattggaggaaattgtgtggctcctttagttaaatttacatctttggaagggttcaaacaggcaaatggctgtaaaaatataatatttcaaaaacattaacagtgtaatggagtcgaacctatgacctctcacaaaccccaaattaaaccggcggaaacactgttcacaaattaagaaatttaattaaggaattttaatttttgtaattctttccttcttataattttgaaatgatattttaatattttagctaaaaagtacaacatttctggactgatcggccagtgtttgcataaaattcccatcccaaatttgccaaatgtttttctggctcattcccaggctcttctttttgacttggaggtggtaaaaacgcttttttaaagttttaattaaacgcgaaaattaattattatttttatggtgtgggattgcccgccaaaatgtttgctttacattgtcaaaa

SEQ ID NO: 44522 - DNA, 1306 bp, Heterodera glycines
tttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaagttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacgggtcagaattcaataaaaataacattcacggtgcgaaaaatggggtatggaaaggttattggggaaaaaaagacttttacaaataataccccttggaaaaaggagggggaaacatgatttcaaaattttcattttttctagtctaatctacatcaaaacgggtcaaaatttaataaaaaataacatttcccggggggaaaaaagggggttgaaaaagtttattgggaaaaaaaaaattttttaaaataattccccccgggaaaaggggagggggaaaaatgattttcaaaattttcaatttttttttaagtttaatttatttaaaaaggggttaaaaatttcaaaaaaaaaaaaaattttcccggggggaaaaaaatggggggtttggaaaaaatttttttttggggaaaaaaaaaaacttttttaaaaaaaaaaaaccccccccgggggaaaaagggagggggaggaaaaactggtttttttaaaaaattttttaatttttttttt

SEQ ID NO: 44523 - DNA, 1098 bp, Heterodera glycines
  misc_feature (1020)..(1020): n is a, c, g, or t
ttattattttaatttaaatatttttcttgcagctttaattttgatgataaatgcataaaaaacaccgatttttagtcgaaaatatttcattttaacgtcactattcaaaaaaaataaaaggtttgggctttcataaataaaatatacgaaagtatatttaacttttcttttaatctatattttgataaatattttggaatttttggatttcttggtttttaaaagaaattccttaacaaaatgcagtgaaaacgaaaaatacactcttaagaattgggcttttcatgctgagtatagggttttatttctatggactaacaactatttaagaattctgaagataaattttttgattaaaatgcgttttttctccgtctctctcctcgtggtgattttcttctttttctttgctgctcccaatttgtcatttggctgtgttaattcggcggtatttaacacaaattcaaaaatacatttaatattttgaagttataaaacttcttgtttttaataccatcaacagttttatttattaaattgttttgctttaaggacaaaggcagcgatgtgacgaactgtcgtggcaaaagagaccttcccgtcgttgacagtaaattttcattcagaaattgggaatttgttgaaactttgagcaatttttaacagaaaatggcataccaaattgacaaaagaattgactgacgacgaagaagaagaactaaagctgtgatgggaacggaaaatgatcaaattgaaagtgaattataaaaattcatttatgcatatgttgaataaactgtcgaagaaaacattttaaattcaaactcttaatattaatttatttttcaagaaattagtctcaaaaatcaatttaaaactttcataataaaatttaaatataaaattagttttagcattccgaaaaataaagaaaaatatttttcggcttctttaattctcattcaaattattatctatttaaatccataattaatagagaccgcaaaaaaaaggcaccanaaatcgcgaaaaaggcactataatagggggtcatggcagttcgtacaatggacagttcgtacaatgggcagttcgtat

SEQ ID NO: 44524 - DNA, 886 bp, Heterodera glycines
  misc_feature (441)..(441): n is a, c, g, or t
  misc_feature (443)..(443): n is a, c, g, or t
tgcttcttcaccggtgactttccgcatttacttgaaatattcgtcaactttaatgggctctgttgtgccattttatctgtccaacgaagtgactggggagcaactgagcctggcaccagacggcataaactatgttttgctcacgcgttgtccaattgtatgggatgataggaactggcaaaatgtggtgcatgaattgcttactccgccgaatccaattcactttttgatcagagacggcggattcgacgaagggtgaacaacttgaaattttgattttgttttggttccaattagactttgagtctaaccaactttttgattagatttgacagaattaggtatggtacaaaaaatggttctatttgcagttcacactaccataaaaaaaagacacgaccataaaatttttttttgcaaatttagtgcgccataactttntncaaggaagcatccagattaaacattcttatgatcattcgatagatctatgaatgctctattagctgcacaattatcaccatcttcacgttataaacccaatttatatgcgagaaaacgatgatgatgtcctctgctttagatctttttgaatgccttggtcgacccgaaaaggtatcagaaccaattggccaattccatcggagtgatcagattgtgagtttttagcggtgtttgtccaaatgataaatggtttctcaacagaggtggcaaaaaggacagtgccggtagtttgggcactccaccttcccccctgccgtccttctgcggtggcacttctcccacaaaatcgtcccccgcaccccataagtaggcaagctccaaactgttcggattcggtgcgcacagttttcatcaataactttgccaacatttaaatcattta

SEQ ID NO: 44525 - DNA, 873 bp, Heterodera glycines
  misc_feature (805)..(805): n is a, c, g, or t
  misc_feature (835)..(835): n is a, c, g, or t
caacatttcaatcggactcaacccaacagcattctaatcactgggactcaacccaacaggatttcaatcactgggactcaacccaacagcattctaatcactgggactcaacccaccaacatttcaatcggactcaacccaccaacatttcaatcactgggactcaacccaacaggatttcaatcactgggactcaacccaccaacatttcaatcactgggactcaacccaacaggatttcaatcactgggactcaacccaccagaattccaatcactggcactcaacccaccagcatttcaatcactgggactcaacccaccaacatttcaatcactgggactcaacccaacaggatttcaatcactgggactcaacccaccaacatttcaatcactgggactcaattctcctgcatttcaatcactggcactcaacccaccaacatttcaatcactgggactcaacccaccagcattccaatcactggcactcaacccaccagcatttcaatcactgggactcaacccaccagcattccaatcactgggactcaacccaccaacatttcaatcggactcaacccaacagcatttcaatcactgggactcaacccaacaggatttcaatcactgggactcaacccaccagaattccaatcactggcactcaacccaccagcatttcaatcactgggactcaacccaccaacatttcaatcactgggactcaacccaacaggatttcaatcactgtgactcaacccaccaacatttcaatcactgtgactcaattctcctgcatntcaatcactggcactcaacccaccagcatntcaatcactgtgactcaacccaccagcattccaatcac

SEQ ID NO: 44526 - DNA, 1128 bp, Heterodera glycines
  misc_feature (30)..(30): n is a, c, g, or t
  misc_feature (47)..(47): n is a, c, g, or t
ttcgtcactaccagtctcaccagaaaattntgtcatcttggagattntattatactaatattcactggaaccaaaatggccctttctctgtccaaaataatttgacaaattatgaaagtaattttcttggttttgttgaaggtttacgacttaatcaaatgattaaagaacccaccagggaatgcaattttttggatttaattttaacaaataataaatttctcagaaaagacatttcagttggtcccccattctcacttagtgatcacaacactgtaaaattcgacttaagactaaatgtttttccttgcagaaaatttaaacattttaactttaaaaaagctagttacttggaaataaatgccatactctcttctactaattgggttgcctttttttcagactgtatagaaattgaccaaatttataacaaattcgcagcatttttacattttttagtatcgaaatatgttccattaacagtatcaaattttaaacataatttcccagaccatattaaaaaattatgatttatcgtcggcaactttggaaagacattaaaaaagaaaaaactagagaaaaatttatagaaacctctaaaaaacttgaatatgaaataaagaaataccttacaaatcgtgaaaataaatttttaagtggtttagaccctaaacaacgatttcgatatattggctcttttttaaaaactaaaaacgcgaaaattccctctcttaaaaataacgaaaacaaaattgccttttccgaaaaagctaaatccaatttattagccgaacaattttattcagtcttcactgatcaaaaaattcctgtttcctgtgaagtcacccctaaaaaaatattgactttttcacaatgacacttaatgaaatttatttggctcttaataaacaagaaaacaataataatacttccattgacagcatcccgaatatttttctcaaaaattgtaaagaaaatttggtttatccgctatttcatattttttgtttttcaatgatgactggccaagtcccaaacatttggaaaaaatcaattatttgtccagtaccgaaaatacccaacccaataaatcctgttgattttcggcccaatttcacttttatgctc

SEQ ID NO: 44527 - DNA, 1001 bp, Heterodera glycines
tttgaatcttgttatttcgattccccacagtgccttcctacgttctgacaatggaagaagtgattgccgtcttccaattccattgccacccgaatctccgcggttggcacggacagtacccaatggaatttccgtgccatggacgcttttccgatcagaaagaaggcatagtttcgctgcaaattgagaaattttcggaatttgcacaagagaaagcatggagtagccgattaagcgaaggaatttacataaaaggattgccatggaaaatttgtgcagaaataaggacgaaaaacaacagcactgaaaagtggctgggctttcatcttttgtgcaccgctccaaaaggtgggaataaaagtccaatttaaatataaaataaataattattttcatttttacaattaaaagatgaaaattggagttgcaaatgttctgcgacctttcgaatagtttcacaaaaaagcggcgtgaaagatgtgacgaaaaaaattgaccactcttttaacaacaaatcttcaattagcggattcactaatttcactttttcggtgaattgcacaataattaaaatgttaaaaattcataattaagcatttaatggacacggacaagggattatatgacaaagacgaggacatagtgaatttggtcatcgatgttaatacggaagagcaaaaggggacgaagcgaaaagtttcgatcgaataaactaaacactcattaactaatttccttaattcaattatataatttgtttgatatatttaaaaaattttcttgttataaaatcgtttttttcgaaatttgtaggattaacctaacaaaacatgttcatttttgagtatgggggaggggtgagttagcggatcaaatgaaacgggacatttacgggtcaattttttccaaaaaaagagcttacaaaggaaggtccccaggtgtccgtgggatttccaaaatgaaattaggttatgttgaattttttaaaaaaattcctaaaa

SEQ ID NO: 44528 - DNA, 1054 bp, Heterodera glycines
  misc_feature (33)..(33): n is a, c, g, or t
cttgttgacgccaaaaataattactagagaagnaacggggtagccgacgcggcattaatctgcaattattaaaaaattttgaaatagcccaaaaccactcgtcttaataacgaaaatatttatcaattgcttttgtttaaagttgacaataatatgaatgcaaataatgtagtcgtatatgcgaaaattctgtagaaagaaaaggtttaaaaataatttatagatgaactcaaatcctcatgtccaacatattaaaaatattcataaataatccttgttgaacgccaaaaataattactagagaagaaacagggtagccgacgcggcattaatctgcaattattaaaaaattttgaaatagcccaaaaccactcgtcttaataacgaaaatatttatcaattgcttttgtttaatattgacaataatatgaatgcaaataatgtaatcgtatatgtgaaaattctgtagaaagaaaaggtttaaaaataatttatagatgaactcaaatcctcatgtccaacatattaaaaatattcataaataatccttgttgaacgccaaaaataattactagagaagaaacagggtagccgacgcggcattaatctgcaattattaaaaattttgaaatagcccaaaaccactcgtcttaataacgaaaatatttatcaattgcttttgtttaatattgacaataatatgaatgcaaataatgtagtcgtatatgcgaaaattctgtagaaagaaaaggtttaaaaataatttatagatgaactcaaatcctcatgtccaacatattaaaaatattcataaataatgcttgttgaacgccaaaaataattactagagaagaaacgcggtagccgacgcggcattaatctgcaattattaaaaaattttgaaatagcccaaaaccactcgtcttaataacgaaaatatttatcaattgcttttgtttaatattgacaataatatgaaatgcaataatgtaatcgtatatgtgaaaatttctgtgaaaagaaaggggttaaaataatttatagatgaactcaa

SEQ ID NO: 44529 - DNA, 536 bp, Heterodera glycines
acttttaggggacccgacacttagggaacccgacatttaggggacccgacacttagggaacccgacttttggggacccgacacttagggaacccgacttttggggacccgacttttggggatcccgacatttggggacccgacttttggggatcccgaaatttggggacccgacttttggggacccgacacttagggaacccgacatttggggacccgacacttagggaacccgacatttggggacccgacttttggggacccgacacttagggaacccgacatttggggatcccgacatttggggacccgacttttggggacccgacacttagggaacccgacatttggggacccgacttttggggacccgacacttagggaacccgacatttggggatcccgacttttggggacccgacttttgagcaaaaggcacttagggaaaccaccgacatttggcgacccgacatttagggacccgacatttagggattttaataaaacaaaaaaaacattaaaaaattaaatttttaa

SEQ ID NO: 44530 - DNA, 1001 bp, Heterodera glycines
  misc_feature (27)..(27): n is a, c, g, or t
  misc_feature (59)..(59): n is a, c, g, or t
cggtatgtaaataggtcgggtggaatntgagcctgatttccaaaaaattcaaatatttnttgcaaaaaaaacaacttctaatttgataatcgattgcttcgagaaatgtacaaatgaattttaattgtatttccgggaaatatacagtgcgatggtaatttattatgaatgaataaatcagtaattagtctactgtatttatgattacggtgtgtggaagaactcaaattctgaattaaatttttaccctaactttttctggacaacgatttttttttataatgcatttgcatcccacagatcgatgcttctttatcagatcaagctgttttttcgattattttatgattttttcaacattttttgtatttcgcatttttacaatttaaagcaaatccctgctaattactaactaattacttttggttgaattttattttattgcatgtttaatttatttctgattttattgggtttcccatgaccttaaataggcacggccggaatattcgggttgaaattgatttttaggctatgttttgaaattcagtttttgcaattattttatgctttttttacgttttttgtatttgactttcagaatttaaagcatatccctgctaattagtaactaattacttttggttgaattttaatttaattttttttgaaatttgccattacctcccttttcgccttcgatgggccaacgatcgcgtggcattggcatttgaccgagtaatggaaagaaaaggggacatgaaaaattgggcacgatttggaagcgacgcgcaaaaagatacgcggaagagatttgaaatgccacggatgcgacacgcgcaaaaaagagcggatgcgacgcgcggtaccattacatcactgttgggtgaactatgtatgtatgtttcccaaacgctaacaaaatgtttgagatattggtacttttccattatgctgccacaccccaaaattttaaaaaaagaaggggaaagcgccagttt

SEQ ID NO: 44531 - DNA, 918 bp, Heterodera glycines
  misc_feature (41)..(41): n is a, c, g, or t
  misc_feature (893)..(894): n is a, c, g, or t
ggcagacacctttgtcgggggcgaaattttcataaaaagtncggaaaaaataaaagaaaaagttccagaacaaaagtcttaaaaactcatttaaagacacttccatctcatttccagtgcaattgacgactttcgtaaaaccccgaaaatgtcggggcgcaaccctattatttttaattaccgcgggctgaactgtacatacattaattagtgcaaatatctcatagttgtatgtatgtttgtccttgcactgttttataaaagcagacattaccattcaccgacagtggcagtggtaggcacaccgaagcattgtcttttccctttatccctaccaaaagcatataagccaaagccagcaaccattttattctttttattgcatttaggtattaaattttttttatatgatttaaattttattatttttggggaacaagttcttttgccaaagaaacgagcacaagataagccacatgaccattcctcattcattgtcagtcattttctctttgtgggctttgggcctaattatttttaaaaagtacttatttgtggtattcagtttcattaaatcagacaattaaggttgttattcgtttgtaacgtggttgttgtacttataattaggaaagaagtctcacaataatgcttcaggttttaatcatttatttgtacgttttaaattctttttcggttttcagtatgttccgtggagacaaatcacattcacgggccggctgttcgacgttggtgaaggcagagcgaccacattgctattcttgctcaaatgcttaatttatatggctttggacattgtcatttgggttgcattgacatttctgagctacaaactgttggtttggactttcttcactccctttgaacgaggnntgtaattctaattaattctttttt

SEQ ID NO: 44532 - DNA, 1160 bp, Heterodera glycines
gagcaatttcaatcctttatgttgctgacagcattgcgatcatctgaggatgcatcgcttcggcaacgcattttgataaagctcgcagcggacaaaaacggcatcacctacgattcaatggtggaagatctgatcaattttcagacgacaattgccgaggccaaattgattgagcagccatccgcatttaaaaatgtgagcgcattgaaaagggggaaggagagggaacaacaacaaatgccatcaaattcgcgttttgccaacaattcacaaaacgcttcaacggcacaacggaaatgctggcgttgtgcaggcgatcaccgggccgacgattgtcgtcacaaattggaaaaatgccccaagtgcaaatttcccggccacatcgcttcacgatgcgaaagcgttcagcaatggcgacgcaaatttgccaaaaagccaattcaacgaaagcaaatcgggagtctcagcgtcggtatggcaaccaaacaaatcaatgccacttcactgctgaaagtcggagttttcgtcaacaaaaagaaaacaaaatttgttgccgacagcggcacggaagtgaacataatcgacgaagacgcctatgacaaaattggccgtccaaaaattcaggaatgcgaagaaaaaggcaaactcttcgacggaacaaaggtcgcattcataggcaaaggagttgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgtaaacatcaattcaagtgcaacatttaaatccaaaaccaccaataccatttattagggaattaaaggccactttctctattgcttttgaggaaggattaggactttgcaccatggaaaaggcacatcttcaactgaaggatggggccacaccaatttacaggaaggcacgaccaatgccacatcattcaaaggaaatcgttgaaaaggaattggacagattggagcagctggggatcatccgtaaagccgaacttttgacttgggctgccccgattttggtggtcaagaaaggagacggatcagcacgattgtgcatcg

SEQ ID NO: 44533 - DNA, 926 bp, Heterodera glycines
cagaattttgaaaattttttataaaaactgatgacaagctaatgtgataaaacaggttaattcttttcctttcagtatccctgcaaagtttggggcgcttctgataagtttctgaaaaaaaagttaagcctacattttttggcatatttaaaaagcaattaaaaaatttttaaaatttaataattttcctgcaccgaaggtactcactcggcctcttcgcggcctcgtggggggcctttttcccggccgtgacactaagttatgaaaattttaagggatcagtgagctacgaaaaattaaccatcttattataatgagaactttttgacatctgtatgcatgttcggatctcactttatccattttataaaccctcaactttttcgaaaaaatgaattttcgtttttcaggaaataaataaaaatgtacaaattttggcttacatatactttttttcagcaagtggtggaggacatgatacagtccattctgcagctgtgcgaggcgccaattgactacgaattcatggacaaactgccggcagtgcaatacggatttccatgtaaggcaaaaacattggcacaccctcaggggtttgtttaattggacccagaaaattatcctcgttttggaaatgctttttcctgacatttcaatttcaggcggttatcggcgcgatttccacgcggaacgtgccaaaattccggaggcgttgttcgacctcaaacacgccacggacatcagcgagacggagcgcgccacactgatgagcgtgtcgcaggtggcgctcacttcctgcaacacttgcgatatcgacatcagaccggtcagcacttaccgaatgcatatttagaatattgggttccagaattttccggtgacaatttgaatgccatgaattggacaaaatagaaaaatttaaaaat

SEQ ID NO: 44534 - DNA, 918 bp, Heterodera glycines
aaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattttggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaaggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacat

SEQ ID NO: 44535 - DNA, 442 bp, Heterodera glycines
taaatgcggtagaaaaaggcgagaagaaagagcagattttccggatcttcgctagccaagaaaaatatttggtaatttaattaattaatattttaatcattttatttattttaattttttaaataatttcaaattccttcagaacccggaagggaagcaaaatgaaacttttatgtgcaggatttattcattggatgtttttcatatgtgaaccctcaaaaattggcattatgtttttttaatttaaaataattttgtttaagttttgctatttcgaggatcgaacataaatacttggaattggatgtatttattaataaacaaaaatcaaattaaaattaaaatttaagggcgacgggtgtttccaatcttacaaattctttgaaagtcgaaggatggaaatacgtcaaatatttcagattgagtatctactttgtttgaa

SEQ ID NO: 44536 - DNA, 1110 bp, Heterodera glycines
gccatgtttgttgtttgctagatctccatttggaccaattaacgctggaataaatttccaaagacaatcgactcaaattttatgaatggcttctcaccaaattgaatctttttgtagttttgaatacccagttttgtcgtgccagtttttgcatcaatgtggagaatcgccctgtcaactcaacagtcattccgttttttgtcgacgcgggcatttggtatttgtcgttattccacggctggtgtcaacgtggcagttcaaaccgaaccgctaatcagcaaagaggtgagtcgaccgtttgaaacaaatgaacatttttttattgttaggtcttgctaaaaatgcgtaaagagacgggatacagctatgtcaagtgtcgaaaggcattggtggcatgtgggggcgagcaaaattatgagcaggcgctgcgatggattaaagaggcggccgtcaaagagggatgggacaaagcggcaaagtgagcgtctaactaatttaaaaacgtcaatctttttcgctactttgtagtacaaatttaaaattatctattttttagattgagcggtcgcaaagcatcacaaggcctaattgggttcgcttcgctttctgacaatgtttctgttctcgttgagctgaactgtgagaccgattttgtggcaagaagtgcagaattcaagaatttggtatttatttaatcctgctattttcaaatggcaaataatcaggtcacagaattggtgaatgccttgcggaactgtgcttcggagttgctgcctttgcctgatgaagcacagaaactaacgctgaagaatattggtgggttgattctatggtttgatgcaaaaaccaacatttccaatttgtgttaagaacatgataaattccgcatgatggatggacgaaccgccgatgaggcgatcgttgccactgtgagtaaagttggcgagaatattcaactcgcccgagcatctgtcatttcttcttcaccagcgaacaaactttttggtcaaacccatccaaaaggtcgtcgtatggtttttatgagtgaaataatttttatttttagaggaatttaatggtgttctactgcgacaatttatttcgttggtg

SEQ ID NO: 44537 - DNA, 1140 bp, Heterodera glycines
gagtcccagtgattgatgctggagggtgagccccagtgatgaaatgcaggagaattggtgccagtgatgggatgctggtggttgagtcccagtgatggaatgctggtggttgagtcccagtgattgaatgctggagggttgagtcctgttgattggaatgttggtgggttgagtcccactgattgaaatgctggtgggttgagtccctttgattggaatgttggtgggttgagtcccagtgattgaatgctggagagttgagtcccagtgattgaatgctggagggttgagtccctttgattggaatgttggtgggttgagtcccagtgattgaatgctggagagttgagtcccagtgattggaatgctggtgggttgagtcccagtgattgaatgctggagggttgagccccagtgattgaaatgcaggagaattgagtgccagtgattggaatgctggtgggttgagtcccagtgattaaaatgctaaaggtgggttgagtcccagtgattggaatgctggagggttgagtcccagtgattgaatgctggtgggttgagtcccagtgattgaatgctggagggttgagccccagtgattgaaatgcaggagaattgagtgccagtgattggaatgctggtgggttgagtcccagtgattggaatgctggtgggttgagtcccagtgattgaatgctggagggttgagtcctgttgattggaatgttggtgggttgagtcccactgattgaaatgctggtgggttgagtccctttgattggaatgttggtgggttgagtcccagtgattgaatgctggagagttgagtcccagtgattgaatgctggagggttgagtccctttgattggaatgttggtgggttgagtcccagtgattgaatgctggagggttgagtccctttgattggaatgttggtgggttgagtcccagtgattgaatgctggagggttgagccccagtgattgaaatgcaggagaattgagtgccagtgattggaatgctggtgggttgagtcccagcgattggaatgctggtgggttgagtcccagtgattgaatgctggagagttgagtcccagtgattggaatgctggagtgttgagtcccagggattgaatg

SEQ ID NO: 44538 - DNA, 1100 bp, Heterodera glycines
  misc_feature (1094)..(1094): n is a, c, g, or t
tttaatttctgcgttggatttttgctccccataattgtttgagtaccccaaacggacacttgaaaaaatcgatttttttgtttttgggcagtccccccaaaccgatgcgcccagatttatggggagaccgaatcctccgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggccgtcccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggccgtccccctaccgatgcgctcagatttatggggagaacgaatccttcgggaatagcttccctatagcctgtactttaatttctgcgttggatttttgctccccataattgtttttccagaaaatctcgcatgaattctcatttttaaattttttatagatttttaaatgtttggatttttttttggcttaccaaaacttcatcgaacctggctctttctattctcattcaaatcgccccaaatttttttttacagcttaattaggccctattaagcttatttccagaaaatctcgcatgaattctcatttttaaattttttatagatttttaaatgtttggatatttttttggcttaccaaaattcatcgaacctggctctttctattctcattcaaatcgccccaaattttttttacagcttaactaggccctattaagcttatttccagaaaatctcgcatgaattctcatttttaaattttttatagagttttaaatgtttggatttttttttggcttaccanaaactt

SEQ ID NO: 44539 - DNA, 822 bp, Heterodera glycines
tttttataattttcataattcatctttttaaaatcttttaaattgtctcaccctgcgtaaaacaattccatacagcgaatgtacgcgtcctgaacattgcaaaaatggatttgcgacaatttaaaaaatgggccaagtttttgggatacaattttttaatttttaatatttaatgtctaatattggcaaataaaaaacccaatttaaatgtgaattgatcaacaacttgcctgaactgcttcctgctccaccagacttgagaagcagctcaatgcgctctgttttcgtcgtcctaccgccagctcaacactgtacatttatgatgaaaatgacaggggatttcaagggcgtagccagacccttggctttgggggggatgaagtcaaaaattcgatttttaggggtgtatttttggttttttaaaatccctaattatggggtgtattttacaaaatttttagccgtttttcgccaaaaaattattatttttgttattttgttctctaattcaaaatatggtaaaataggggtccggcggtgccgataggcgccgccgggaaaatttttgaaaatttgattaaaatttcttgacagattttcactaaaaaatgatcaaattttgtgatttttatcatttttctaatgagaaataagagttttggggcgccgctgagaacagtttttcatcaaattaccaaattttgagattttgggccattttctaaaaaaataggagttttgggggcgcggcggtgccgataggcgccgccggggaaaaaaattggaaattttgatcatttataaacaggttttcactgaaaa

SEQ ID NO: 44540 - DNA, 749 bp, Heterodera glycines
agccaaaatgcatttttatggcctaatttaaggtgctcatttcgaatatatactttatttttgttttcagactttttggaaggtggttacaaatttttgaaaaatcgtctaaatttgagccccggaaaatccagtcaaatttcgaaaattcataactatcttcgtttttggtcaaatttagtggaataaagtttgaaaaatagcaaaaaattaggagaattttatgagatttatttggaatttctatctgccaaaataaaaaagttattccagaatttctggaaaaattcgatttttctgaaaaaaattcctaactcccttctgaaaaagtattttataaaaataatatactcaaaaaatccgcaattttttgctctattttataaattttattttagctttttatcacttttttgaaaaaagttatagaaataaaagtgattttggaatttgggaccacaggggtgtgactatgatttttgagtggaaaatttttttaaccaaaaatcttccaaaaatatgattttaggggttatttgggccgctgatcacgaatagtaatcagattttactttagacatggttaagacctcagaatccccgtgttattggggattctgaggggtgggagcgcccgtcctgaggccgcgaagcggccaaatgttctcaacaaaattaaatgacgggcgcgaagcgcccttcctgaggccgcgaagtggccgaatgtcctcaacaaaattaaatgacgg

SEQ ID NO: 44541 - DNA, 891 bp, Heterodera glycines
aatggctatctatttttttgagaaattttctatgcaacaaacgctctcgaacatgaaacgaagtgcggtgcgccgtggccattttatttttcaaataatttttaaatttaatacatattccagaaaaatggctatctatttttttgagaaattttctatgcaacaaacgctctcgaacatgaaacgaagtgcggtgcgccgtggccattttatttttcaaataatttttaaatttaatacatattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctattttttttcgaaattttctatgcaacaaacgctgtggccattttatttttcaaataatttttaaatttaatacatattccagaaaaatggctctctttttttgagaaattttctatgcaacaaacgctctcgaacatgaaacgaagtgcggtgcgccgtggccattttatttttcaaataatttttaaatttaatacatattccagaaaaatggctatctatttttttgagaaattttctatgcaacaaacgctctcgaacatgaaacgaagtgcggtgcgccgtggccattttatttttcaaataatttttaaatttaatacatattccagaaaaatggcatctctttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaa

SEQ ID NO: 44542 - DNA, 1199 bp, Heterodera glycines
cctggcaggtcctgggtttaatatcaacaatttgtattgcaaatcttttgttatattataataaatggataagaaatttcgtcgagaaaatttctcggcttgtagaaaagttttgaatttttttcttttaagactcgacaaaagtgtccaatttttaccgttttttattccgtctaatattaattttttccccaaatttttactttgagtaatttagttaattagtgtattcagattttaaattagccttttttcattctctaattaaattttcgaattcttttcgtctccccttatggtaggacaaattggcatttaaaaaatgccctcacttccctaatttttttttctgtcaattttcgcctattttaatttaaatcttgccaaaatcccgactctctgtgcctgaaaatcccggcccctgaggcaaaaataagttttttaaaacgtcgaaatttctataaaaaaattcttttcttgttaaaaaggtcaaggacaacaaacacacatcacatcctgctgtctgctgattgaactgatcagataacgcacgcactcaacacatataaataaataataggaagcaatttgcttttctatctatgtccggaaattttattaaaaattcaaaaaatgttttcccaaaatcattttcaaaaattctaaaaatgttttcccaaaatcattttcaaaaattctaaaaatgtttcccaaaattatttttaaaatctaaaaatgatcttttcaaaaattctaaaaatatattgtcagtggtgccgtgccaactgatcttggctaatttttgggggttccctctcttttcttgaccttaattcccgattgattagcaatgcattagcaatgccgtgccaactcattagggctaattaattggccaaatcgccgagactctcgacccaaatagcttttaataacggccaccggcagtaacaaaaggcagaaaattatttggccaaaaccacaccattttaaatagtttgttcttggtccccaccattttcttatcactcattcatttcattgaatttattattttatcagtcacacaatttgtccacacacttttcacttccttcctctcgtcaaaggcgctggaatgtgctcgatcatcgtctgatgatatgataaataatcacaattttctctgtttaaaagtgtacattttgccacaatttccg

SEQ ID NO: 44543 - DNA, 1051 bp, Heterodera glycines
tgtcaaaagtaaaatctgatcacgtattcgtgatcacctgcccaaataacccctaaagacatatttttggaagatttttgtgagaaaaatttttccactcaaaaaccatgtgcacccccctttggacccgaatcacaaaatcacttttatttttatatctttttttaaaaatgtgataaaaatgtgaaataaaatttatattatagagaaaaaaattgcggatttttgtagtattttacttttctcaaatagcttttcagaagcgagttctgaatttttttctgaaaaatctaaaatttccagaatttctggaataacttttttcatattgatgttagaaaacctaaataaatcccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattccaaaaattttgaaacgaaaaataaacatcatattcgtgctcagcacctcaaaatagcccagaaaaatatttttcacaccctttttcgaccccaaaaaaatttttgaaaatttctagggggcctagctcgaaaatttttgaaaattttacatcatgtagtaaaccattcgatagcatttaaaatgctctacaaaaatgttctaagacaatttttcgctaaaatcaacccctgacgagttatgggcccgggactcaaatgtcccgctcaggccaaaatttttttctatttccgggaaaaaatcgaaatttttccgaaaaaaataccaatcgatagagctcgaaaaactatgttttggaagtggtcttcgtttctctgggaaaattcgttaaaaattcttaaaattcaaaaacccgaaaaccgttttttaggcctagctcgaaaaattttgaaaattttcgaaatttttaaatttcagaaaatcgagctttcaaagctctacaataatttcgctggccaccctgcgctcaggtcaaagcctaatgagttat

SEQ ID NO: 44544 - DNA, 952 bp, Heterodera glycines
ccgcacgaacctgtgccgcaggcatgcgttcgtgcggtaagcccgcgcgcggcggcacgcctcaaaggccagttgtcgctttaaaagcaatcaatcatgacgacgatatccccatcactctcgcaccccctcccccccccccaaaaaacccgtgccacaggcacgggttcgcgcggtaaacccgcgcgcggcggcacgcctcaaagggcagctgtcaccaaaaagcaattaatcatgacctcgatatccccctcactctcgcaccccctcccccccccccccaaaaaacccagtgccacaggtcgacgggttctgcgccctgaaaccgcgcgtcgcggttggcacgcactcaaagtagcagcatgtcaccaaaatagcaattaatacatgacgacagatagcgtgtaaactaacgtactcgtggggtactaagagtacgtacgaacatcgagcattgtttttttcggttgccacgcggggcagaggaggtggaggcgtggccatctacttgtcgttatgattgttctgacctccgtggcagaaaggtagctgataaggatagtttggttattcgcgataatttttgatcattaaatcgtattcgttcgacatatacttatgcgagtgtatatatgacatgacacagtgaccaatgccttttttgtattgttttgtccgattgacttcaatgtagaattgaccactgacggattgagcgggagccttttttaaatagcgaccttctagccaattccataccaaaataaattataatacctgctactgccaacacttgagaataggcgaaagctgtatgatctgttcatggtgcataaaattgcttatggacgaacagatctgaaactatgttctatttttcatccatcagcacgctttatcatcaccatttatagatttatcacaaaatacaaactgggcaaaaaaattcatt

SEQ ID NO: 44545 - DNA, 990 bp, Heterodera glycines
tggagttcggtgcaactgacgtggacttatacccctcacggcgactatttgcgcaatttggaccatttggtgagccaagcggaccgattgagagaatcaaattacaggaacaaactgacaatgagagtcatatgcggcgcagtttggtggttcattagtcttaattggctaatccattagccccaattgattcattcccgactttccgcagtatgtgaactctttggacttgttccactccattctgataaccgtaacaatccccgccttttacgcacttttcatcgtcgcttttctgtcgattcaaacggggtcatcagcatcatcaatggtgggagtcatacggcacaaggtaaagaatgggttgtgctaatccaatgactcattgtcagtaccgtaccatgccaataccatagtcatacatggaaagggacaaaaggcggtgccaacttaggatgaacgtaaaatcgaaaaaatctaaattgtaagcaaacatttgaaaaaattagtaaagaaaaccaagagaaaaaatcctataattttcaatgggatgaaattctgagtcataattagtgtctttttctttcctctgtcagatcattttgacaataaaatatacaactttatgcttggtaactttggccataaaaatgtctctgacttaggtggcttaatatttcgctttgtgcccatttcgccaagtgttggcctatcctccgttggtatcgccagggggggggaatcgcatcgcgcgagggttttcgcgaaaaaggaccaaactccgagcgctcataaccgacgtatgaccgtagtaacaacacccatcatcccttaccgtacaccatagacatgtgtccaagtgttggtcatcagttcgacaaatgccggtgtcagtttttgctacgctctgatgggttttatgtccgtcccgcccattttggtcgttattttgggcacttggctttggctgttcctcccatggtgatgtat

SEQ ID NO: 44546 - DNA, 1255 bp, Heterodera glycines
tctctgcccatagttctccggtctgtttgccaaatgcgggaagaatggcttgtcctgcacgtcaagcccataggaaggaatgagagcagccagtgaacagggcatcaaattgaaagagtcccggaagattacatttggattgcgctgcttttgtttgcgtattttcatttcatacattttgttcccctgaaactttaaatatatgttaaaattttaaaaatgtatacccgtcgcaacatctcgggattaaagccaatcctgaacagctcgcggaagacgagcaccatgtcgaagcgaccaccaaagtgtgaataggcataagtttcgtatttctttggcagtttgtagacgagccaatccacaaatgcctccagtgggttttcgcccactatttgtttgtcaacaatagtatccgcaaaacggcgctggcagaaagcgaccatgcgatgcggaccgcagatttgacagcctgctgtccctcttctccaattgccgttttcaatacagccggggcaagcaattcgagcagcgatgaagtttggctgatgttctcttttctccggctggagcgggtccaacgcatggtgttgcattgtctccaagtcgaagaccacaatacgataaggatcaatttccctgtgctcaattagttgaatataaaagatctgcattttttaaattcttcattttctccgagattttcatgtggttttaattcattatgcatttattaatttaaattttaatcggagaataaaaaaataaaacttgagaagctatttaaattatctcaaagaaaaagataatatatattcttgtaataactctaatttattgactttcttaaattttattttaaatgtttaaataatcaagttatatttgaatttttcacaatttattactgtgcgcatttaaacggtatatttttattttaaagataaataaatacctttggaactttacattttaatattaaaatataactacaatcaatttcataaaaaaacgttttattttttaatacctttggaactaaattttattaaattcttctcgcaattttccaaaaagaaaaatcgccgaattgcagcaaaaaagattttaaagaaaagaaactaataaatatcataaaaaaatattttatagtataaaattggacttaaaatattttgtaaaaattataattatttaaaaaatataattataagtatcatgattttaataatagaaaatttaaagaattttgactatt

SEQ ID NO: 44547 - DNA, 1028 bp, Heterodera glycines
ttttaaaaattttttaattcctttttaaaacagcccaaaaagtttaggcttatattttaaaaaagtttcatcgaacctagcgcactaaaatcgatataatctctccaaattttgcaggctttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgct

SEQ ID NO: 44548 - DNA, 274 bp, Heterodera glycines
gaagaggtgagaaaaataaagaaggaaatagtgcactgtctgactgtctggttacgcttttgaaaaaatttgacccaaaagggggacccaaactccattagtaccacttatattttgtttttcaacttcttgttcatattcgggcccggggttcggaattgggcaaatccgagcagattcataatcagcaccctcgagaaaccccggaaactgaattttagtccaaaataaaaaagttaaaatagggaccacaattctttaccattgcccaaat

SEQ ID NO: 44549 - DNA, 877 bp, Heterodera glycines
attcctatcactactcttttttgttatgtatatcaatgatttataaaatattttagtctaaatcaattaatattcttaaaattaaaaatgaacaatcgtctatctttaaaccccaatgattttccgaacacgatggagtttgtcttgttcaatgccgttcagcagggcaatgtcgacaaccctgatattgaacgactcctggagcgccttagaaatcgccaaccgcctccgtctccattcaagaacgaccgactcctgtgggatgtattcgatgacccggaaatagccaacgcaccacaaatgacaattaaagtaatatcggcgttttaaattataatttaattgtgaaatcagtaaaaatttcattttaaagggaaagttttcaaaatatttaacttttcacctatttttaaaatagtcctttcattttgttgttttaattaggcagagcggtatcagcatgggtactgtttccgtctgattattttaaaagttaaaaagtagtgttaataaaaattatcaattttggtcattgttttggatgatttaagacatttttacaaattctccaaaaatttagaccccagagaattaccgcctttacttggtaccgtactggttgaaaatattggtactgatatcaataccgatttttgcgatacctgtcaataccgttaccggttaaaatgaaaattatagctatcgttccatatttttttaccggactgttggaggcctgaaacgcatgaacaacatgtttttagcttggtttgaagcttctaggatgggtttctatatccatattttccatatttcgcgatttatgtccatatttccatattttggcatttttatccatattttatgcccatatttt

SEQ ID NO: 44550 - DNA, 903 bp, Heterodera glycines
  misc_feature (864)..(864): n is a, c, g, or t
  misc_feature (870)..(870): n is a, c, g, or t
  misc_feature (892)..(892): n is a, c, g, or t
tgctccccataattgtttgagtaccccaaatggacacttgaaaaaatcgatttttttgttttcggggcagtccccccgaaccgatgcgcccagatttatggggagaccgaatccttcgggaatagcttccctatagcccgtactttaattctgcgttggattttcggctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataanattttntaaaatttttaattcattttanacaggccaaaa

SEQ ID NO: 44551 - DNA, 1802 bp, Heterodera glycines
gaggtttccgtcctctctgagctcgccttaggacaccttcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaaagggcgtgtggagcgcacgagacacccacaggaaccgcggtgctttaacggcgcaacatccctatctccagctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccgagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaa

SEQ ID NO: 44552 - DNA, 1089 bp, Heterodera glycines
  misc_feature (34)..(34): n is a, c, g, or t
  misc_feature (987)..(987): n is a, c, g, or t
taattcataaatatttttagaacgtgctctgaancgcaccaattttatttgcaagttattttaggcactcagatgctttcactatcaaaaagggagatgaataaaaaatctaaaaatttttaattgctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataagtattttttagaaagtgctctgaaacgcaccaaatgttaattaaaagttaaataaggctctctgatgctttttctatcaaaagggagatgaataaaaattttaaaaatttttaattcctttttaaacaggccaaaaagtttaggcttatattttaaaaagtttcatcgaacctagcgcactaaaatcgatataatctctccaaatcttgcaggccttctccattgtaaaggactaacttaacctgaaaaaatgccaacgcttgttgtttttaaaatatttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaatttttaaaaattttaattgctttttaaataagccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaatttttcgaaattctgactttttcattaattatttanttatttgcaaaaataattcataaatattttttagaacgtgctctgaaacgcaccaatgttaattaaaagtaaataaggctctctgatgccttcactatcaaa

SEQ ID NO: 44553 - DNA, 1026 bp, Heterodera glycines
atatattttcttgaatttcttcccattttgggttacatgtcatcgtaataaataaatcgggtttgccaaatcttcgaacaattgacattgcatcttgaaagtgtttttcaatataacgtggtgatccaacaacagtagctggtaaaataattttgcgtcaattggaagtcctgtttcttgggattttttaagtaaaaaactatcaacatttttataagaatctgctaaaatctttttttggttatttctaatccatcttattctatcaccttcgatcttaacatactcgtcaacacaccattgctgaaataattttgctccataaagaagaggattaaattcgtttctcacagcaatacaataacttgcatactgtaatctcgtcaaatttttaattccatttttctgtttcatttcgggatgccaccctgttgtccctctcggaaaaaacaaagggtagcacattggtgtaacatttttgtcaagactattcaaaactcttaattcttttcctttttctctgactacaattttcgattctggtacttctccgtcagctccaggcacaaaaacaacggctacttcatttgctctaggcaatttatatctatttttatccatatctggcgacaacccaaataataatttaagttccgctggttctcttccttcttctttagctttttctttttcatattcttcttcatctttcatcattataaatgcttgtgcaaaaggattttcagatttgatcaaactataaatagagttaagcaaatcgtcgtctatttttgggtttgattttctcaaaaaattcatagcttcaccagtgtcaatgataaacaattggccatttgatggtaactcatcagaatcagggttaagtgcgatttttattttatctaagatttgtccaaaaatacggaaacaatatggcccacggttatgcttaaattgatatcgcattggattcatagaagccattgaaacactgctatttaaatatcgaatattttcaaaagacat

SEQ ID NO: 44554 - DNA, 1861 bp, Heterodera glycines
  misc_feature (881)..(881): n is a, c, g, or t
cagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgntacgacttttgcccggttcaagccactgcgattaaatcggttccagtctgcataccgaccgaagccgggaacactaaccgtcccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaa

SEQ ID NO: 44555 - DNA, 168 bp, Heterodera glycines
ttaattattaataatttgtttacgaacaatccttaacagaattcgcaatttaatattaattaattttcgttcctttcattcctgaggaaatgcacttttccttttcaaacaattttccgttattcatttcaaaaggttttttcatttttatgtaattatattttcgat

SEQ ID NO: 44556 - DNA, 1106 bp, Heterodera glycines
ataattttcaagattaaaaaaatatatatattttgtggcgataaacattagtccgtattcaacgaccccaaaaaagtgtgtttcacgactgtaaataatgccgaaatgtccgtaaataaaaccaccaaatttagagttaaaccggctaatcagtgacagaatttccatttttctcccaaaatttcccatggcgattcacctgtcccgtgtgcgtcagctcgtcaaactccgccggccgctgggccatttctttggggctcggcactggcacatttttctgctcgtcaccgcccttccaccgccgtgccattgcgccggtggcgccgcgcattcgcaaaactgcggcacttttggatgatgaaaacatagtgattgctttttggcaaataaaaatgtaaattaggaacaaaaaaaaaaggaagaaaaatagcgtaattgagaaaaacggtaatattaaagtaattagcatgcctttttaaaacatttttaaatgactcaaaaataaatatgagcaaataaaaaataaattcagcggacgagagaagagagaatgcatattattgaggagaataaaggacatagccataggccaattttttacttccgataggagccccaaaaacccccgaggggatgccttttttatgttcaaattatttattttatgaaaatgaggaggggaggattttagccgaaatatgaaaatttctcgaaaatttttagttttcaaaaatttgttttctttcgagtatgcattttggattttttttaacattgctatgcccttgtacagagaggagagagagagagaggagcatcatattgtgagtgattgtttagtctaaataatcacacggggcgacaaaaacaaaacaaatatttttgggccattaaaaatgatggcgacaacaaaaaatgaatagagagagagaggagaatgggcagcttattcagtgctgcgtccatttgatggtcttcaggtcgacgccctcctgcaccatttcccacagcggcgacatttcgcgcagacggagcgcgtcccggacacacttttgcaccacgtagtcaacctcctaagggagtggggcatcataaaagtgtggaac

SEQ ID NO: 44557 - DNA, 1017 bp, Heterodera glycines
  misc_feature (941)..(941): n is a, c, g, or t
ttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggccccgaaatcatttttagagcataacaactgatgacagccactgtcattgtttccaagagatttctattacagatttgccaaaaagagatagccatttttttggaccgtcatacgtcacatatactgcaacgncccgaaatcattttagagcataacactgatgacagcactgtcattgttcaaaagagatttctattaccagattgcc

SEQ ID NO: 44558 - DNA, 1557 bp, Heterodera glycines
  misc_feature (78)..(78): n is a, c, g, or t
  misc_feature (117)..(117): n is a, c, g, or t
  misc_feature (1455)..(1455): n is a, c, g, or t
  misc_feature (1485)..(1485): n is a, c, g, or t
  misc_feature (1513)..(1513): n is a, c, g, or t
cctttaaataattattttttgttttttatataaaaaatagttaaaataaattaaaatcagttctttatacttattttntacggctcttattttttcaagcgcgttgtctaattattntcattaattattcgctcattttgcctgattgattttgtcggagattaaattagccagttatcttatccattttgttaaaatatcctcttggccttgctgattcatctaaccttttaattggccttccactgtttataattccttcatttaaatacgaaaatttaaaaagttttatttatttaattgcactcccatttttaacgaatggctgcgaatgaatttattatagcgttaaggtttttgacaaacaagaaatttgctgtcgattatttttttaaataaattaaattgttaacttaattttatatttttatttttgtaatataaatatgttttttttaaactcttggctctgttccgctccttttgttaagatctaatcgtatatgtttatcttaaatctgaattattttaaatataagaaggcactaattgaattattttaacaaattacatcatcaatcggatgtctatgcatttatttaagttaacatcagaaatttttatttcaattttaatttacatagatattttgacattgaatttgtattttttggtatcaatcatttttcttgcataattttattttattgctttttaattttttgttttcttattttaataattcaacaaagttataaatatctttgctcgttttggttgtaataacaagttgaaactgtcattttaaatctcggcgctctttaaaagacgattaataattaaaatttttgtaattttaaaatccagtttaatcattttataaaaataagttcatttgaactcttggttttattatataataggttttgtatttttttgcatgttttcgttttcgaatacttggataatcaatttcaattagattactttatttattttttgattttaaatttatatgatattaaatattcttcttcataaatattaaatatttctctatataaaagactccttgtatagtatttaatattatttattttcgattttttattaatttaatttttaaattttgttttgaaataatattttcctttcctaaacaattgttttttataaattctcatgtcaaaccaactccccttctgtttactgacgtttttccaagagaagtttttttttaaatttctatcataattcatatatttgtttttttaaataaatgttcgccttattgcgattgcaattataaatcaacatgcgtttcgcaatgattttatagattaaaaatttaaaatgattatctaaaattattataaagaaaagaaaattttgtggaaaagaactattttgtataaattattatttatctaatttttgttattgatacttatttanaaatggatttgccaatttaatttatattgngtaatttttttttaatgtgaattgcggncatttgtcatttttcatataaaacaattaattttttttttttgt

SEQ ID NO: 44559 - DNA, 1252 bp, Heterodera glycines
  misc_feature (30)..(30): n is a, c, g, or t
caaaataggcttagatcacatttgatattntataattaattttgatatatcatttttgaaaaaaatcgattttttagggatacattttcaaaaaaaatttttaaattttttacaaaaaatttctataaattctcaaaaatcctcaaaatatgtaaaaaaatgaaaaatatttacgaaaaattgcgaaatatgtacgaaaaagtccaaaatatatacatatttaatatgtaagaaaatcccgaaatatgtaaaaatatgtaaataaaagtcccaacttttgttcgcaaacacaaaaaagaaagtgtttttcctactatttagagcatggagaaaccaagaaaaaaatatgtattacataaaattagcagccttttctttcatttattatttggctatagacactttttctattaataaaatatttgtccgaattcgtaccctttaattaatttctttaagcgactatcgatgagctccatcattcctttctgtcctaattgtccttcttaaatcatccaatttcatcccaatttagcatatccggcacctaattaacgcctttgactttttggcctcggttgggaaaacgcccattcttatgcgcatcgcctccccctcctccaccattcgggcaatttgttactttttgaagagagcagcaaatgcttgagtgccaatccctaggcgtccaaacatttctgggaattattaagtaaaaaaaagtgcctttcccacaatttgtctacttgtgccacagaggaatggataaataaatggatgtgtgtgtggcgtgccgttgtcgtgcaaaaatgaatgtgtgtccctgagtattttttgacaaattaatgtcaacatcataatgaatgaggaatgatggaggatgtctttgtacttttaatgacattggcgccgtaaggccataatcaattttttttaaataaagaattataaactcaattttaaaatataaatatttatttacttttatcagttcaacttcaaaattgaaattttttatcgtaattgaatatttattaaattgcttattttattttttaacggaaaattcggggtcaataatcctctccattctttaaaaataaaaacaatagcattaaataccgagaaataataataaaaaacttcctgaatggggcggccagcaacgcaaacgcgtaaaaattataattataaatgacaccgcgagaaaaatagccccaagcagattgcctgagggcatttgtaaaaataa

SEQ ID NO: 44560 - DNA, 866 bp, Heterodera glycines
  misc_feature (782)..(782): n is a, c, g, or t
tccccaaaagtagttattttttcttctaattttcaaaattatctccctctttcgcgtgggaattcaatcacaattttaacaattaaaatgagaaaatattgttatttttggactaaatttgttcacaaagtgcactaaaaatttcaaaaatttaccccggcggcgcctatcggcaccgccggcacccaaaaccttatttttataaaaagttggctcaaaaccacaaaaatttggacattttttggactaaatctgttaagaaattgcattaaaattataaaaattttccccggcgatacccatccgcaccggtgtagcccctcccctcgcacttcacactggtcatgaggagaaatgcgcccgaagaaggtggcaaagaacggtttgtttgtgtccccaatgggcaattccaccatggtatatcttgttgctcccagcaaatattcaagtgagatccgtgaaaactgaatagaataagggatccacgtgagcaccaatagaatgtgggacaacctatcctaaagcaccggttaacgacgtaccactctacgaatgacgactttatctgtgcttgcgcaatgggcccatccggatgccgaaaggaaacagaccaacattcacacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtnaagcaccgcggttcctgtggtgtctcgtgcgctccacacggcccttgaaaatgcgagggaagctatttgaatctcctgcctgat

SEQ ID NO: 44561 - DNA, 1143 bp, Heterodera glycines
agcttgactgtgccaattaacaacaaatgcccggaatgcgatgtgaaccatgttgatctgaccattgatgctttcaactatttggagccacgcggtggcgaagttggcaaagcgaccggtcagaaaatttaatgctttgttgatcaatatttatccaaattaaaacaatttattcaaatgcgtaagaacctaattccctgggggataattaattaattacagcgctaattacttgcaattttttaattgtgtgctaattacttcgtttaggcgccacgctcacttacatgaaatgtccgtccaatattaaagcttgttgaataatgtgttggcattggctggcggatggaagcgagtaaaaaacaaatgcattaattattaactaatttgaatttttacatggaatattgacggtattaatttcacacccatatatgaatttatgtgatcggaaagtttttttttttttaaatcactcgaaaattttacaaatgattgataattggtcccggagagcttagagctgggctggaaaacattaaatagataaatgaaatgtaaaatttttaaatacataaataattggcggtgtcaatagctcattaaataaatgttagctgcgtatattttaatagatccaaaatttgtcaacgtataattataatttttatcccgaaaactctttttactcagttcattagtaatttgacaaattttaagcacaaattaatccaaatttttcacaaaatttcctagcggcgcctgcttatctgtgtaaaacggcaggagcctaattccctaaaaaaaaaattttccaacattgcattcaaaaatcccgtttaactgacaatattgtaaaaattaatttgattaaatatttctagcattaattgttaaaaataatagaaatcaacaaattcttctatgtgtataaaaaatctccgatcactaaaacagaaagggcgagtcgatcacaccgttgcccttcccggcacctccttcatcggaatcggacggttttgtgcgcatctaaaaatttaaaaatattatttttatttaaaatttaattaaaattattttaaaaaactcaccatatgcccatcgcccatattctgcagcactttcatttcattcacattgccc

SEQ ID NO: 44562 - DNA, 1029 bp, Heterodera glycines
  misc_feature (899)..(899): n is a, c, g, or t
  misc_feature (941)..(941): n is a, c, g, or t
  misc_feature (961)..(961): n is a, c, g, or t
cgaggaggagcagaagcgttacgttttcgagcaccaggacaagccgcgtttcatctacatcagcgaagaaggagaccaaattgagttcaagggaattgtcaagcagtttggatacgtcctaagcgttgagactatctacttcgacaaagaaaagggaattgatgaattctataacttcctccgtaacaatgtcatgtgtttcttcagtgttgattcataaagtgctttgaaatgttcaattatttcgcgtactgtttactgtacaaatatttcatactttaattttcctcaatcttattttacgatttttattgaaaaaaatgaccgtcacatccaacaccgaattccgactcatcgaatgtgtgccaatcctcgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaacatgtttcatattttattgctattttaggtgaagggtttcttaaggcaagaggacggcacgagccaaaaagtggtcaacgaatattatgaaaaatatgatggactaaacggatttactgaatttcttcggaattgggcttttaactttttctgtttacatgcctttgatgatgatgacgacacatctgatgaacactaatttcgttaatatttattgtatgctcttggttacaaatcgataaacaaacgcatcagggttatttgaacgatttaaaatttgcataacattttcgaaacccaatccgacggacataaaataaacganagtaattacatagtgaccacaaacattggacaacaccgattngaaccgcgtcttattatagntaatgtttttaaaattatcgataaatatttttttgatcatctgataggcatctctccatatgagtcaa

SEQ ID NO: 44563 - DNA, 951 bp, Heterodera glycines
cccccccccccaaacgaaaatttaaaaattttatggcaattttcgtaacaaatagcactcaaatgttcaaaatttttcccggcggcgcctatcggcaccgccggacctccattttgcactatttttacatgttttttgccgtaaaacggccaaaattgggtcatttttagtgaaaaagtggagtttttacccagcagcgggacaaaaaagttttttattggttaaatagcaaaaaaaaacaaggtctcaggtcgggcccccccccatcgggaaatgtttttatgtttttctagataacgtgccggggccgaactgagcggttccgagatgattctatagcgccaaaaatgccattttttaaaaatgtctccattcctctcaatggctctgaaaagaattttcatttttttatcactttttgacgctgtgcacaaacaaaagattgcgggcactagcggagaatgtctgaaaatttattgcattttattaccagatgatactatagccaaaattggcatttttttttaatttccacgttcctctccacaatggcgtgccgtaaaattctcccattctcggcgccaatttgttgaagaaaaaaaaacattttttagcatccccaaagcattgtgttgagcggcaagaagatcagccaggacgtatccgccgcatcggatcagcagcagcaactgcaacagccaagcacttccggcgctggtggccatggccacccatcggaccaactccgttcggcactcaaatacccctcacgggcactgctacaacagcatcatcgacaacaaattgagccacaacaacagcagcagcggtcgtcgtccacgacggcatggcaaaaagtaaaggacgagggggtacagcggtgggcagtctaagtccgtcaattcgagtgcattttgagacagagatattgcccgagacgcacaagtctga

SEQ ID NO: 44564 - DNA, 1304 bp, Heterodera glycines
  misc_feature (17)..(17): n is a, c, g, or t
  misc_feature (1214)..(1214): n is a, c, g, or t
  misc_feature (1225)..(1226): n is a, c, g, or t
cagcaaattttaataanaataaatacttttcaattcatgcaatgaatttcctgaatctataaattgatccactagaaaagtgttagtagaaaataaaaaataattggagcccatattttcgtcataaattaagtcccgaaagataaatagcatggcaaaacttgaaaatatttgtcgatttattgcctattttccatccatgtttgggataaggaaatatataaaaagataaactttgtataagtatttattatcatggaagtcgtcagaataatatcaaaagacttcgtagaaacaatattgcaataatttaagttcgttttatttttcagtcaacaacacggccgagagaaattttgatacatcaaagacaaacctaaaatacacagcggtgagagccctagcgaaggctggactataaaattgcacaacaaatatacctactgttcgagttatgttttatacgagtcagatataagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatacaaaacagataagactttgtataatatggcaaggttgtggaagtcctcccaaaaactttcttacggaaaataagcagcaaattttaataaaaataaatacttttcaattcatgcaagaaatttcttgaatctataaattgatataatagaaaagacttcgtataaacaatattgcaataatttaagttcgttttatttttcgtcaacaacagagtcccgagagaaattttgatacatcaaagacacacctaaaatacaccgcggtgagagccctagcgatggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatggcatgaattnccctgatctanntaatgatccactagaaaagtggtagtagaaataaaaaataattggagcccatattttcgtcataaatgaagtcccgaa

SEQ ID NO: 44565 - DNA, 838 bp, Heterodera glycines
ataagatacatttataaattgtgtgagaacataaacaaatattgtgccaaatccttcctgttcttggtcgtgctctttcgtggtgaacaaaatttagtatgttaccgtaaatgactgtttcgcttaacagctgatccattcaattgctttgacggcttacataaatttttaatcatgattgagtatgcccttacccaacggttaaagggtagagtcaattgtgcaatgtattatatataccatctttattcattgatagtgtacaatttaaattaacatgttttctgtgcctagtgagtacaattttttgttgtgccggtggacaacacaataaaatatttttattgaagaaaatggaaaaataaaatacaaatatttgatcggaggaatgtagcaaaaataggagggaaaacaatgcgaaggcaaattggaaagaatgaattggggaaatgagtggaaggaattaatggggaggggaacaaatcaatatttggtccgttcaaagaacgaacccaatgacaacaatatttgaattatgggtcgccccaacacctccccttttaagtctactgatcggccctgaaatcgatcacacacgggatgatttatttgggcccaatcgcagatgatcatccggccctcgatggcataagtgaattgcgccaatttgcgggagattactgccgggatgattttccttcaaattgtctggcttattggcacgaaattttccatgcgatttgtccttaaaatgagtgttggaattttgccgaatttggttgatttttccggggctccaggccgctgatttgtgtcgtcgactgaagatctctccaat

SEQ ID NO: 44566 - DNA, 989 bp, Heterodera glycines
aaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaacgtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataataccccctgggagaagggagtgggaaacatgatttcaaaatttttcattttttctagtctatctactc

SEQ ID NO: 44567 - DNA, 332 bp, Heterodera glycines
  misc_feature (41)..(41): n is a, c, g, or t
attactccgccgaggcaaaaaattttttaagaaaaattttnttcttcaaactctaatttttgaaaaagatttttgaaattttttcttggctgagttttgtcctgctgcggagttgtagcccatcccaaaaagatatcattgaccccgtcggatttgggtctccgttttcgcagagtttggccaagccaggagggacctgagttttttttttgtcgttggtttgtccacggggttggaattccggtccaccgagtcgtttttgcttggatttttttgttttaaacttttaagtggaattttcttagctaaaaatttatctatttgtgaagaaa

SEQ ID NO: 44568 - DNA, 928 bp, Heterodera glycines
atcactgttgtacctcttttaatcacttcttctcctcttttaatcaccgttatacttcttttaatcatttttgtaactcttctaatcacatttgacctcttctaataactgttggacctcttctgatcactgttgttcctcttctaatcacagttgtacctcttccaacacatcttccaacaatttttgtacctcttatgagctcaacaacatttaaatacgggcgcgaagcgcccgtccaagttcaacaaaatttagaaacgggcgcgaagcgcccgtccaaggccaacaaaatttgaaaaacgggcgcgaagcgcccgactgaggccgcgaagcggcctaataagctaaaaaacgggcgcgaagcgcccgtcttgagcctcgacgtggactaaaaacccataataatttttataaaaattcaaaaaatctccaaccaattcgatcaatttgaatcgcttcacagcctaggtagcgaagctcccaaagcgcgcaagcgctttttcccagcgaaatagccgacggttcacgcaccgctagttacattatgttaaattggtttgtggaataacagttgtcggaagtcgatgattcattgggaaaatgctagaattgtataataaattaaaaaaacaaattaaaaaattacgtttatcatgtttaataaataatattacattttttaaatttgtgaatttagattttaaataatcataatataatttaaaaaagattcaaaagatcatgtcaaaaattagagcttaacaaatatttaaaacatatatactaaattttttattaaaaatcttttattcgtaaaataaataagtgctgcaattcgtatatatttaaccctattttttaagagcgacactaaattctaagaacgataaaaattgtctaaaatttacattttcatcccaatttt

SEQ ID NO: 44569 - DNA, 769 bp, Heterodera glycines
atttctctattgattctaaatgtccaaagtgattttttatccttataaccaaaattgttagcatttacgaatttgatgttttttgtgtgttagagatgtgaaaatagtacgccaaaaagagagaaaaagtaatgcattttcatgttttatatatatcttttgaaaaatagtataaaacataaaatggctgtattacattatgcagaatttttttctcgatcagtatgcaaaatttggtatagatttaacatatagaaaaaaagttaaacgtagcgaagtaaatgttgttttttacataattaaaatgaagagatagtacgccaaagtgagagaaaatacaaagaaaaagagaaacgacgagatagtactaggcttttctctgcacagtggggcgtacccatagtgcatttggggacactgatcatactgatcacgaatcaggcatccatttcaaccaattccgcaccttgggccaagattcgaaccaaaagtcgagaattcaaatttctcgagtttcgcatttttgtctatgatgattcagtttgtttcagaaaatccaaaccgattttcaaccaaaaatgcgaaactcgaaaaattttaaatttcactttctgttcgaattccggcccggaagttcgaaatttgtcaaaatggacgccatttcacattactctcttttcttcatttgctgttgatgctgttccgttccacttccattctctttcagcgcctttttgctgaaactcacctctctgtgctgctgttctgt

SEQ ID NO: 44570 - DNA, 996 bp, Heterodera glycines
tttagtgcgctaggttcgatgaaactttttaaaatataagcctaaactttttcgcctgttaaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatattgaaagcatctgagtgcctaaaataacttgtaaataaaatttgatgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgataagtttataaaaaaaagttaagcctaaaatttttcgcatatttaaaaagcaattaaaaatttttagattttttattcatctccctttttgatattgaaagcatctgagtgcctaaaataacttgtaattaaaatttgatgcgtttcagagcagtttaggaaaaaatatttatgaattaattttgctaaaaaaataa

SEQ ID NO: 44571 - DNA, 1509 bp, Heterodera glycines
  misc_feature (63)..(63): n is a, c, g, or t
  misc_feature (93)..(93): n is a, c, g, or t
caaaaaccccgaaaatgggcaaaacaggcattataaaagtcattgtagacgacaccgcaaccnaagcggaaaacgcgttttttgtgcttatcntgagcgtatcaagtgcgcaaacattttagacatttgcctaaaaaagaatccctagtcattatttaaatgaaaaacaaaatgacgaaaattaatgaacaaatgtgcaaaaaaaaggttccaaaaaaggacttccgcgagtcgaaaaaaaatattggattggaattcgggtcgagacgaccaaaaaacttggttgcgagaaaaatgtcgggtttcgagatttgagggtctaacctggcccagtcccaaaaaattaacttttgataattttcaaaacttataattaaatttgtttactcaaataatgaaaaaataatttttttttttggggtagtaaaaaaattttggtgggcactccctttagtttttattccaaaccctaaccaaaaaatgcgtaggaaaaccagtttattgattagaaaaaaaaattcaagaaattcctaaggcttaggcctctctcacccccgtccggcaagtcgtccccgtaaaagcggtagttgcgcggcgctccgccttcatttttgacgtcacaaaacactttgcatgccctctggggaaagcgggtcagctgactgccggtgccggtcagctcggggtcctggcgaacgcgttggtgctccgtgcattttgccgaaatgtactggacagttgttgtttgttatcattagtaattagccaatttgctaatgacccacacttttcataatgagccaactcgctaatgacccaaacatttataataagtcaattcgctaatggcccaaatatttattatgagccatttgttaataaataacccacacattccctaatgaatcaattggctaatgagccatttgctatgagccaggctaatgaccactaatgatcgaaccgttaatggaataaactcgctaattaaccaatttacaaaatgacccaatcgtgctaacgaatgaagagacttatcacgaataaattaatccgtgataaattttcttgctttcccaaaggactaaactcatttatgacctgtctcatcaatggcatttcaaatatccattattaaattcagtgatatagccgaaaaagtatttcggcaatttcacgagtggcgtcattgaccctaattggtccacctggttgaccgactggcgctcctgcgggcatttgcgcgaacagacggcggcacgatgcgcaggcccactgcactcggcacctccgttctgtggtgccggattggagcagttccgttcggaaagtgtctgtgccaaaggacaaaaaagttattttaaaaatccgcatgcatcccgaaataaaaggatttttattgtgataaatttgaaaatcctaagcaattaataatttttggcggggatcgtatcccaattattttgtttttaatcttcgaaatttttaaaaaaatcttaggaacttttc

SEQ ID NO: 44572 - DNA, 977 bp, Heterodera glycines
ccgaaaatattgctccaattgacatttctcgcccttttaagcgcaaatggggacttattttgtaattctcccgtaccgttttcaattctcacaaagatgccagttttcgagaattttgaaattccagcactacatgccgaaaatattgctccaattgacatttctcgcccttttaagcgcaaatggggacttattttgtaattctcccgtaccgttttcaattctcacaaagatgccagttttcgagaattttgaaattccagcactacatgccgaaaatattgctccaattgacatttctcgcccttttaagcgcaaatggggacttattttgtaattctcccgtaccgttttcacttctcactaagatgccagttttcgagaattctgaaattccagcactacatgccgaaaatattgctccaattgacatttctcgcccttttaagcgcaaatggggaattattttgtaattctcccgtaccgttttcagttctcactaagatgccagttttcgagaattctgaaattccagcactacatgccgaaaatattgctccaattgacatttctcgcccttttaagcgcaaatggggacttattttgtaattctcccgtaccgttttcaattctcacaaagatgccagttttcgagaattttgaaattccagcactacatgccgaaaatattgctccaattgacatttctcgcccttttaagcgcaaatggggacttattttgtaattctcccgtaccgttttcaattctcactaagatgccagttttcgagaattctgaaattccagcactacatgccgaaaatattgctccaattgacatttctcgcccttttaagcgcaaatggggacttattttgtaattctcccgtaccgctttcattctcacaaagatgccagttttcgagaattttgaaattccagcactacatggccgaaaatattgctccacttgacat

SEQ ID NO: 44573 - DNA, 1775 bp, Heterodera glycines
  misc_feature (1632)..(1632): n is a, c, g, or t
  misc_feature (1687)..(1687): n is a, c, g, or t
  misc_feature (1697)..(1697): n is a, c, g, or t
tgggcgcatcggtcggggggactgcccgaaaacaaaaaatcgttttttcaagtgccgtttgggtactcaaacaatatgggagcaaaatccaacgcagaataaagtacaggctatagggaagctattcccgaaggattcggtctccccataaatctgggcgcatcggtcgggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaatccaacgcagaattnagtacaggctatagggaagctattccggaaaggatcggtctccccataaatctgngcgcatcggntcggggggactgcccccgaaaacaaaaaaatcgattttttttcagtgtcccgtttggggtactcaaacaattatgggg

SEQ ID NO: 44574 - DNA, 1296 bp, Heterodera glycines
aaattgaacatcctcattggctagtctctctcttttttgtggtcctttctcagcttcagatacgtgtctatttccaatatctttacgtttaatatgctcacccaaagcctcattaagcctattcactattccgatataacccttttccgatttatcattatattcctcgagagttgttgaatatttgctttttgcctgtttggctattccctttgcgacgtcggctgatttctttgcttctttcaagtcattcttttccacatgctctaatgttgtgtttttggctttatctacttattcttgaaaagatttaagttcatttcggtatgtttgaatttcgggccccttctctaccattttgtcaaaccacacttttatatcaggctcttctaaaatttgaggatttacttctcttagtgtgcttagtttggtttggatggaactcgagacattgttgatatgattgagttgtctttctacatctctcccggcgcgttctgcggccctctttgcgacatcaatttttgagtctttggtttcttcagccttggcttctctcttcccacgttgttttttaattttgtaatgatgtgtgaatgcttcgttaattttatttcccaatcccccggcggttttaaaattcatgtcggtaaataaacttgaatggggacaccgctgtcattttcccatacttttataaactcttgaccatttatgccgagagcggtgaatgagtaggggtaaataattgatgagagagctactgaccaatttgtgcccaattccaaagtctcggggaggcgtactgtgaattttgacgtagtgttctcctgccccggtgtgttcgacggtagtacaatgtaaaaatcatccatctgttttcactaattcctggttataaaatatgccttttattaaatttccttccaaatcttcgatcctgtatgaatcgggtgtcgttgaattaacaataacgattttaaataattcttcggtaaagtttgggagatacccctttgcaaattttcctttttccttgataattcgaacgatatcgccaattttaaattttttctttttcgaaattttaaatttcttcgccttatataatttttcccagagcgcccgggcattttcaaaagttacggatactggcttggccccaatgtcctattcacactgttgttaatgtttattattattttgtctattacatcgacccatcgtagagtgtccatctttgtaaaatatctgtacaagcgctcctttattgtccgatttgccttttcacgactc

SEQ ID NO: 44575 - DNA, 611 bp, Heterodera glycines
actcataattatgctttgtaatatgaattccaaaattacggctgtgctgtccgaccaatcgaatacactgcgagtgtttgagtacaaagttccggctgagtcttgatttgttgaacaatcgagcagaaaattgttcaatttgttgaccattaatgccagcggagtttgagagggcagattcttggcctcatattcaattttgctaaattttttattttaattgattaacatcttcaaattatattaattgtaaatacatcgttgatcattttttacttgtattcgtcagcaatttgaacgccagccttttccaacacatttttaacactttcaaagtcaatttggctcggttcttctgtccgcgttgcaagtgccatcttctcggatagcaaattatgagcgacaatcacatggtttttgagagctcgaagatgttgcaaacctgggaaaaccaagaaaggatactataataacaaaaataaataaataaaaatttacatttttcaatagaattgcacaattggagcaaaggagtgtctgtcccgctttcaaccattatgactgacttaaagggtttaaagattaattatagcttaataagtaaggaacgg

SEQ ID NO: 44576 - DNA, 1244 bp, Heterodera glycines
  misc_feature (1175)..(1175): n is a, c, g, or t
  misc_feature (1190)..(1190): n is a, c, g, or t
gagaaattttatacctcacaaaagcgcttgcgtagagacggagggctgtgccaatcgccatttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactcaatcccagaaaaatgtctatctctttttttgagaaattttatacctcacaaaagcgcttgcgtagagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactcaatcccagaaaaatgtctatctctttttttgagaaattttatacctcacaaaagcgcttgcgtagagacggagggctgtgcacaatcgccattttatttcacagaggatttttatatttagaggttatcccagaaaaatggctatctctttttttgataaattttatacacatacaaatgctctcgagcatgatangggagggcggtgcgncatagaccttttatttttgagggaaattttaaaattatactctatcccagaaaa

SEQ ID NO: 44577 - DNA, 1209 bp, Heterodera glycines
  misc_feature (28)..(28): n is a, c, g, or t
ataaaataatcaattttatgaaaaatantttgtttataaaaacgcatacaagtaaaataaacgacaattattgatttgatagaattaattaatgttttaaggtaattaataaaaagaagtaagttataaaaaacaaataaaattctttgtttttttcttgtttataatttactattttaaattaaaggtttgaagttagtgaaacataaaaaaaatacttacgcaatgtaataaaaatttaaatatatttttgcattttttaataaatatttgattgcatatatggaatgaattttttgttgtctaatttttctatagaataaattttgttaaatgaatgaattaaaaattttaatgatgcaacaaatgacaatttgtataatttgattcaaagaatatgctagcaaaattatctcttttttttgtaaatttcatccatcttctcttaattgtcctgctgatcttctggcatatttggtgggatgaaacagctcgaaaaaccgcacgatttgtcattgatgggcggttgtcggagcacacgcgggggccaatgtttgctctagaaaagacacggtatccgatgggtttttaagcggtccatagattttttttattttcggcatgatacttatgcggaccgcaaaattgcggaccgcttttcgcgggcttgtgactcatcggtacggttatgtcttggttcactaattgaatcaaaaattcaaatttgctgatccagcttcgggattggaactcttgcaggacgggatcccgcggggggttatttatgcaatcacacttttaaaattttcgggtcccgcgctagattgcgagatttttgaattttttcgaaaaaaacataaaatttaatcaaaaatttccaaaaatttttaggtagctgccaacttatatgaacgataggaattgagcataaactaaataatttaaataataattttttgcttattattttaattatttgtccacttttaattgtttgcccacttttaattgcttgtcgccctccaacaacgcttcaacaaattcctttgaaaaatcaatgcaattgttttttcgtaaatcgtattttctgctgctgaaagtgccctcctttaactgttcattttccatgtaaaagtcgttgaaatggtcaaaaatgttttgcacttcccattgacttttgtttgtatatccgatgcgatggaatttgct

SEQ ID NO: 44578 - DNA, 1476 bp, Heterodera glycines
  misc_feature (1414)..(1414): n is a, c, g, or t
cggtgtagcgacggacggaggaacgcccaattcgatgtccggctctttcgcgtcgtcttccgcatcgtcggcatgtcgtgcagcgacttccagggccggccaccagcagcagcagccgcaatttgagcagaccaaaaggggcggcacggcacagccgggcgaagggaacgcactgatgccaaactcaccgtcctcctcttcggcatcgatgccgcaacatcagcagaacggaggtgagtgttaacgcgaagagagagtcggaaagccaatcatatgagttttaacattttcgagttttttttttgagtttccgccaatgtcggcacggaacttcgtttggatggtaccaacgccgtccaacagcagtcgtccgccggctcaaacagtgcccggttgagtccggacgggtcgttgcgaaacgctgcagccgccggatacgcagcagcagctgccacaatgaacggactcggcggcgcggtcccttccgcgtcgacgatgaacagcgcggcactgatgcactcactgggcgcggcacagcaaatgcattacggcatcgacccatagtgagtggggctgggactgttttggggtgtgcttcttcagcacttatatctctcctcgattcagctttggcatgtcccaagcggacttaagtgcgtacagtatgctaccgtcggctgcccaatacaatttcaatgtttgcctttttctgttgggaatgctaccgtaactttctgttaagcgttaccgttacccaccaaacattcaccaaacgacggcgactgcgtccgctttcccaactccgcccgtcagtggcgcagcaatgcctgtgccgggtgagaagggcaaagtgacaatgccaggaaatcggtgctttttcccaggctccggactgagtctacaggtgtccgtgctggccggacaacactcagccgcacatttgcacaatctgagcaccaacgaatggggcggcacttcgacggtggaccatccaagtcagtattggccccaatgaccgaacgaagggacaaatagcgaacggagaaagcgaaccgaccgatccatggacaaatcacaaatcaacagttgtttaccaaagattttcaaaaggtcatcgattcattcacaagcgtattgtgcttttcatatcaataaaatttgaaaatatattaatttaaatgtgttgcgctctttggacctcggcgggggaccggcagttcacgtccagtcagcagatttcgctcaaattaaaagatttgcatgtatggcaagtggttttgtaagaaagtaaaaggacaaagaacggaggttcgagtccgttggactacatgaatatttttatttatttttgtccaaaaagttctttttagctaacccttcttttttgcttttaaaaaccctttagattatttgntcgtaatttttgtctctatcgttatgcaaaatttgaagcggatttacaagtagaaaaaattt

SEQ ID NO: 44579 - DNA, 1554 bp, Heterodera glycines
  misc_feature (1427)..(1427): n is a, c, g, or t
  misc_feature (1459)..(1459): n is a, c, g, or t
  misc_feature (1473)..(1473): n is a, c, g, or t
  misc_feature (1542)..(1542): n is a, c, g, or t
cgcgaaccaggtgtacggtattccgcaggccaacgatgccggcgtgtacacgataccgttgagaggaggaggtactgtatcttttttaaacataattgctactgtattaaataagatcagtttttttttgctaattagttctaatttttttcattttccgcattttaataaatttaaattttaaaccaagttcaccaccaacataactttacattaaaaaaagggtatatcatatcgattacatgttttcttgtcactgatcatgaatatctccagctggtgggtcccaccctataatccggcccgtggccagaaaaaaattcggagggggtggagagaatccaaagaccttttaaaatttttctccattgtttttttttaaatttttagcaccagggagaaaaacaggcatctgtagtcgtttttcgccaaaaattactaattttttaaagtgccaacaaaaaataaataaataaaaagagcaccggcggtgcgttctgttccgccgattaaagcaattaaaatattgcctgattgcttaactaattagccattttgctttaatttttcgaataaatcgtcaaaatttaattaattgattattttcttttattttagagcgatctgtacgaattgaagttggcaatgagctgaagcagcgttgtgagaaggaaatcaagacaatttggctggaaattgttgaccaacagcgcattgatgagctgtccatggagagtcaattgtaagaaaaaatcagttaataaaaattaaattaaaaaaaaattaatgtcatttagaaacccttcgaatatataattttaaattcggaattgagacaacaaatttaataaataacaaatatccctcaacttttttgaaaaaaaaacctgtaaaattaagaccctcgtatatcatgactaacttaattcaaaaaagagaaaaaaaatctaattatgtttaaaataatatctagtattttaaaaattaatttcaatatttcgtttattgaagaaaaaatgtctcaaaagcccaaaaatatattaaaaaaaaatgaaaaaatctgcacgaaaaaaaacatttgatttaaattaattaatttatttaatgaattcctaattaccatacccttaattaatttatttaatgaaaccctaattaccatatcccctccccccatacagtaactccgtgaaaagcctgttggccaagctgaatgtgcggcttgcggacatgcgcctgtttccgttcaactatttggacacgtatcgtaccgtgacggagattatgcacgaattggagcagttccagcaacacaaccaaccaccgacaaaaattcatggccaacaaattgtgtacacggtgaacatcagctgcggcgagctgaacgagcagtccagcgaagtgataagtgcggccatcgagaatgngctgagttttcaggtagacaaaaggatggaanatagtgtttcttanaaatgccatttactcgctgccgaaaattcaggaaaaattaaatattgaaaaaaattaagaaaattttanaatgaaaatttt

SEQ ID NO: 44580 - DNA, 1309 bp, Heterodera glycines
aacggacacttgaaaaaatcgatttttttgttttcggggcagtccccccgagccgatgcgcctagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccgaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaatcgatttatttttgttt

SEQ ID NO: 44581 - DNA, 1068 bp, Heterodera glycines
  misc_feature (937)..(937): n is a, c, g, or t
  misc_feature (964)..(964): n is a, c, g, or t
  misc_feature (984)..(985): n is a, c, g, or t
  misc_feature (997)..(997): n is a, c, g, or t
ctgcaggaaatgacagctctttttattggtaccagaatatcttaatacattatatacgaccagcttgccaaggcatgaattgagattgaagaacgctgttattgttatgttagttagaaacttgaatattaaagaaggtctttgtaatggtactaggttcagaattttaaaaatgttagataaagttcttcactgcgagatcttaacagggaacaaagctggcactaaagtgcttttaccaaggattactttaactgatgatgaaacttttcctttttcaatatcacgccaccaatttccgttaaaattatcattttctttaactatgaacaaatcacaaggacaaacatttaataagattggcatagatttgcgaaataatgtatttcaacacggacagttatacgttggtttttcaagaacgagatcatgggatgggttaaaagttagattgcatccaaaaaacagagatcataaagtgaaaaatatttgttttaaagaaattttaaccgattaaattttttgaaatctaaacaaaaagaaaaatagatttatacgttaataatctatgaaatgtaaatatattaaagtcagtatctgaaatcttaacaaatacataaatcacaaaaaaacctatttagtggtttaagcttgaatttttttggtaagcattttttaatatttgatcaatgtgtttttgtaaaatattccaagaatcaactttatatatatatcaggtaagttaatcgctacattattgggggtggtgtagcgtgtggtggggcaggcaattgtgccttttaaccatcacgtaagccccctttgatacccaccgctttggtgcgttctcgacgcgggtatcgttagtaagcttaatgccgaagctaaaaacaaagcaatttaaaattgaaattactaacaaaaagaaaaagagagnaagaaagagagtgagcccgaaaaatanatttttgaggatttgatttnncaattattttantttaaaattttaaacatgactttaacaaaaatcaaaattaaaatttttttactttttttttgtatgtttta

SEQ ID NO: 44582 - DNA, 1504 bp, Heterodera glycines
  misc_feature (1445)..(1445): n is a, c, g, or t
ctgtccccacttcggtgctgcgaaggaaaagcgtagaagggatcggtcggttgttaccgcgggggcgagtcgacttcgacagtcggaggcaattgattctggcacatctgacgaaaaaaatgcctttttattattattatttgattccaataccttggcataacacggcgatattttggggttgaggctaagcattttctctcccgtcatcacaaatgcctcacagcgtggagaacgaatctgtgggcaaaaattgaatttgaataatttgtacaaaggcaactcttacaacaaaaatttaaaaaaagtctccggttagacctagcctaagcctatgtgcgagttggctttatacgattcagtctttttggccatccctcccccttttgccaattcaccgtcttcgggctgtccttttccgcactttcgctgtccccactcgtccgtcggccttttccatttggcgtcccattccgttggcaattcgtcgaaatttcgctgcctccccccgaatggcttcttcggctacgacgtgcggcgtcccctccattttctaaaaacgagtgaatttgtgctccaattacaatttgcgggctttgtcatttgtattaggccctcggattttatgcaccgaaatgcgacaaaattatgaactctgatttgtatcatatggatttcaaaacatttctgaactgtgcccatccttaaaacttgccgaattgctccccgcccttcccgcgaatgagtgccatttggccattgctgctgctgctgggagtcggcgtgaacagaacttcggtggtcattcaatgggacacaattattaaaggggaggcccaagtccaatcctaaatttggtagaagaaaaaaccaatctaaattgaaatgattggaaaaggtaaaaaaatatttagcgttttataacagcaaaatggaaaagtgaaaatttgcataagccattgagcagtggtgaaaatgagcagcggtggcaaatttgcataagcacaataaaaaggcggcattgggcgacagataaaagacaaatgaccaccgattgcttttggcaatttataaaatccaaagggtcgtgggaatggacgcacaacaaaaaacaatgcaaagataaaaagtcaacaaaagtgatcaaagagccaatggtgcccttctgctgctgtccttctcaagcattcatccgaatcccaccatctaaacacatccaatcaattaaactttgcataaactttaatcaaagtcatccaataaacccacccaatcggatgatttcgccgtttaagtaatggttgtcgatgatatgctccaccaatgcggcaaattcttccggcttccccaatcggttcggaaacggaacagtgccagaaaggaactttttgacctgtgcaaaaacgatattgcgaaaaacccagaaaatattattgaagaaactnttggtggcaacgaggaaagcaatggcgtgtccattaagccgggagcaatgccatcacgc

SEQ ID NO: 44583 - DNA, 902 bp, Heterodera glycines
aagcacacatgcgagccctgatttagtttaataaccgattttgttgagatttctaagtcattttgaattggcaaaatgttttaataggttaaaataaaaatcctaaatttcgcgttagaaaagaaaagaggtcattgcctaaggcattaccaatgagaaaattgcctcgttcattatttatttgatggatgacaattgattggtgtcgtgctgtttaattttgggctccaagtacaaataagtttattatttatttagtaatcagaacgccaaaactttgcaaaacttaaaatttattggggattttcccttgtaaaaatggaagagccgatctcgagttagaaaatatactttcaaaaaacaaaatcgaattcgatagatggggtcaaaaaactagcctaggcaaaatttcaagaaaatctgacccgaggaaaatttttttgaccctagtgaaaatttcaataattttaattcttttttagccaagtccacaatttaaggccaaacttggaattcaaaattttttatgcaggattgcggactgggatcctgcaaaatcctgcgcaggatccggtcctgctccgggctctaggtaatactgtagatggtgggccccctttttggaagaaattttttttattctatttaacgacaatccagatttgtaacaaaatctgacgaaaatcctaaaaaagtcagattcgtgatcagtttagaacagggatgcgatcgaaaatttttcaaaatcaggacatcgggcccaaaaaatcagattttggggtcaaaaatcagaacattttgcaaaattgcttcaaatcttttatttttacaattagttcaggtcccggtccccgctcattctagtcgaaaactaacagcaccatcccggcagatccgcatac

SEQ ID NO: 44584 - DNA, 826 bp, Heterodera glycines
  misc_feature (756)..(756): n is a, c, g, or t
  misc_feature (758)..(758): n is a, c, g, or t
  misc_feature (764)..(764): n is a, c, g, or t
  misc_feature (769)..(769): n is a, c, g, or t
cgacgcatcaaacaggtggcgaaatgaaaactctctgatcagtcaatgctttaaatgttttgatcaatttcaggaactggcggagctgaagcaggaaccgatcacgggttgcaccgcggcaccgatggatgacggcaaagacatgttccactggaaggccgccatcaaaggaccgcccgagtcgccgtacgaaggaggcaccttccatttggacatcgttttccatcgcgactacccattcactccgccagttgtcaaattcgaaacgcccgtttaccatccgaacgtcaacaagcagggtggcatttgtctggacgtcctgaagacgacgcattgggcgccgtcgttgaccatttcgaaaggtgaaagcgacgcgacaaagagcagataaaacgccgacaaatatcgacaagacaaaatggcccaattcaaaacgaccgccaaaactgtattttttgtaaaaatgccgatattttgtcgtgtgaaaatgggatttttcaaattcggaaatgccgttttaattcattgtcccccctccatttcagtgctgctctccatctcttcgcttctctgcgacccgaatccgaacagtgcgctggagatggacatcgcgattatctaccgcaatgaccgcgagcagtacaaccgaaatgcccgtgaatggacgcagaagcacgcgatgaaatgagacgacaaacgaacgatggatgggagaggatgcagaagacaaccgccgaagaggaaggaggcggcggntnccttcncctgnccctcttcctcagaaaggccgaactgtatagattgtattattgtatctctactgtat

SEQ ID NO: 44585 - DNA, 1134 bp, Heterodera glycines
  misc_feature (78)..(78): n is a, c, g, or t
tatttatcttttgcctccgacaaataaactatttttattcttcgttgtgttcaccattgaacataacaattaattatntaaaaatttttagtttttacaatttcaataaattcaaattataaaaatgtctttattatttgatcatttgtttttataatttttttttattatattcttaattttgatgttattattatattttatttaaaaaaattttaagatgtaaatatttggtaattaattatatctattgagtcttgtttctattgaatactttttgcgattattatctcttttaataaatttaatgcaattcattaaagtttaaaacctttagtatattatttcatatgagttcgcttattttttactaaaatttaaatgtttgttaaatgattagtaatttttttcattttcatatatgaattttactttataaattttgatattaatcaactccttttcctagtgatttttccaagaatagttttttttgtttaaatttttaatcataaattattatttcttataatttttcacaattaatcgattttaaaaataaattaatagttacgcaatgatattgatttatatattttaaataaaattactttggaattatttattaattgctttagtcaatgtaattattttgtgtaaaatatttatttaaaataaacacataggccatttaatagtttttttttaaaaagatctctttaatagctggacatactacccaaattttctcattttttatttgaatgagaataatattgaagaaatgcttatttttgacaaatccaattataaagttggtctactaaaaaattaattaaaaaatgctgattttgaaatttttctgttgtgagccatgatatatcaattggagatgcaaatattcgaatatttctaatttatgattttttttgtcatttcgaaattctaatacacatacactccgagaaattattaatttctgctgtattcattttttgacaacttatctctgtggcttacgtccacaaaaagaatatatatttttatttggtttaaatttaaatcagttttaaaaactatgatttttaaaatgtaatacctaatgaaattattatttattttcattttttacat

SEQ ID NO: 44586 - DNA, 1246 bp, Heterodera glycines
  misc_feature (1200)..(1200): n is a, c, g, or t
  misc_feature (1210)..(1211): n is a, c, g, or t
tttgtagagcccatcaaacacattggtgcttataggaatcgctacttgaacaataggggcctttttattacgattacaacaaatcagcacggcgtctcgccgatacggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattgaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaatccctcttttggtgtaacctatgatttttggcccattatggatgaattaggtatagaaggcgtcgcagaaatacattcatattttctaaattcgggtttcagaaaattaagatttaaaagaggctgaattacagatgctttttcaaattttgggtgtatccgaantagaaagaanngtggaaatcagtacttttcacgcctataaaattcg

SEQ ID NO: 44587 - DNA, 1082 bp, Heterodera glycines
tccccttcatgctcgagagcatttgtatgtgtataaaatttatcaaaaaaagagatagccattttctgggatagagtataaatataaaaattccctcaaaaataaaaggtctattgcgcaccgccctcccctatcatgctcgagagcatttgtatgtgtataaaatttatcaaaaaaagagatagccatttttctgggatagatataaatttaaaaattccctcaaaaataaaaggtctattgcgcaccgccctccctatcatgctcgagagcatttgtatgtgtataaaatttatcaaaaaaagagatagccatttttctgggatagactataaatataaaaatcccctcaaaaataaaaggtctattgcgcacagccctccctatcatacgcaagagcatttgtaagtgtataaaatttatcaaaaaaagagatagccatttttctgggataacctataaatataaaaatcctctgtgaaataaaatggcgattgtgcacagccctccgtctcatacgcaagcgcttttgtgaggtataaaatttctcaaaaaaagagatagccatttttctgggatagactataaatataaaaatcccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctg

SEQ ID NO: 44588 - DNA, 1393 bp, Heterodera glycines
  misc_feature (126)..(126): n is a, c, g, or t
gttttgtaatcattgtaactgtaaattgcaattaaagcgtaaatatatggttgtattttgtagcattttttacgaggcttcgaatggtatatatcaatactcaaatgaatattttacccaaacacntgtattttatcaaatgaattgcacaaattatttctggtaaaattatccagatcccaaaaactttgaaactcgggaaattgggttggaaaatttttctggacaaaatgattaagccattatgaaaattgatcatttttatggtcgtcaattttgactccacctctatctcagcgagtattagtcgtagaccaaaatcaaaaggcaattcgatagagaattttaaaaagcgacgatttaatattgttcattatctcttgcgaaatgtcaggtgtaaaatgaaatattgttcttgacgcccgactacaggtgcaaaattctctctaaaagttaatcttttaattaaattcttttacaatagttttggtgcttttcaatttcatttctatgcatttttgacacattagacccaaaagttgaaattccaaaattttcaacttttagatttttgttcaaattcgggtcaggaatcctgtattgatcgatatgcgccgacggcaaaatttgaaattatttccgaaatttatttgcaaacttatctgtagcacaatgaaaaacttaattatgcaattaattaattactgattggattaatcgtttaatttgctcataaattactctaattaaaaaccctgaacaattcccatgaagttcatacttaactttgataggaccaaatttcgtcaactccaacggcactttcctaaattttctcttaatgaatgataatattataataagtaattcgtttattttaattaatacattgtgccgtttgaaacagcgaaagtagtaagaaaaaacataaaaacaataaaaatatgaataaaaagcattgatacgttattgaaaaataataataataattaaatattacaattcaaaaaacgaaagattatccatttttctcattttagcaaatgaaaatcgctttttaaacaaaaaatgggtgtgaatcatcattgaataatgaatgaacaaaaaaaatattcatatgttataagtaaattacgaaaaaagaatgttattggaaaaaaaaataattctagcggaagtcaaatgcaaaaaggctttacacaaatcatttaaaaattgctttttaaaaacgctgttcagaaaagtaactaattaattattttagaaaaaatttaatattacataaaattttcttaagataattaattgattaaagttttaagcaaaatttgccagatcttatggaattgctatgtgaaaaaatttcgtgaccgtaattcgcgtaaaaaaacta

SEQ ID NO: 44589 - DNA, 2412 bp, Heterodera glycines
atttgctaaaatgttgggaagggacgaaacacaactaccaggccaactcttaactgctccgacttgtaaactgtttttcggccaaaaaacgtagtactttttcaaagccaacaaaataaaatacaatttgaaattcaatcgaatattttggttagatttttgtcagatgatttttgggttgaattttaaaacaacatttaaaggaattggttgtccaacagtatagacaagttcgtctgtagaaattgtgaaaattccgataattctagcaaattcggttttaattgtggaatttttttgttgtttttccactaaaaatagagttaagctctaatctaaccctaatggccaataaaactatctttttaatcccaccaaacgcgcaaaatttttttgttccaatttgcagttacgtcgaccaacacgtcgtccaatttctccaccgcattcgccgccttttcgactccgtcccgacaaacctttacattgcgaccgccgctttggccgaaactgtctaccgcctgaagcacttcgtccgcagttgcgaggcgattcgccaacacattttgccgctgctccgtgccaatgtccgcgccctgtttttgtcctctcccattttcgaccgtttgatcaaattctcgccctcctttctcgtcgattgcccctctctgggaaccatcgattcctaccaagtttttccctacttcaatgacattaatttggccatcgtttcgcgtggacgcgcggtgggccaatggttggccattccgcgcccggacgactgccaaaagtgtgaaattgtggctggtctcccagaaaaggatgggcactcaaagaggggggcaaaaaagtgcacatcactggcaccatttataaaggtccttgggtttacacaaccataaaaaatcttacatttacaatttttgtaaagtttttggaaaaattttagcatttttttgggaaatattttttggaaaaaacaattaattcctcataaaatggtggataaaaaaacgttaaaaatttatcaaaaaaaaaatttttttaagttcttgaaaattaatgaatttcaaaatttcaaatggtttttttttttttttggggggggggggggggggggggggggggggggggggcccccccccccccccccccaccacggaacccccttgaaaaaaatttttggggacaaaaaattggtgcgcccacaccccgccccccaatctaggtttttttaccacggtgggggggcaaatgagaaaataaggagggggggggggacaaattttggggaaaattaaaacaataaattttttaaaaaaccctaaaaaaaaggggtccggatttttggaaccttcaaaaacaaagtccttaaaatttgatttttttactttttctttttcccattttccaaagctttttggcttcctcctcttaaaacgcttattgatggccatcttcaattttttggccactgctctttttttaatgtttttttgcctaagttttggtatcaaaagaacgcttaaaatctcagaaatttttaaatattaggatagcaaataatggcattaagaaaactaactcaatgagaaaatatcaaaattcagctttttagaatatattcatgagattgaatttttgtctatttcatactttaagctgccgtttgatccaacttaatggggaaaggatgatcagaaattgtttttgaaaaatgtgaaattaaacagatattgccagccgtccaaaaacaatgtccaccaaactgtgcatcaacaacttttgcctttgcccccctccaccaactcttcctccaccgcttcgccgtcctcattctccgcgtcgtttcaaacgccaaaaaaacgcaaactcaaggtgattattggtagctatattggcaatactttcgttgtccgtcctttttttgtttaaaaaatattaaaaaattgttttctgcggttttcggaatggaatcgcttccctagcttcgggattcttgttagccgggaggaatgccatttatgatcagcgtctctgacccggaaacataatttgttagggttttgacaaaatgaaaattcaaatgctttgttaattatttctctccccccaattttcattactctctgaagaatggaattggcttcaatttcactgattagtttgacaaaagccaaatttttcgtttgtcgtccttttgtcgttcgtaaattatgattattggcccgggccatttttaccgtttcgactctcttcgtcttcatataataaatttatccgtaaaataacatttctttttcaaaaaatgacattcttttcgctatattttcactagtaggtaataactttaactttcttttacagtttgaaaaagatttcaggagaacgccgaagagaaagcagagggag

SEQ ID NO: 44590 - DNA, 963 bp, Heterodera glycines
aattaatttaatttttccaaaggatgtttttttctaattttggtggcgctcactttctgcattttctccatcttcattctgatcccaaatgtgtcaggtaacaaccattaaaaaagcctatctattttttaaaattattgtaacttttcacagctgctgcctgcgagtcgcccaaatactccgccaacggttactccacgcaagacggatttttccactacaaaacttcttacattgttgaatttgcgatccaatgctctaacaattacaaggtttgcccatctttcgtaaatcgagaatctctcatttttattgttttcattttgagcattatttttgcttttttcaggacgcgccattctacgcactggtcggtgaaaaaacgctccaattggctgtgtctgaggagaccaacaagtaccaggtgtcctggcaattggaacatgccgattctggtgcacaaacattcgatattcgcgtttatgacgaagacaaattcgcggagcacaaaaaggtttcacttactttcaaatttaaaaatttacattagtcctacgaaaattttaaaatcttgttttttttaatttgtgtcaatttaaaaaaaaattctgaaaactctaaaaccactggatttttttctttctaggccgatgagtccggctcaagttctgtccaaccattgttcactgtccagcattaccacggcggcacctctcacaaaacgtggatttcctcagagtccgtcttccttttgttgggcgtcgtggcgctgtactttacgatgaatttacgccaattgttggccaaaagagactgactgaccaattggttgttgtccattctcccgaatttcacccttttaatccttcaatctgtgaaatgaccattttaagttattcctgacactttgggcttactcaatttatttgtaaccttttttggtggggtattttcgttttaaca

SEQ ID NO: 44591 - DNA, 983 bp, Heterodera glycines
ttgaataaatttacatatacaaatttttaattatattattaatttatttaaatgtatgagagacatgaaggggatgggcgcccaaggttcagatatgaacccagggtgaacccgatttcaccctgaaactacaagtgtcatttcgttgtgacaacgaagcgaccccaggagtttcaggggcgagagtagacagaataaaagatatgttttattataaaattatttacattaaaacgtatataatttattttataattgattaattctcaaaatatatttttatttcataactatattaatcaaaaattcaatagataaaaaacatgccatgaaatgatagaaaatatgctcttctaccattttggtgtacataaacggcatgaactttgctgatcaaatagcgaccgtgctcatccggtgcaattctgctgtccggatttccttgatcaatttggactgccaacttaaaaggcggattgatcatttttattagagcccggtaaaaaattttccggaggcgggagcaggagttaaaacttttctgggacgggagtcccgatcggggatcccataaaaatcccactgccgttacaatcccgttcaccaaaaaaaacgggtgcgggaccggaaatctcgtaaaaatcccgcggggatcccaatccccaggctctgattcttatttattatacagaatttcacgattccgttttttatatttcgcttttctaccggtttcggcttggtgcgtttgtttgcgcgttttctttgtgttttgccgtgttttttgcccgcttggatgatgttgaagtggttgtgaaagtcgaacttctattatcgtcgttgatgttcgacccagcaccgtcaagttcgacagttgcgccaatgtcgagaaagccatattcgtgtcatgttccgagtcattttgttctttcgtctcatcgattcgtaatttgcagcaattgagtcccagtcattatcctgaa

SEQ ID NO: 44592 - DNA, 943 bp, Heterodera glycines
  misc_feature (851)..(851): n is a, c, g, or t
  misc_feature (861)..(861): n is a, c, g, or t
  misc_feature (881)..(881): n is a, c, g, or t
ttttcttggtggtgtaattttctgtagtcatttgatatgcatctgctatttttctagtcacaaacaccaatatttttcagcccgaattttataggcgtgaaaagtactgatttccaacttatttctattcggatacacccaaaattaaaagcatctgcaattcagcctcttttaaatcttaattttctgaagcccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattactttgtctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaactttaactgaaacataccatatcagtgagacgccattctgatttgttgtaatcataataaaaaggcccctattgtataattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaattcagcctcttttanatcttaattntctgaaacccgaattagaanatatgaatgtatttctgcgacgccttctatacttaattcatccataatgggccaaaaatcat

SEQ ID NO: 44593 - DNA, 917 bp, Heterodera glycines
  misc_feature (840)..(840): n is a, c, g, or t
  misc_feature (845)..(846): n is a, c, g, or t
  misc_feature (880)..(880): n is a, c, g, or t
tgaatagcagcgcaaaaattgggaataaaaaatgattgccaaaaatgcgctaaattgggaagcccggttttccgtccaagcgaaagttggcacttttaaaagtgccgaaaacttacgcaattaaagtgaccaacgtccactcactcatttttaacaatttttttttgtatgtgtcgaaattcgagaaacgctaaaattgagaaaaataattattttacacaataattgtttaaatattttatggaaaattattttatcttataatataaataaattttttgatttttatttattgttcctgaatttcatattggtaaggaatttaaaaaaatgatgccaatttagaaaaaatttttcgatgggtttttatttgttttttctattttaaaacattaaaaatatatttatctttttcctaaaatttctaatcaaaaagcgaattgcacaaatcatttatgcattcatcagcagtagtagtggataaaatcagtggatgtacaaaactgatacagtcagtcatatttttagcaatgtaaaagctaaaattatgcagttttccgtgaacaaattttattgcataaattaatttagcattgaaaataaataaataaagccgacaatgatgggttaaacaaaaacaatttgttggttaatactaatttcgctattcaatcattttgccatcagctttttatgtatgtgtgtgctttttcatcatcccatttattattatttgggaattagtccattttaatgatgacaaatagttgaagccacaaattttttttgtacaaactaattatgcaagattttgtcataataacaactttttttagatgngaggnngggggggcattaaataaagaaaattcaattttanagtcgaatttcttttgaatttgtaaagaatgatgtat

SEQ ID NO: 44594 - DNA, 907 bp, Heterodera glycines
cgaatgagtgaagagtgcccatgtactctacttgttcctgacacacttaaaaattcatgggtttttccaaaaatggcatttggcgggcggcgaccgcgcgtctcgggactttcttttattatggtcttatgagagaaaactattggagtttgtgaacgcatcggactcaaaacttttttatagttctgttgttttgcttttatgatttgttaatgagtgtctaattgagactccttccccccccccgcccatcggaatttcgtaatgattcggacgcctaataatccgacggataatagcaggtggtgggtttttcgtcgtttagctcgaaaaagtagaaacacattaagaaacggatggagaagtttgggtgaaattagttggagaggaacggaaagttgaaaagtcccctccccaggccaacagctgctgaaaatgacaaatccttcgctattcgtcgtttaattaattgctttcatccaattcgtttaatttttaatttataaatcatttggtgataatctcgcgaagtcaaaaagtgcatatgtgttataattaaggttataagtttgtatgcactaaaaaaatgccaaatatgtgcataaaaatgcactaaaatctctcaaatatgcctcgaaaatccaaaaaatgcccaaatatgcatgcactaaaatatgccttaaaaactgctaaaaatggctttgatccctcaaaaaatgacaaaaaattgtgtaaaatatgctctaaaaatgcaaaaaattgcaaatatgcatttattcacgaaaatctctaaaatatgcttttatatgcactaaaaacgttcaccaaatcaaaaaaatttgtagaaatgctattttgaacccctttcttcatagaatatgcgcagaaaaatatgcaaaatcattca

SEQ ID NO: 44595 - DNA, 876 bp, Heterodera glycines
  misc_feature (803)..(803): n is a, c, g, or t
  misc_feature (806)..(806): n is a, c, g, or t
  misc_feature (812)..(813): n is a, c, g, or t
  misc_feature (825)..(826): n is a, c, g, or t
agttcaagcagtacagcaacaacaacaagttcaagcagtacagcaaccgagactccggacggtcagggacgaccgccgctacgaaatcgccgctatcgtttgttcgcgccgcgccgcagatggtcaaacgcgtgaattgaggatccattgccggtcattctcgtatcactatgatacatatgaagcagaagcgtcaatccaaagggtaaaatttttttttaatttgtgcataaaaataagcattaaaaaataataattcagcaagcgcctctaatccacgcggcgtggctccaggtccacgaccttgggaatacgccgccgcacaattttcaattttcgcgtcgtcgactttttgttaaataaattaattaaacattacttcgtaataattaattaattaatgaaagatgcgcaagcagcagcagaaggagaagaagcacaaaatttggcggaggcacgaggagaagaagcaatggaagaggacgaccaccaaaaaaatttgcaggggacaccagcagcagaagaagcagccctaatttttgatccgatgcagccgcaggctgcgtagcagcaatgatggaagtggaggaggacgacgacgacgaaattatctttatcactgaagtgcaaagagaagagccaccaccaccagcagcagcagcagacgaagtcattgtggacttacaactggaagcagcagcagaagcagttgaagcaccggtggccaatgaaactcaaggggaagagccaccagcagcagcaatcccagtgattgaggacgaaaactttatttgacttcattntgntaattnntttcattaattnngtagccattatatgtaaagtatttatttttttgtcacattaacatgatca

SEQ ID NO: 44596 - DNA, 1243 bp, Heterodera glycines
  misc_feature (1065)..(1065): n is a, c, g, or t
  misc_feature (1099)..(1099): n is a, c, g, or t
  misc_feature (1159)..(1159): n is a, c, g, or t
  misc_feature (1161)..(1161): n is a, c, g, or t
  misc_feature (1188)..(1188): n is a, c, g, or t
caatgcttcatcacctgtcaatttcatcattgtctgtaggattaaaatgtttgctgttttgctcatgcccattgaattgaccaacggattcactggggagcgattgtcactgatgaaactgaatggcaaatatttggtgatccgttgtccgatttcacgcgatgagaccaaatggaagaaatgggaacaggaggccattgaatgtgatttagataatcagttgaacacaattcatattggaatatgtgatgacgacatcggcgacgggtgagtaataattaataatgctctaagaatctcgactcgataatctcgggtttttttttggctcgatcacgagtatcactaataattattactaatttgaatgataacattttaatgggtattttcattttcgcttttagtcttctcgatgatggaactcccggcccaagtgatcagcagaacagaattgtggagaatgaccgatcaacgtgatattggcacttgaaattatttagactatttgacataatttgttaattttatttttaaagattgctttcaaaataatattttactagaaattttaaaacttttaattgccataattacaaaaaaaaataaaatgacattttttatgtcaaaaaatgttcaaacaaattaacaccccccacatgacaatgcgcaattgttgagcaaatattgttgaaatatgaacagttcgcaaaggccgtttgccgcccatcgtcggcacattggcaactgatcatcacactgttgggctgatgacgatgatgcattgtcgttgatgccaccacattttcggcacgttcgcgcacaatggacaagcatgaaagaagtggagaacacggactcacaattgcctaaaatataattaacaattaattttaaaaatataataaatgaatgtattaccaatacttgccaaaaatggacaatcacttctctgatcaatgcaatttgcgttgttcacgtttcgatcactgattgctgctggtgcgccatttgctgctgtcaatgctgatgaatcaactgctggttgtactgaactgtcactgngaggcatttgagcttaattaaaaaaacaactttnaatgaggcatttaaagaattaaatttattttgaaaataaatatttttaaattgaaagttngngggcaatttcaaattttgtttgaattnttattctctatttcacaggagtgaattcctctgctattatgtgattgattttgag

SEQ ID NO: 44597 - DNA, 1194 bp, Heterodera glycines
tttgtagatcggctaacctttgactgaaacataccatatcagcgagacgccatgctgatttgtgtaatcatataaaaagcccctatgatcaattctgcctttcctataagcacaatgtgtttgatgggctctacaaaatattgcttgtgcacagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgttcaattctgcctttcctataagcacaatgtgtttgatgggctctacaaaatattgcttgtgcaaagcaattattttcttgtaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaattcagcctcttttaaatcttaattttctgaaacccgaatttagaaaatatgaatgtatttatgcgacgccttctatacttaattcatccataatgggccaaaaatcataggttaagaccaaaagagggattttagtttcagccggaatttctggagggatgttcgtgtgtaacctatctttgtctattcggataa

SEQ ID NO: 44598 - DNA, 840 bp, Heterodera glycines
  misc_feature (316)..(316): n is a, c, g, or t
  misc_feature (321)..(321): n is a, c, g, or t
  misc_feature (330)..(331): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (344)..(344): n is a, c, g, or t
  misc_feature (346)..(347): n is a, c, g, or t
  misc_feature (358)..(358): n is a, c, g, or t
  misc_feature (365)..(365): n is a, c, g, or t
  misc_feature (367)..(368): n is a, c, g, or t
  misc_feature (393)..(393): n is a, c, g, or t
  misc_feature (418)..(418): n is a, c, g, or t
  misc_feature (444)..(444): n is a, c, g, or t
  misc_feature (465)..(465): n is a, c, g, or t
  misc_feature (467)..(467): n is a, c, g, or t
  misc_feature (476)..(476): n is a, c, g, or t
  misc_feature (488)..(488): n is a, c, g, or t
  misc_feature (495)..(495): n is a, c, g, or t
  misc_feature (502)..(502): n is a, c, g, or t
  misc_feature (509)..(509): n is a, c, g, or t
  misc_feature (525)..(525): n is a, c, g, or t
  misc_feature (538)..(538): n is a, c, g, or t
  misc_feature (541)..(541): n is a, c, g, or t
  misc_feature (555)..(555): n is a, c, g, or t
  misc_feature (557)..(557): n is a, c, g, or t
  misc_feature (562)..(562): n is a, c, g, or t
  misc_feature (565)..(566): n is a, c, g, or t
  misc_feature (581)..(581): n is a, c, g, or t
  misc_feature (587)..(590): n is a, c, g, or t
  misc_feature (614)..(614): n is a, c, g, or t
  misc_feature (629)..(629): n is a, c, g, or t
  misc_feature (638)..(638): n is a, c, g, or t
  misc_feature (643)..(643): n is a, c, g, or t
  misc_feature (657)..(658): n is a, c, g, or t
  misc_feature (666)..(666): n is a, c, g, or t
  misc_feature (670)..(672): n is a, c, g, or t
  misc_feature (680)..(680): n is a, c, g, or t
  misc_feature (701)..(701): n is a, c, g, or t
  misc_feature (703)..(703): n is a, c, g, or t
  misc_feature (710)..(710): n is a, c, g, or t
  misc_feature (720)..(721): n is a, c, g, or t
  misc_feature (726)..(727): n is a, c, g, or t
  misc_feature (731)..(731): n is a, c, g, or t
  misc_feature (737)..(738): n is a, c, g, or t
  misc_feature (752)..(752): n is a, c, g, or t
  misc_feature (778)..(780): n is a, c, g, or t
  misc_feature (782)..(782): n is a, c, g, or t
gaaaaagtggataaatttaactaattttaaaatattattagttaacgtgaaaaacgatacacgaatacccgaaaatggaaaaatgagtcaaaagaaatgttgtcataaattcttgtccactccttttcccctttgttgggaacaagaaaaatttaaaaaaaaaaacggctcacgaccgtgttttttctttaaaacatctatttttggcaaaaaaatgttgtgttgaacgtgaatggatataattaccctcataatatgcttataaatgtaccaagagaatgaatttttatttaagaaaataaaaacaatttttttncaccnttttttccnncccnccncanatntnnttcacttccancaccatncnntaattatttctaaatacaaaataanccactcactcattaaaattattttnaaaatttaattaaatttaaatttctnaaacaaaaaaaaaacaaacancnttttcatanccctcatccccntataatnccacctnaaaaaanaaataaaaaacaaaancaactacataacnaancaatttcactttcnanaacanctnntccattcattccctnaaatannnncacaatttaaataaaatttaaaanaataaattttttccntaaaataanaaatnaacaaaatttttcnncattatcncaannnaattaaanccaaaacaacacattcaattnanaaattcncttcattcannattcnnaatntaactnnatcttcaattacanaaatcaaagatccgtcctttctcttnnnancgaatgtttttcttatgttagtaaagatattttttaattactaatatatttttcaaaa

SEQ ID NO: 44599 - DNA, 1018 bp, Heterodera glycines
cgcgcccactacgaaacagggtactcagatggagagaatagatttgttcgctacatccaaatgcaacgtctggtgtaggaaggatgtagtataaaatgaatttttaacagccgcgcccactacgaatcagtttactcagatggagagaatagatttgttcgttacatccaaatgcaacgtctggtgtaggaaggatgtagtctaaaatgaatttttaacagacgcgcccactacgaaacagtttactcagatggagagaatagatttgttcgttacatccaaatgcaacgtctggtgtaggaaggatgtagtctaaaatgaatttttaacagacgcgcccactacgaaacagtttactcagatggagagaatagatttgttcgttacatccaaatgcaacgtctggtgtaggaaggatgtagtctaaaatgaatttttaacagacgcgcccactacgaaacagtttactcagatggagagagtagatttgttcgttacatccaaatgccacgttcaacgtctggtgtaggaaggatgtagtctaaaatgaatttttaacagacgctccactacgaaacagtttactcacgtggagagtagatttgttcgttacatccaaatgccacgttcaacgtctggtgtaggaatgatgtagtctaaaatgaatttttaacagacgcgcccactacgaaacagtttactcagatggagagagtagatttgttcgttacatccaaatgccacgttcaacgtctggtgtaggaaggatgtagtctaaaatgaatttttaacagacgcgcccactacgaaacagtttactcagatggagagagtagatttgttcgttacatccaaatgccacgttcaacgtctggtgtaggaaggatgtagtctaaaatgaatttttaacagacgcgcccactacgaaacagtttactcagatggagagagtagatttgttcgttacatccaaatgccacgttcaacgtctggtgtaggaaggatgtagtctaaaatg

SEQ ID NO: 44600 - DNA, 939 bp, Heterodera glycines
  misc_feature (28)..(28): n is a, c, g, or t
aaccaatcaatggcatcgtttgatactnttgtgaaaaatattgtttcaaacctgttggtgtgatccgaaatcgttcatagaatgcatgacattgttggtaactggcggtggtcttgggggtggctgatgccgagtagccaatgttggattttgtgcaaaaaacggtgtgttttgtgaaaagcctccaatattttcgtttgggtatttgctttcattcgccgaattcaccgcggttggcaccgttggaaactgctggggaggcgccggtggactttgctgatttatggaaaaattcaaatcggccatccacccaatcgtaaaatacttctttttgcagttgaatgaccgtcggtggagttggcggcggcttcccgcaactattcttgaatcgagattggtgcccaattgatggcttgaaaggcatagtcggatcgacggaagacgtctttgattcagtgctggtggaaggccatgaattgtccggcagagttggctttgattggaacagtggcggtgggggcggaggaggtggtggaggaggaggagacgccaccgaactcgccgctgttagcaccgactgtctttgctgcggagatgctaccgaactcgccgcggttggcaccggtggaaactgctggggaggcgccggtggactttgctgattatgggaaaattcaaatcggccatccacccaattgtaaaatacttctttttgctgttgaataaccgtcggtggagttggtggaggcggggtttcacgcgacttttcttgacttgggattggtgcccaattgatggactgtcctcccaaaaccaatccctgctgctcatcttaatgttgctaggggtaactttgtattaattaaacagatgctacttctgcgattgttgtgcatgtgcttgtctgattcgcgggttccaaatattgccttttttctc

SEQ ID NO: 44601 - DNA, 1030 bp, Heterodera glycines
  misc_feature (39)..(40): n is a, c, g, or t
  misc_feature (938)..(938): n is a, c, g, or t
tcccattttggcgatgcattctgtgagcgcgttaccgcnnaagaatcgcagtgcaagcggaaagtaacgcgagaagggcaagaagactgatcagaatgccgtgaatgatcacaacggcatattgtggggggagaaatggtgtcaaaagtagtctctgtttaaaattttgaattacagccattttaattacaatttttaaaaaatctagtcaacagaatgtcaccggatgtgtgacggccattcggtattggttgatgtccattttgtaatatggaaacgtgttgttgtcgaccgatttgaatgaccaaactgcggcgacggtggacaaagcaatactcaccggaattatagtgattgaaaattcttgaactgctcgaaacggaaaagtccagcgattttctcactactcgacaccgataagcgcgagcagctcaactgctgccaattcgactggccattttgatcagcgctgtgcatgccaacagtttttgaagtttgacctcagttggtcctcccgttgagctgagtacaaggggtttctacaacagaaagactgtccaagagtgccaatgcgaacagtccgacgatgccgatgaacagcaaaagaccgatcatggcacttgaaagacctgaaataaaaggcaccaatctggacttccctaattacgtttcccgacgagcaaccgatgcagaaaaagccgattaaataataatgaaaatataaatatttttaattaatttgttgataacatattatgcaagttatatatttttgaagcatttatatgttttaatttgctaaactgaaaataattcgaagagtttatttggacggttaacatggaaaccatggggttgaagtgtgggttcggattgctgctgaatttatatagatagtctcagctattgtagtcagtttaaatttcaacatcatttgngcaaccatcacataattaattatttacccatttcctcgtccacccgttacggtgagtgtgcacagcagcgaggcggatagacgcaaatcttt

SEQ ID NO: 44602 - DNA, 930 bp, Heterodera glycines
attttgtcgtattcatttgacgccatttgaagcattagccccttcgaaatgcttaagcaaatgccttttttttcttttgccatccttcgaccgatccgtccaaagtttcaattcaaaggccaaaccaattaaccaccatccctttagtgaataaacatcaattaccgtactaattaatgactattcgtcttcccttcacatttctcccccagcgatgaattgctctggcgacgccccaattcctccgcaaatgatttttcgttggacacacaacggaagcgtggccatttgttattccattgtccgtttttaactatgcaattatttgtggaggggcggggaaaatgaaagtgccaaattaatcatctcttactcagagaatgacacagagaatcattttttatttttcaaaaaaggtttttgtgatcgctttgtttggcaatcttttggtgattgctgtgttaatcaggtaaattaatggcttttagagaagcatagagaacaactgaccagacgaactcatctgatcagactattctgctttttaccaaataaataatccatgttcagaaaccaatgcatcaaaaaacgacgagtgaataccattctcttccacatgacaattgctcagcttctcggttcgtcccaatttgttttggctaattgtcgtccatttccattttcatttccaatttttctgtcaattccctccgttcagtgactttggtatatatccccaaagaaattgtgcacaatttgaccatcgcgtggctctggggcgactttgtgagtgttggtgaggtgaatgcaatttctgatgtgctctccccgttttaacagttgtgccgattctgtaaattcttcgatgtcttcggcgtaacactttctgccggcattttgatttgtctgagcatggacaggtgccaatgc

SEQ ID NO: 44603 - DNA, 726 bp, Heterodera glycines
aaaagtaaataaggctctctgatgcttttctatcaaaagggagatgaataaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaacgtgctctgaaacacacaaaactttatttacaggttagtttaggcactctgatgctttttctatcaaaaagggagatgaataaaatttt

SEQ ID NO: 44604 - DNA, 1054 bp, Heterodera glycines
  misc_feature (77)..(77): n is a, c, g, or t
  misc_feature (81)..(81): n is a, c, g, or t
gttaaatttaaatttattaaacaaccaatttaaaaaagccaaactcgtatccagagaaagagaaggccggaaaaatntttntaatggacaaatttttgaaatttctatgatatttaattaaaattttccgtcggcgcctataggtactgctgggccccattgtaccattattttttgaaaatttgaccccagaatggcaaaaatgggtcatttttggcaaaaaaaaaaccgcgacaaatgccagttttttgcccggctgttaaagtgcaaaatattttagaattttaaatttatttttggctttgaattctactcacttaatccgaagtttgtccccaattgaaagcttggaaagtgcgtccatcgcctttgtgttgctttccgggacggccaaccaactgagcacttcggtgaagccggcatcctccacctttcgagactggcacagaaattgctcaccgccaatgtcgaaactgtcaaaagtaggtggaacggtaacacttaattataaattttacagaaccatccgtaattttatttaagaaattaatgtttttgggtccggcggtgccgatgggtgccgccgcaagaaaaaccgagaattttggccatatttttaacaaattttcaccaaaaattgataattttttggattttcggaaaaaaaacttttgtttcggcgagatttcagcagcgagattttggggtttattcattatccacccattttttgttatttaaaattatgcaattaaatgatcttacatcacacttttgagcatgtatttgcacgggcgcataagcgtggcgagaaaatggtacgcaatttgttcgtaaagcgcatgcgcatcttcgtacaagcatttgtccacttctacgaagcattcatttattaacaataatatgcaaaaaacgcatgaaaaggaggggggggggggggtcagcggaagattttgcgaggtcaagaaaatgttggaatttttaaggaattttctaatttgtaagaaaatttgtacaatatacaaaatgttttacctctttcccctcttcgccg

SEQ ID NO: 44605 - DNA, 1002 bp, Heterodera glycines
  misc_feature (5)..(5): n is a, c, g, or t
gtggncccgttgattgagtatgtgggcatcgatgatccgaccattgtattcaacgcgatcttcgtcaccatggtattgcttttcgttttttccaaatttgcagtattactccgctgctccgtaaagttattgcaaaaaataatgggtgcatctttgaaaattgctcccatagatacccttggcttttatgaattactggaccaaatacctcaaaatgggtcatagaatctgtgtaaaatgctctttcgcgcactaatacaccgtttttctgggggggggggggcggtaaggctttggctaaattcggaaaattgtttacaattagttcgtgtttttcaaaaatttggaaagggccagacatagcgtcattccggatgtattcattcctataaaaactcattttttcccgtctcgctgtttcagctcgtcttcggctccttcaccatgtccgcgttgtacgccgattcgaccaaataccttcacttgggaggtgtgagaaataaaatactaggaaattttgttgcggatgattcttttttgctcatgcatttttttcaaaaaacttggtgaaaatggtatccgtcagttttacaattcccaagaaatacgggcctgaatggggaaacagcaatttgaggttataaattcccctatttttacaggtatcctctcatctgcactgttttgcatgctgatcgtcctgtacgttttcttttccgtttcagaaaattacaaagaaaataaatgaaattttttggtacattcactaaaaggagatgtggaggggggaactcgacaagaaaatcaacgactttctttgggcggaatgaatcgtactttttccagaattgttccgcaaaattgagcaaaaaatgcttggagaaaccaaaaaatttggaattttgaattcggaaattataattctctattcttttttaggcttttcgccccgtacactccgttcgaacgctcgttcatgctctgggccgggttggcgatcaa

SEQ ID NO: 44606 - DNA, 1051 bp, Heterodera glycines
tttttattgaaattctgaacccgtttgaagtaggattagactagaaaaaaatgaaaaattttgaaatcatgttttccccctcccttttccccgggggtatttttttgtaaagtctttttttccccaataaacttttcaacccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactagaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaatatttatgaattaattttgcaaataaataaaaacgaa

SEQ ID NO: 44607 - DNA, 854 bp, Heterodera glycines
  misc_feature (20)..(20): n is a, c, g, or t
caaaccccagattttgaatnccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattgaaaagagcagctcgagctctacaagaaggtatggaaagaaaaaatagttatttctgggactttttcagaaatcagaattaattctccaatgtggcccaaattttaggcccccagccacagccccttgcttctcccagttttgagtcttggatttgtcaaaaaaaatcaagacttcaaattaataatcaaaaattctcttaa

SEQ ID NO: 44608 - DNA, 1566 bp, Heterodera glycines
taagaaaaatgagctttttatcaacaaaatcaaataatccaaaaagagataatattatatatattatttaatcgcaattcaaataatttaaaaattattcaaaaacagtaaagaacgtgaaaaaggaaaggaaaaatttacagccagagattttgttaacaatgatgatcaggcatgaattaaaaattcataaataattgtgataattgacgatgcctaggtttttccttaacaaaattaacggtaaaaaatttaacataaattattattgtcgcaatgtaaaaattaagttggctattattttttcaccaaaaaatttattattcggtaaatttttgtttttctttgatattttgtcaaaaatattttgaaatattttaaattttcatgatatttagtcatttaaaattgaattttaaattacaaccaaaggaaaattttttgaaaattttggtttactttgttaacaaattatgccaagaatggtcgatttttatgagtatttttgtttaaaaagctttatcacaaaagaattaccgtatttattgatagaacccccctctgaattataacccccccaggaaaattttttcccaaaaaatacaatttttttgtaccaggtattttatattagatatattccaccctatataaataaaggggtacaatttaactaaatcttaacctgaaattttggaattaaaaaaattaattttttttttgcccatggaaatataggcgtgtgtgtgaaaattcataactaactcaatgttgaccaatatagtgtaaaatatctataaaaatagagaaaaagctggaggattttatgctttttattagaatttcttctttcaataagaaaaaattgttacataaatttttgaatatttcaatttttcaaaaatgttaatttaactattctgaaaatgtttttggaaaagaaatataaaaaaccctcatttttttcctctataagtcaaaattgtttgaatttttatgcatttgggttatttttgcccatttttaactaaccgtgcaacttaatactgtttattggcctctgttaagcatgtacaatttttgagactattacaactccgaactgaataagaaaatcggcattttcattccttaatcggacaagaattttgaattaacctcattgaatattattgaattttaagaaatcgatttgagacaaagctgtgcttcaattgatttgagtatacagattccattcgttatttttgttatccattttacaaaatttcagaccgttgaaaatcattttattaaggtattgccgaaattgaaaaaaaaataattaaaatccctgaaaaatttcggtagttttgccaaaattttacaaaaaaacgtcattttttgttggatttttgaaaaaatgcaggttgaaaaatataacacccctctgaattagaatccccctctcgaggggttgaaaaataaaacccccgggggttatatttcaataatacggtaattaaattaattatctaatgtaaacattaaattaatgtatttttatagacgtttaaataaatcttt

SEQ ID NO: 44609 - DNA, 780 bp, Heterodera glycines
  misc_feature (627)..(627): n is a, c, g, or t
  misc_feature (651)..(651): n is a, c, g, or t
aattttttattccttttgcctgtatattaaatccttaaaatttagaaagacatttaaaaaaataactctaattactccacagtgtttaatcgtatgcaatgtggttaattatcattcataacattatcacgttgttgcttaaaccccctcaacatttcaatttttctcaattatgcccctgggctcatctttaattttttgactaaaattacaataaattttttatattccactgttttcaatactagcaaacttttccatatcacttaaaaggctgatattcctagtttttgttaacaaataatcttttttatatctagagcgttgaataaataggatgaaaatgttttaatcaaatattttacttttttctgcaccttgttttggagcagttacattaagtctatgttatagccagcatcctcaaacaaatttgatatcttcaaattttttattccttttgcctgtatattaaatagtcaaaatttagaaagacatttaaaaaaataactctaattactccacagtgtttaatcgtatgcaatgtggttaattatcattcataacattatcacgttgttgcttaaaccccctcaacatttcaatttttctcaattatgcccctgngctcatctttaattttttgactanatttacaataaattatttatattccactgttttcaatactatcaaacttttccatatcacttaaaaggctgatattcctagtttttgttaacaaataatcttttttatatctagagcgttgaataaata

SEQ ID NO: 44610 - DNA, 1004 bp, Heterodera glycines
gtcgtaatgccactgtccaattgtccacttctgtccaaatgaccttcactgtcctaatgtccactgtccaaatgtccgggagccaattggctaattttcagtgaaacctgtttataaatgatcaaaatttccaattttcccccggctgcgcctatcggcaccgctgtgcccccaaaactcccattgtttcttagaaaaatggcccaaaatcgcaaaatttggtaattttatgggaaaatctgtttccgcggcgccgcctgccccctcttcccaaagttttttggaaaaagcgcgcctcaaaaagttttttattcatttttaaaatttggaataaattttacaaaaaatgatttttgccttatgattttgactattaaaagttttagaaacaatttcgtcgcttttcacgtttcgcaatttcgcgttttttggaattttgcgtttcgcatttattttcatttcgcattttttactttcgcaaatttcgcatttctctcattttattttccgatttggcccatccctgttgcataatgaggtggagaattcgttcgaaagtgacaaattgggcatagactgatcggaaaaatgcaaaattcgacactccaacacctaaaataagttggttatttggacataaacttatcggaaaaatctgttaattagcaaactaaaataaatgattggacattcattaaccgaaaaatgaaatttcactccgatcagatcaccaaatgatcagaaaagattcaaacttagcacagagtgatcaaaaaatgtatagaacgatgaaaaatgaattgtcattactaaatgaattacaagtacatttaaatgttaaacctgatatcagatattcatattcgggcctagactgatcggaaaatttagaaaaaaaaattcctaaaattttttcaatgatcaattttgcagctttctaccgacggtgagaaaagcagcactagaaagtcaaacggaggcgaaaaaaaaagcgggggaatgaa

SEQ ID NO: 44611 - DNA, 1042 bp, Heterodera glycines
aaaaaatttaacgaatttcactatgaaaacttaaattctctatttatatatttgtatgtactttggcttaacaagaaaaaaggtgagtcaaaaaagaatattgttagtggacagaacaagactcaatttaaaaattttcaatataattgactcaatcttaagtttcaataagaagataaatatgaatctattttattcagaagaggagaaaattaataatacacaaaatagtataggtttgcacgtgctagaaaaagaatgaagttagtattataataatttagaaatcattttagaaaataagaaattatataagaggtaaaatttctcagaatcttattcgaatttttaaatcaaatataatgaataaaattaaaacagtatacatttgtaattttcaaaaattactaaaattacagaatttattttaacatcggcgattttggataatatttataatttcagaaattattcgagaaaataaaaggtgtaataattttgctaatgaaattataaaaaatgcatgcaatacaaaagtaaaattagtgaaaattttcactcataaaaccctaataataaatcgaattttaaacatatggaatcacaatctttaataagaaagcataatttaagattataatctcatgcagaaaaactacagagaaaagtcgcaccgaaaatttcgtttacccattttccgaagcatatacattttttaatcattcatttaatgaatcaagaataatattcacgatattaatttaataaagcaaatttaaggcgaaattataaaacatttaattttatggaaggattaagaaaaattaactaaaaaattcaacccaaaataaaaagaaaattaaaaaaaaatttcatttttccaaaaaaagagatgaactatacaaatgatgaaatatatgaaagcattgaatttatttaccttcgaagtaatttttaatattactttgacgtatttttttaagtttgtaaaagcccattaaaattatctaatttactgaaaattaattttgcattgggaaac

SEQ ID NO: 44612 - DNA, 735 bp, Heterodera glycines
atttcagcgtttttggaaaaatttttgaaactttctttttcactataaaatgactaaaaaatcgttgaaaatttttccataatttttttcttagattatcttataaaagaatttctaaaatttgtagaaaaattttgaaatttgaaaatcttggtaactccatagtttttgtaagacaatttttaaagttgggtgaaaaaaattcttcaaccctgaaacaaaaattttgagccaaaaatttggcatcattcaaatggtttttttatttttaggacaaaggacgtttttgtcaattcatttttaccccgattcgtttttgtctatatttaggtatgtacactggtggaaaaaatttttatgcaccacataattattttgatccactcattcattctgagcatgagtcgtttgatcactctttactcaaaaaagggaggaaaaaagtctttactcagaacatgaaaaaccaccttaaaattcatttaaaaacctgaaatatatttcatgctagcttatcttttgatactgatcaaaaaagtctcttacatcaacttgatcagatcactctttcatggtgaccaggaaagtcaaaaatggcttgaaattggggaaattttagaaaaaaattcctagggggttaggaaattttgaataggctcattggatagagcacaaaattcactacagaattgccttttggatggttaggctaacgatgtatactcgcttgagata

SEQ ID NO: 44613 - DNA, 488 bp, Heterodera glycines
ttccaactctaattaaggaacaaaattataattttacgttttggaacgagctgaaaattttcgccatttaatcacacaaaaaaacaaaaacatttaaaataaaataaattttaaaataacaaacagagacacatatccaaaattagaaattccttaaaaaatcatttttccaaattgaagcaaatttcttttttccatcttttcaaatttgcacttccaatttccaattttttggcaattattttatcactaatttttgggttcttttcaatcgtttcaaaatattgattcatttttcttaatttctcatcgttgaaatattttgcctaaatattaaaaaataataaaaaaaatttacttacttttataacaatttggcatcaattcttttttccattttataaatgttccttcaaaaatgcccaattccttcacaaattctttctgtttgcccttatataaacgtttaaattcatcaaatcgttcaa

SEQ ID NO: 44614 - DNA, 915 bp, Heterodera glycines
atgatttcgaaattttcaattctttttatgatattctactcaaaaacggctcgaaattcagtaacaataacattcacggagagaaaaatggggcttgacatgtttattgttgaaaaaaagactttacgaaatagtacccctggtagaagggagagaaaaacatgatttctgaattctcccctttttctagaactatatctactctgatatggatcataattccctagaaataacattcacttccgcataaaaatgatgatagacaatattattgaagaatcattgactttaccatgtaatacccctgctaaaatgtatcgagaaacatgatttcaagattttctgttttttttatttctaatctactcaaccctatatcgaaattccataaaaatttcattcacgatgcgaaaattggagttcgacaactttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattg

SEQ ID NO: 44615 - DNA, 1162 bp, Heterodera glycines
tagtggtcaaaaagttcgtacatctactgctcgtcccccgaattggtcaacaacttacttggaatatcctctggcaattcagctgattgttgcgcatatcccaaatctgaaaaaacattgccgaatttaaattttgcggattttgtgtccaactttggccatgcaatcctcccctcccgtgtacatccacgcaccgtccacttggaagcccaccgaagtcacatttttctcatggacactgcagaaaaaattagaaaaatattgtacaatatttcttgggacgaaactaaactcggacttccaaattcgtattgataccccgaattgtgtaataaacagaaattgtattgcaaatcgcagtacgagttggattttatcattcttttgcttttaattagtgtacaattaaacggtaaaaaacaaatttgtgcacaaaattcaaaatttgtctgactttttgaccatttttaaaaggaatgtgataattttaaaacgaaaaacgattcaaaattatcataaattgacaatgcgttccctttttgcgtttcttacgaaaatgtgtgtagtccttgcgcggttggacattgcaaatcgtaaaaacgaatgttttgccatgcgccgacgagcagttgggcaccgtcgggcgtaatgcaaatgttgttcacctgggattcctgtcaaaaaaatggacatgaaatcggggaaaaaggaaacgccaaatttgggggtaaatttcatggatttcaaaaatagtagattttgttttcgaaattctcatccctaaatcctttaaaatcattgaattttcaccgtccacgcgcactttgtaggggagtgcctccaactgtttctgcgatgccacgtcccaaatctgaatatttttagcgatcatttaatgcgaatgactattaaaactcgcatttcaacaaaaatcctaaattcgaatgaggggaagaaatgaaaaagtttacccgaatggtggcatccattgcggcagaaaccaacattggccgtgtcattcccatggtaaaaatgtcaaaaaagcgaattaaaacagcaaaactttgtgtcaaagaaaatattcaacgaaaatattggacggttcggtaaacatataacaaaaaagaaaaacaattggcaaaaaatctttgtacaaaaaaaa

SEQ ID NO: 44616 - DNA, 957 bp, Heterodera glycines
  misc_feature (944)..(945): n is a, c, g, or t
tgctaattactcgtccaaaatgaatagatgagattactttgataataatctttaggggatattagcccatcaatttttaagctaattactggtccaaaatgattcgataagattaattggattaatatcaatcattaaagaattattagttaattaatttaattacccttatataagctgaagagtttccgtattagcatataaaatatatttatgggattttagcaaatttcctttcttgtagccgaaattttttttatgttaatgcattaaaacactgaaaaaatcgaaacaaataatttttcaaattcttatttactatatcagaaatataaaataattttgtgtgtaaataatttgacagaaatttgttatttttcacaaaaaaaatatcggaaatgtttttttttctttgaattattttatttaagtattttccggagaagaatgcacattttaacattttgccatttttttccaattttggcacatttttggcactattttgcgatgcttttttaatccatctaaatcccaattcattctgctggaaacgatttcaagaatgaccttgtacaaaaaccctcttattctaaggaatgtccttggaaataaggataataatttgccgcccccctaccattttagctgaaaagtactccgctggtgcttgagcagtccagcttatggtatctgaaatacggatcacacaaatccgcgcggcttcaaccaaacggcattccatttgcaatgaacgctgaaacgtcgtcattcaaacaggatgaagcctaaagaagacataaattgtgcctcataatctttgattagccaagatagaaattgatagattaatgggagatcagtagtacttttaattggatatatattaatttcctcacaatttaatggctttgtaaaatttgattggtccatttccatgcatnntggtaaaattta

SEQ ID NO: 44617 - DNA, 907 bp, Heterodera glycines
  misc_feature (67)..(67): n is a, c, g, or t
aattttgagaagtgagatagaaatgataactttcacgattcaaccaaattttcggtgctctaattanccgcgataaaaacattcgaatcaattaaatagcttctgagataataaggtttatcataaaatttcatttaaaaataaaccctcaattattggtatgaacgatactttccaaacatgcacacgttttgcgctcgagctattcatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagatagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctattcatcatcgggcttgtcaatccaaagcgaaacaacaaagatggtgttttgatcgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcactattcaaaccaattttcggtgctctaattaaccgcgataaaaacattcgaa

SEQ ID NO: 44618 - DNA, 610 bp, Heterodera glycines
agatatacttgtttaaatatctgatcaccataaaaatgatcaatttttgatcagcgccataactttttctaaaagcacccaataatggtatcatttgatagacctgagtgtcccctatttgcctttaaaatttcaaaaaatttggttgtgtttcaaaaaagttgcggcttgtaaatttcaaaaattgatttggtaaacctttttgaccacaacttctttgaaactcaactaaatttttttgtattttactggaaaatagaggacactcagggctatcaaaagatgccaagaatgtttaatttgggtgcttctataaaaagttatgttgcatgaaatttatcaaaatataacatggtcgtgtctttattcgtggtcgagtaaactgaaatagagcaaaatataatttaattatggtagcaagagctaattaatagattaaaaatttaaataattaattgatcattagaacaactcttccgtactgaaatgacccaccccctccgatcaccccacactcatacttttttcgcttcgcccacactcatactttttcgcttcgcccacactcatacttttttcgcttcgccacacgcatacttttttcgcttcg

SEQ ID NO: 44619 - DNA, 1230 bp, Heterodera glycines
aaaattagagtagagcgggcccgggaattttgggcaaaaccgggatcgggactagccgggacctgagaagccgggaccgggacctcgatttttcttcgggaccgggaccgggaccaaccgggaatttttaaaaattcaaaaaaattcaaaaaattaaaaaaaatcaaattttaatttatttcaagtgaaaatattaaataattaaatttttatttagttttttatttaataaaacccaaaagttaaagctaataaattaatgaaaattttcaaatcaaattttcttcatttctttcaaacaattaatcatttttggactaagtgatcgaatattattagaaattcagatttacgtttcacataaattttttcggcgcgctttttccaaaaaatttaggcgaagaaaggggtccggcggtgccgataggcgccgccgggggaaattttgaaaatttgagtgtaatttattaacagattttcaacaaaaaatgataaaaatgtgttaatttaaaaaaaaaactatgaggaatcatattttgtcgataggaaagccatgagtatacaaaaaaaaataaaatattttaattactgtagaggaattgaacaatgggaaagaagaagagaaagtcaaggagactagccagtaggccatttgcacaactggcagtgttacttttaaagaatattaattattattttttaatttttttccttttactccaattttcatcactaattttcactcagacccccattcttaccagtgattgtttttcccggttcccggttgccctaccgggaccgggacctgagcttttcaaaacccgggaccgggacctcggatgaccgggaatttccggcccggtcccggtcccgcttcactcttagtcattttcattaattagtttgttaatttattttacaaaacgaaaacaaaacggcggtgggaaaaaagaaaaattgaggagagcgaaaaaaagaaggggagagagagaaagaagggtgagaagagagaaggggtgagggaagagagaagagaaaagcacaaagaggagtagaggagggagaaataggcgggaaaaaaaggagaaagatggagaaacaattagagaaagagaggaaaggagaggagagaaaaaagaggattagaagtcgaaggagggagaagagagaagggaggggaggagagaaagaaaagagagaagacaaaacgaaagagaagaaaggagg

SEQ ID NO: 44620 - DNA, 1313 bp, Heterodera glycines
tcaagaattacacgaatcgcattaaaaagagcaaccccccccccatataaataaattcacatctgctggaagacgaaaacattatctgatcatataccagaattaaaattaaatactgatttttcttttaatacttttatattataaatataataattggaaaagtgtcaacaaaaaatattttgaaaaaataaagaaaattttatctaatcacgttaaggaataagcggtgagttattttttgatttaaaaaagaaataaaataatagattttgtatgtatattataaaaatttttatttaaaattaaaattcatttttaattaatgaataaatatggaactgtcgtataattatttaaatgccaatgtttaaattccaattcaattttttcacttacattgagaacaatgcttatggtaaaggttgaaaaaacactgaaatttaaaaatttacaattacaaatataattgattatatttaatagacttatttttgaaaaattctaaaatatttatgaatagtgaattagaaaaatcaaatgaattattttattatcaatctatactttctatttgggtaaaaatttatttaatattaaattatttaagcaatgaaagcgaatcaaagcaaaaacaattaaaatttaaaaatttatatcttcaacaataaagtctttagaaagtggtggcacacacagtagaagactatgacttttttatggagaacgaagcattttaaaaatttattaaataaaaggtactaaaattaaaatatgaatttactaataaagaaaatcaaaaataaattaagtacgatagaatttacactttaccatttgtttatgactaataattaattaccaactaatagaatttaaacgatcttataaaaatacccgcaagaaataattaaattaagtaatccctaaatatttggaataattaaaatctttcacaaaggaaataaaatggattaaataaaataaatcattttgaagattgtattaaaataacatttttgtgcgttaattttaaattttatttaatttcttattttgcaataaaagcattaattttttgaattatttatttattttataatttaaaaatctaaaaatattagtagtgataaataataaaaaattaaattaaattaaagtattaataaaaacacgaccaacgaaaacgtgcagagtctcatggacatgattaacaaaaactaaaataaaattattatcaataaagacacgaataaatatttatataatgaaccaaaaatgaaattaattattgaaaaaaatttaaaaaaaaa

SEQ ID NO: 44621 - DNA, 949 bp, Heterodera glycines
cagcataatgacgcagatactaattgttctggaattattttctcagcgcatttgatcgtgaaaattttggaaaaatggctatctcttattctggctacagtcaagggaattccaaccgcactctcagcataatgacgccgatactaattgttctggaattattttctcagcgcatttgatcgtgaaaattttggaaaaatggctatctctttttctggctacagtcaagagaattccaaccgcactctcagcataatgacgccgatactaattgttctggaattattttctcagcgcatttgatcgtgaaaattttggaaaaatggctatctctttttctggtctacagtcaagggaattccaaccgcactctcagcataatgacgccgatattaattgttctggaatttttttctcagcgcatttgatcgtgaaaattttggaaaaatggctatctctttttctggtctacagtcaagggaattccaaccgcactctcagcataatgacgccgatattaattgttctggaatttttttctcagcgcatttgatcgtgaaaattttggaaaactggctatctctttttctggtctacagtcaagggaattccaaccgcactctcagcataatgacgccgatactaattgttctggaattattttctcagcgcatttgatcgtgaaaattttggaaaaatggctatctctttttctggctacagtcaagggaattccaaccgcactctcagcataatgacgccgatactaattgttctggaattattttctcagcgcatttgatcgtgaaaattttggaaaaatggctatctctttttctggctacagacaagggaattccaaccgcactctcagcataatgacgccgaaactaattgttcctgaaattttttctcagcggatttgatcgtgaaaattttggaaaaatgg

SEQ ID NO: 44622 - DNA, 1001 bp, Heterodera glycines
  misc_feature (960)..(960): n is a, c, g, or t
gtatttgctggtccgtaaggtccaaagcgacgcgttgttccgcgtaacagagcgaacgccacgacgcacgacgcgcagtaatcgcacctttgtaggcggtgccgagcaactcgcgctcctctctgttcaaattggcgtctgcttggatcatctgaaaataaaaaatgaaaacaaatcaaatgcaatgctttcaatcatcgaccacaccttcttcattgcctcggtcatgtcatcgtagcgtcgtgccttctcacaaactctggcaaagaacacaatgtcctctttggaatcggtgaccattgcgcaattcgaagaagccaaatattagcaacttaactattccgtcccgattaaagaacagatttcattaaatataaagaattgaaaaaatacaaatatttgctttccaaaaggaataagtcgtgaaattcgtttcccttttggggccatttttaaattcgaggagaatgaagacaatttagactaacagtatcaataagattttatcaataaatgctaattttggtacaaaaaagagtcgatggtagagtaatacataatggtgaattcagtttgtgttcgagttttagccggttttgaactaaaaatgcgaaattcaagaattttaagtttcatctgaagtttcaacttttgattcgaattgattggggttcagaattgccgaaaggttgtcaaattcgtgatcagaaataaaaaaaaagcattagaattttacgcaacgatttttcatgaataaatgtaaaaataaaaataaattgtgtagtacggtgtgaatgcaacgaaattagactgagggtgattgaagaaaactggcctcgttatatatacaattttgggctttagtccactcgacaacgacgcgcgattcaagcgtttttccatatttggcgcttcgaaccgcggcaatttgaatccgcgactgcgaaattttttgcgcgnacctatatgactggcgatccacggctttttcgggactaata

SEQ ID NO: 44623 - DNA, 457 bp, Heterodera glycines
  misc_feature (406)..(406): n is a, c, g, or t
atattacagatgattgaaaaagaatcattcatttctccacggattcattttttcagaattgtcttttaatttaaaaataattaatttatcactaaataaaggttgttttttaaggctctgtatttgtctcgccccactacagtttttacgccgtctttgcatactcttttttgcgtagttcaaaatctgaaagtgattttatgtttttttttctggctcacctaataattattcgtttgagccattctaatattgtgatttttttttttgcttttctaaattatatattaagtggggctatgtttagacttttgcactgactgtatacatatagataaattgttttttaaatattatgcaatgagaaaaagtgaagagcaaaggtcaaatcacacaataaaaaacngaataattgtcgggttaattcgggaaaagaaagtgtacctgggcataaact

SEQ ID NO: 44624 - DNA, 1085 bp, Heterodera glycines
  misc_feature (979)..(979): n is a, c, g, or t
acattatgtgtcgttaattttatgctaattctggctcttttctaagaacccgtgcggaaatataaaagcaaggaagtcttctgctcgcctttgcagcctctgtacggcactggggccaacactttatgtgtcgttaattttatgctaattctggctcttttctaagaacccgtgcggaaatataaaagcaaggaagtcttctgcacgcctttgcagcctctgtacggcactggggccaacactttatgtgtcgttaattttatgctaattctggctcttttctaagaacacgtgtggaaatataaaagcaaggaagtcttctgcacgcctttgcagcctctgtacggcactggggccaaccctttatgtgtcgttaattttatgctaattctggctcttttctaagaacccgtgcggaaatataaaagcaaggaagtcttctgctcgcctttgcagcctctgtacggcactggggccaacacattatgtgtcgttaattttatgctaattctggctcttttctaagaacccgtgcggaaatataaaagcaaggaagtcttctgcacgcctttgcagcctctgtacggcactggggccaacactttatgtgtcgttaattttatgctaattctggctcttttctaagaacccgtgcggaaatataaaagcaaggaagtcttctgctcgcctttgcagcctctgtacggcactggggccaacactttatgtgtcgttcattttatgctaattctggctcttttctaagaacccgtgcggaaatataaaagcaaggaagtattatgctcgcctttgcagcctctgtacggcactggggccaacactttatgtgtcgttaattttatgctaattctggctcttttctaagaactcgtgcggaaatataaaagcaaggaagtactatgctcgcctttgcagcctctgtacggcactggggcccacactttatgtgtcgttattntatgctaattctggctcttttctaagaccccgtgcggaaatataaaagcaagaagtcttctgctcgcctttgcagcctctgtacggcactggggccaacactttat

SEQ ID NO: 44625 - DNA, 932 bp, Heterodera glycines
  misc_feature (77)..(77): n is a, c, g, or t
cccctcaccatttcatttttatcaattatgcccctgggctcatctttaattttttgcttaaaattacgatatttttnttatattccactgttttcaatactagcaaacttttccatatcacttataaggctgatattcctagtttttgttaacaaataatcttttttatatctagagcgttgaataaataggatgaaaatgttttaatcaaatattttacttttttctgcaccttgttttggagcagttacattaagtctatgttatagccagcatcctcaaacaaatttgatatcttcaaattttttattccttttgccgttatattaaatagtcaaaatttagaaagacatttaaaaaaataactctaattactccacagtgtttaatcatatgtaatgtgattaattatcattcataacattaacacgttgttgcttaaaccccctcaacatttcaattttcctcaattatgcccctgggctcatctttaattttttgcataaaattacaataaattttttatattccactgttttcaatactagcaaacttttccatatcacttataaggctgatattcctagtttttgttaacaaataatcttttttatatctagagcgttgaataaataggaggaaaatgttttaatcaaatattttacttttttctgcaccttgttttggagcagttacattaagtctatgttatagccagcatcctcaaacaaatttgatatcttcaaattttttattccttttgccggtatattaaatactcagaatttagaaagacatttaaaaaaataactctaattactccacagtgtttaatcgtatgcaatgtggttaattatcattaataacataatcatgttgttgcttaaaccccctcaacatttcaatttttctaaattatgcccctgagctca

SEQ ID NO: 44626 - DNA, 1600 bp, Heterodera glycines
  misc_feature (1024)..(1024): n is a, c, g, or t
attcccctggggcaaataaattcatcctcatcaatgctccatccactttattttcattctccctcttaattatcccttgctgatccagtctttctttcagcaaaaatctcccgaaatcgcctccccaccagccacccatttctccacaataatctctccccccccgcccatcccatcactaagttgtccagcaattatgcaaatgtgtcccctctttctctccccatttttatctgttttttactctcctatgtgaacacaattcactcactcattcactttccaaccatttgtccttacgccgattaaagccaaaataacctttagaagccggatttggtgcaattgctggcagcagggcaacaaaaatgtcccgctgttgcctcttcctctgcctcctgctcttcccctgcttttccccgcttttcccttcccccgctcactcttcactaatgattgagggtctttttctaattgcttgtccctctggccaaatctttccttccaagtcgatttgtcttctccgcctcctcgcgatgtaaacaaatgttgtccttccattcggacatgtccgggatttccttctgcttctgatccggctactccccgcccatttatcattccccccccccccccctcttctcgctttttcctttcttttctcgccgcgtctctttttacctttggctttgctcttctttctgctgattggaaattcaatttttgaaaagatttttccttgataatttactcatttacctctttttttttttgtcctttttcggccttttccactcccatcgtcgttgatgcaaatttctctccccttctcccttttccttttcccctcaccctcccaccgttttccattctcttcctcttctttctttctctgtgtctctcttcatctcccatcatccttttccccttgatcctcttcttccgtccactccctcccatctcatcacttttgtttgcaagtcggcttttccctcctccgcttccatcagtggacaatggactntaacctgtcccctccctctccccccccccgccgctttggccccattggcaaacacaaaaacggtgaggctgagaatggccataagatcgaagaagacttctcggctaattatccgtggaaatcaccggccgaccaatcgaatgatttgtgagtgtgcggagtgaccacaccaccaccatcagcaacagaacaaaacatttttgttctttgtccgccctccgtccgttctttcgtccgtccgtcgctttgatgattttgtggccgctcttttctcataaattctttcatttttcaaaaaatctttgcggtgggaaagcatttgattttttgctgaaatccggaatttattttccattttttttattttcgattgttttgccatttctcttttggcactttcttttgaacttttcctttatttattcatttattattattattttctcttttaatccctctaaaaatacaaaacggaaattgcgcgattttgtgctattattcatcaccacacgacaaatttatttgcacttggccaatttatcctttcactgggctaattatcccttctgctgcgag

SEQ ID NO: 44627 - DNA, 1370 bp, Heterodera glycines
  misc_feature (39)..(39): n is a, c, g, or t
  misc_feature (84)..(84): n is a, c, g, or t
  misc_feature (313)..(313): n is a, c, g, or t
tttgctctatttcttagcaaactttgcacaaaaatgacncaagtgctctatgaaaacaatatgcaattcgtaaactttcaattntatccagtgtaaatttttcacggaataaccgtgaattggccccgtgaatcgtgaccgtgactgtgagtgaaaaaggcatttatgtagagactacattttattaaaattaatatttttctatattaaatgaattatttttattaaatattttgtaaaaactatgaatggactaattaaaaataaaagaaaattcattaaataaataattaaggaccaaccgcaaatttanacaatgactgtgttattaacggagttccgttccaaaaggtagacttcatctcatcaccttaccaatttattcatctagcatgatagtgattattcaaatccggacaaatttggtcctgaaacgcattttcacctcttttttaaaaggtttatgtcagcgcaaaagacggcacttgacccattggcattttgacttttggcattggtccccgaaattgcattggaatgcgttttgccaaattaaaattgacatttaaaaataaccactttgctttttagcttaataaacccaaccttaaaatcaaggtgtgatccatttaccaataattagtgctatttatcgccattttaaattatttatgcttctttaattcattatttttttgttttttgaaatttcagaacaattctcattgagagttttaaggcttcatgcccctatttttggatttctaaaatgcaaatttcccaggctacatcgcgtcgcaatgcgaaagcgttcaacagtggcgacgcaaatttcaccgaaagccaataaaatttgacatttaaaatagccgattggctttttagcttaataaagggccgccgctctgttaaacattctttcaaaccatgtttttgttttgtttttttttgaaaaatgccatttattcattttttgtaaatgagctgctgattattacgaattctatcatcattatcgaccaccaaatgaccatttccggcatttctgtccctcgctttttgtactgcttcctctcggtgcccttctttttgcttatgctttctttgctgcaaccaccgcggctgccatcttcttcttgaccgccagcacggaggagcggggcgggcacggacagtagccgctgtccttgccgggttggccaggcgctccgggctgtccaggctgaccagagtttccaggcagaccgggctggccaggcgcaccctggggtccgggcggtccttggccgccgggctgtcctggttggccttggctgccggggttttccgggttgtccaggcgcgccggggcgatcccttcgggccaggaa

SEQ ID NO: 44628 - DNA, 557 bp, Heterodera glycines
  misc_feature (14)..(14): n is a, c, g, or t
cccaccagcaattncaatctctggggactcaattctccgcgtttccaatctctgggactcaacccaccaaccttcaatgacattccaatcactgaaactaaaccctccagcaattcaatctctgggactcaaatctccggcattctaaacattgggactcaacccaccaactttcaatgacattccaatcactgaaactaaacccaccagaatttcaatctatgggactcaaatctccggcattacaaacactgggactcaacccaccaactttcaatgacattccaatcactgaaactaaacccaccagcatttcaatctctgggactcaaatctccggcattacaaacactgggactcaacccaccaactttcaatgacattccaatcactgaaactaaacccaccagcatttcaatctctgtgactcaaatctccggcattacaaacactgggactcaacctcagcaaatttctttagcatttttaactttttgtgtgccttgggatgttgaacagttggggagggctcggccgcttcgcggcctcgtacgggg

SEQ ID NO: 44629 - DNA, 1088 bp, Heterodera glycines
aaaaaagagatagccatttttttgggcccgtccataccttcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaccatgggggggccactgtcattgtttccaaagagatttctattac

SEQ ID NO: 44630 - DNA, 937 bp, Heterodera glycines
  misc_feature (846)..(846): n is a, c, g, or t
ggaaaggtagaatttgaatggtcagactatatttacactgagcacccgtagaatcgggtgatgccaagccatatgacactgctattttgatgttctgcccgcaattctaccaaaaacgagtttagaccgcagtaacgcgctctcagagggaagattaagggacacgaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaaggaacgcaaaagagatgatttaaaagcgattcgaaaattctatcgactgatataataacgatgcagtcgcggcgttgacaactgagatggaaccaaaagttccataatatctttccataaggctggaaaggcagaatttgaatggccagtcgatatttacaatgagcgcccgttgaagcgggtgatgcgaagccatagcaaactgtatttttaaattctggctgcaattctaccaaaaacgtgtttagaccgcagtaactcggctcagagtgaagattaagggacgcaaaagagatgatttaaaagcgattcgaaaattctatcgactgatataataacgatgcagtcgcggcgttgacaactgagatggaaccaaaagatccataatatctttccatagggctgganaggcagaatttgaatggccagtcgatatttacactgagcacccgttgaagcgggtgatgcgaagccatagcaaactgtatttttaaattct

SEQ ID NO: 44631 - DNA, 83 bp, Heterodera glycines
cggccaggaggtggtggtggagttcatcaacggcgacctctgccgccccatcgtgatgggtgcgctctacaacggccagggcg

SEQ ID NO: 44632 - DNA, 899 bp, Heterodera glycines
ttgcttaatgtgttgcctctctttttctcactccttcctttgcttccgttttctctcgcccttttcctattggccttttcagtcacttctctctctttcgcctcctctctctccccttatctctcgccctctcccattatctatctctgttctcgccctctctctcattatctctctctgttctctcgccctctctcccattatctctctctgttctcgccctctctctcattatctctctctgttctctctccctctctcattatctctctctctctctctctctcattatttttcctccggtcatccaattggcggttatcgtgaactgtgtcgatttgctcaatttgacaataatttgtgcgacgtgtcgtattatgttttttctgcttttcttgtgactttgtccaagtgcgtttttggcttcccccccccccttttggctctttttgtctttttccctccccaattcatttttcgtcattcctcgagcgcgcgtcacgatttccgcaattggattgacttttgcccgtcctttgttatttgtccgccattagtcaaaattgcgctgccctttagctgttctcctaataaggctacttccatcaagtgaatgaataaatactcattgtttcttctgtttcttctcgcccattccctcgggtccctccgttttccttcgcccaattttcttccccaaaatttttctttgacttggctttaatttgatcttctctcctttcgagttcattcctttcacaagcttataaaatgcacaaccatcactcatttggctttattctatcatagaatggtcgaccgattgatcagagagtgagtgatcgattgacaacatttgatcctccgatagtcttaatttcatcattgcctcatcccca

SEQ ID NO: 44633 - DNA, 1238 bp, Heterodera glycines
  misc_feature (1159)..(1159): n is a, c, g, or t
  misc_feature (1168)..(1168): n is a, c, g, or t
  misc_feature (1181)..(1181): n is a, c, g, or t
atattaatcaactaatcaattaatttaaatttacattccttccaaatcgaacttaatttttgcttcaaagcatagtctactcaaattaataacttattggaattaatttaaaagcaaataaaatttttatatatgattttggcatattttatttcataaatgcccgaaataaaacgatcttttaattactgacgacaattttaagtgaatgaattttaaaatgggttcttgattttctttatgtaaaatggaccaaatggtttaacaaaaatttaagaaatgatatataaagaagtattagttaatacaaataattttttaatcccaaatacctacaatttgttgcttgataattaaacaaaatagtgcaaatggcacaatagtttaagcaaaaccatgaataataaaaatcatattattgtcaataaaaatttgttagttttaaagctcaaaaattaaaatatagctttaaaacataatttaacaaaaaaaatttaagcttaatataagaagaaaaaaataaaaaaggttttaaatcaaaaataataacatttatttatttattacacttgagaaaaaaacgtcgccgtttttacttgagattaaaagttactcaaaaaaaataatgaaagataataaaaaatatattactgttttaaaacctaaataaaatgaatggcaaaaggatgccgaacaaattgtaatgttcagaaaaacaggagaaaaaccaatcaatacggaaataagatattctatctgaccaaaaaggaaataaaaaataattaatgaaatcataataatattttgaaaatatacattaaaaaggaatattttgaaagataattgttccaaataaaattaatgtaagaaaaagtaaaaatatatgaaattaaaaaattattatggaatcgagattaatttaaatgagataatgtattgtaaaactaaaagatgtcaattaatttaattttattaaaaaataacatatttaattgatatttttaaatgggtttttgttaaatactaaaaaatcactaatatggggattgcgaataataaagttattacccgattaatattagatctgatttgaatttaattaagttgcaaaaataagattgaataaattctacaaatgattacctaaacagaatttaanctagaacanttccattgaaatnaaataaaaataaaaattatattaacaaattaatgaaaaaaagattacaattatttat

SEQ ID NO: 44634 - DNA, 1679 bp, Heterodera glycines
  misc_feature (15)..(15): n is a, c, g, or t
tgattccataatttntgagtttctcaaattgcctaactctttatttcctaaaagcgctaatttgtttttcagtgctccggatcacgtaattatcttctcaacgccacaatgctcccattttacgatccggtcgtattaaaccgaggtcattaattcgtctaaagatttaagagttcaattcaactcttaaaaagtaaccaatttttagtcggtctaagcaatgattacactgactttttgtattcattcgcgccacggccgacttgcaaatcggccggagggtgcggatcaccgtaagcaaaaatcaaattattaatccaaaaaaatcatttcccattcagctatttgttctgcgacaccacgaccaatggcactgcgttttgctgtgccaaaattaaaaggggaggaaattgtgccaaatttcaaaagaacagtaaaagaaaagcgaatttttaattatttggaattataatgttaaggcgaagaaccgtgctacgattctttttgcattaatgggcaatgccatgaagccaattatggcaaaatggtgggaagaatttcaatataaatagcatattcaaatggaatatttagctaattgttaatttagcactttttaaatgttgtccattcttccgaccaatcgttgtccgatgagccaagcagttctttcattggcacctcaacattacctggatttgttgcggatggaaccgatgtaaaagataatttattgaatattaaaaaaaaaattaaaacataattaattattaaaaattactttttaaattgttattatatttctgtaattgcaatgcttgttcccgcttttaagcatcacataaacttcacaacatcaaaaccttcatcaccaacaccttttcttcgggcgatgaaactgatcaaacaacggcatcttttcaactttcttccaccacttcaggtcaacaaacattactgtatgacgaaacttcaactgtatcgaatacagtaggaaacaacactgtggagctgcttaccaacacttcgccaactgttatttttaaatttaaaaccaatgaattttgcgataaaattaaataagctttttcaaagaaggcataattcaatttaataaaaatagccatcgcttccgaatgagcgccaatgctttgacaaccacgaatgctgcgcccattgggcagccaatggttcgtgctgtgcggcaccgcgattcatgaacacgtggtgccccgcgtcgtgccgttacgacgggtgccggccccatgcgacagaaggcctaatttttgttgtttttgaatggtttattcctgttttttccttttttcaattgaacaggactgtgccgccaagaaaaaaaacccgttttaccgggcgactcggtcccggttcaaaattttttctgggcgccctccgagaccgggcttttttcaaaatggtcctaaaaaacttcatcaatccaaagttattttttgatgcgtttatgttatttcacgcttttttcagatgggtgggaggtccgtgcatgaatttttttatgaattagcgtgataaaaattaatgtctttttattttcaaatttaggacaaacaatgttaaaaagaggttagattttgatccaaaaatttatttcttaaccgggcgggagtgatgacatttaacgaaatcttattgaaatt

SEQ ID NO: 44635 - DNA, 1170 bp, Heterodera glycines
ggaaaaggcaccgtaacccatgtaaaagtcaaacgggagttcaatgaacagcagacggaagagttgagacagaatggcggagccgtggccaagaaaaggaggacactgtccaaagtgcaatgcgccgaatgtgacgagtttttgccggacacggaaatgtcgcgactgaaccacacaaatgtgaagtgagtgagcaattgcatttgtttggccttcctttagtgcggctttaggcatttgatgctttgcctgttcaaatgtccgatgtgtgccagggaattcacttcaactttcaacggcctcgcctattgcgtgagtcacatcaaatggcatcattctggccaaatgattccctacgacgaggaaatgacaatggacaatctcccgcaaaaaatggttaaaatccgagcgcgggcttccgaactttttccctaaataaccaataaaaaagcaacgactaactttttgcacattctctcaatcatttgccccgtcttttttcattatttttttccttgtcaaatctctgatcattaaataattccacctcaaattcgattttttaatattgcaaaataaacataattttttatttgatgaaatgtaaatcaataatccctgaggcactctcatagatacaaaatatgataatcaacatacatatgtagtaagcaaataaaagcagtttttccaaattgaaagtgtatcaaaatttcaagctctcttttttgcatttttcttcctgtttagtttgcttcacgcttttccaccgttttcttctgtcgatctctctccccctgtttccaacgcaaaagtgtgcgatggttttccatcaaaatgcgtttcctttccttatgcgcgtcgttgtagtccatctgcagtttttcgggccacggtgcaatgcagaacacccagtcacaataacagtgcaatttgccgcctttctttgcagcgtctttgatgttgctgcgccaccagtccccaccgtaatcgatggtcagctcatggccaggcaaaatgtcgcgacttaaaggccaattgaagaaaaatcacgaaaaaccttcgaaaacacctcgcgaaaaacccaatcgaaccacgagtcatgtcccgatgactgctgtagaaacgaaaaggctgcagattctcgaaacaggaatggtgaagaagcga

SEQ ID NO: 44636 - DNA, 698 bp, Heterodera glycines
tctcttccttaataattttcaagcgccgaaggcccaccacgaggccgcgaagcggcctgagtgaggtccttcggtgcaggaaaattattaaggaagagagttcattatttatttgttttttgcataattaattcataaatatttttttcagaaagggttctgaaacgcaccaaattttatttacatgttagtttaggcactcagatgctttcactatcaaaaaagggagatgaataaaaaatctaaaaattttaattgctttttaaacaggccaaaaagtttaggcttaacttttttttcagaaactgatcagaagcgaaccagattttgcgagagcatcaaaaagacaaggaaaagcactgctatgatgctaacaccagtaattctgaatttaaaattttttattaatttttaaagcttcactattttatttttttagcaaaattaattcataaatattttttcagaaactgctctgaaacgcatcaaattttaattacaagttattttaggcactcagatgctttcaatatcaaaaagggagatgaataaaaaatctaaaaatttttaattgctttttaaatatgcgaaaaattttaggcttaacttttttttataaacttatcagaagcgaaccagattttgcgagagcatcaaaaagacaaggaaaagcactgctatgatgctaactcccagta

SEQ ID NO: 44637 - DNA, 840 bp, Heterodera glycines
atgaacaaagaaatccaaaaattgaggttttgttaggatttaactggttaatgaaattgattgcgacgacattgttgtaccaccacagtcgttagcatgagcaaggaaaaacaaaaaataacaaagcaaaagccatagaaacggacggacgctccaatgggacaaattcaaaacaaacagcacacaacgccgaaacatttattctgttgaaaatggacattaactacaattttatttgtgtaaattatttcaataatacaaagccatggaattaaaattaaactcaaatttgtacgcacaccataagtagggaacggtttttaggtgcatataattgcaaaatgaatacgtcgtacacatatatacatataaatgctaaaagtgtaaaatacatacaagaaagtcccaaaaaaaccccaaaatgggtgctaaaagaggtgacagaaatggaaaaccgggtcaagaaacagcataagaaatttttccctggttttttttttggtcggagaaaatgtgcttttcattctgttatcttacataaaatgctatccccaaaaaaagattaaaaccttgaaaccgttcccatataaaaattgttaagcaaaaaaggcaatcatattcatataaaaatacaaattgcgttccaataatccatcaaatttttctttttgtttgggatgctaattttcttccaatctgagaacacgttgaattttcaccaaactggcatccaatgctttgacaaattcttttgcgcttcgcttgtccttaaaaaacaataatgttagtgaaaaaaaatattaaaataatgattgtcccaaaaaaaaacaaaaaaacaaa

SEQ ID NO: 44638 - DNA, 914 bp, Heterodera glycines
aaaaaagagatagcccattttctgggatagactataaatataaaatcctctctaaaataaaaggtctattgcgcacagccctccgtatcatgctcgagagcatttgtatgtataaaattttctcaaaaaaagagatagccatttttgtggaatgagttataaatataaaattcctcagagaaataaaggtgtgatggtccacagccttccgttccatctggagaccatttggagatgtataaaatttatcaaaaaaagagatagccatttttctgggatagagtataaatataaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgcgcacagccctccgtctcatgcttaagagcatttgtgaggtataaaatttctcaaaaaaagagatagccatttttctgggatagagtataaatttaaaaattccctcaaaaataaaaggtctattgcgcaccgccctccctatcatactcgagagcatttgtatgtgtataaaatttatcaaaaaaagagatagccatttttctgggataacctctaaatataaaaatcctctgtgaaataaaatggcgattgtgcacagccctccgtctcatgcgcaagagcatttgtaagtgtataaaatttctcaaaaaaagagatagccatttttctgggatagagtataaatttaaaaattccctcaaaaataaaaggtctattgcgcaccgccctccctatcatgctcaagagcatttgtatgtgtataaaatttatcaaaaaaagagatagccatttttctgggata

SEQ ID NO: 44639 - DNA, 1233 bp, Heterodera glycines
  misc_feature (1028)..(1028): n is a, c, g, or t
tagatattttctttggtcccatgtgagaacactttcaccgtcgagtccaccgaaccgctgcaaatacggctcggcactgtccaatcaacgcacagcacgcggtccgaatggcccatcaaatcatatagagccgccctggggctgctaaaattggacacaaaaaacattagagcaacagaaaaaaagaatttcttaaaattcaaatcctcgaaatacaacccccccccccccccccctccacagtcaaaaatttatgaagacaatatttagtactaataatggcattctaaatataaatttgttttaatcattcgctaaatacctactcgacgcttgtgccagaaactcaccggacgtcccacattttaactgtgttgtcaaagctggccgaaacaaacaaatgctggtcggttgagtgccaacagacatcggacacaacgccaacatgaccatggaacgatgccttgaccattgagccatctaatggcgaaattaattagaaaaaaggggaggggcatttagttgggtcaccaacccctggaacgaaaatcccaaagccgaaccaacgaatcgacagaggaggtcagcacaaggccattggccggacagacggaaagtgcggaaaaggctttattcgaagtcagcgtggagatggggcctaaaaaggcagaaaaagggacattttgaatgccgacccaattcgagatttatttgttgcgcgagggttagaccaaaaattccaaattaagtggacaaatttcattttgcgcatccattcccttcccaaaaatcacctgccaattggaggtcccacagcatcagctgatggtcccatgaagcagtgatcgcctggctcaagttggacggatgccacgcgcagccgaccacaggctcgcgatgcgattccaaagtgaccatcggagtctacaaaataaaaattaaaaaaatcattgtttatattggaacatttgattttttaaaatttattcgttaaatgtgcgacattttgaactacgaccattcactgnaacattggcggtgaggtcgccctgtgaaatgtcgagaagcaaacgcatcattttatattggcacaactgtattaacaacagcaaaagtcatggcacagaaaggaatgccatgaagcgcagaaatattcaaaaaagggaaatgtgccgaaaatagaaatcaaaaacattttacaaaatatacataaacccacaatctttggcacgt

SEQ ID NO: 44640 - DNA, 784 bp, Heterodera glycines
  misc_feature (437)..(437): n is a, c, g, or t
atttttatctcttgaaatactacttaagaataattccgattattttttgttgaatatatacttaatattgaggtccatcaattaatgattaatctacctaataattgtagcaaaagaaaaaataacttattttaagctagaaaacgcgaggtaatcaaaaaaaaatcaaattcataacaattcgtttttttattcctataaatctttcatttatttaggcttttaatttaatcttttgttgcttatttcaaagtcatttcgtatatcacttgacttctttctatacagatgagcacatatcatattgcgtcgactttttattaatttgtgtatatttattttaaagtgtgcacgacgggcgaagtccacgcatctttagctgatactgcctagccagcatggtacgggcggcgcacgcggcgagcggaggggggggncgtgaaaattcaaacagtgctaacatgcctttccaggaagtgtgcctgctgctccaccaacattcgacttgtcttggcaatgccctcgggcggcactgtccgttagcgcgttcgttgttcaccagtcggcacgccttgcgggacaattttctgtcctttgtgctgccctttggcaccgccgtggaacggaatgccaaaggagcggaagcaagcgcttacagtggtgccaccatcgaattggatcaattattctcggatgaagtgcttgacaccgtgccaacttttggactttaacagggggggccccaaaaaagaaggaacgagaagcgaaactaattaatggatga

SEQ ID NO: 44641 - DNA, 1194 bp, Heterodera glycines
  misc_feature (20)..(20): n is a, c, g, or t
ttgacaacgaacaaagttantggtccaaaaaaacttctggtgatgtccgtaaaatttgatcaccttccatttaataaaaatatgaaagaaaaaccgctacgataaaaaaatgttgccgctaaaggtaaaatcaaactaataaaattgtgtatattttttagcgggttgtgatcttcccacttgtccaagctgtattgcattagcatcgtgccatcattacccaaaatgaattgttgacatttttgttttttcgaatttcccttttccatgttcaccttgtaaatgtcgtccactcgtgccaattcctccagcaacggtaaaagttcgagcagttccctgtcgttggggtcgtcgaaccaagtgcggaccgggatctgaaaggggaaatgttatataatgacaaagcaaagtgccaacagcaacaacaaaaacggcaccgaattgtcagggtggaaggcgtaactggcgggcgaattgtcgatgataatcacccgacgcaaatcgcggcccaaccgggaaaggtcctggaaatacgggggcacaatgacaagcagtttaacgacaattaaaagggggattccgacaatcccaaattcataattttactaattgaaaatattaaagtttaaaaaaaatacccaacctaatattaaaaaacagctttgttttttaaaaaattttagaggctttttctagtaaaaaacaattttgaaaaataagtaattaaaagctaattggctataattggtcacatcattgcccaccttgacgtagttgccctcgtagaagacgcacgactcgcggaacagtcgcgaacggaaaatgcgtcttttgtccaaaaggtcgacaaccgggtcggcatactgtaataatacaaaagtgaaaaactgtttaattttatttatttgtttttaattgccttggccaaactggcggtgaacagaacacactcgaacagtgcgccaattcgttccaaaaagtggtcggtgtggggccttttcagcacgtaaacctgcaaaaaaggaaatgcgaatttgaaaatgaatgttttttgtagagcccgatattttggaaaattcctgaacttttgacaataataatatttagagttcgacctggacatggtttcagccccagtttttccttggcctgggcttttgtctagaaaattccaagtccagaggtccaacatgg

SEQ ID NO: 44642 - DNA, 1220 bp, Heterodera glycines
  misc_feature (1209)..(1209): n is a, c, g, or t
tgcgaataaaatcatttaacgtgcttcaacattaacattttgagctgggggctttttatgggtgaatgatcagaatctctttttccgatcattctttcccattttccccatttctcatccactttacagctctaaaaccctccatcagactatgttctgatcaaaggcatggatcagtttaagccttagaaaaaataactgaaccagacaagcctcaaaatgcactcactgtccggcttttttgacccaaaacaaccgacttcatatagaaggggaattgaaagtttataccaccgctaaaaatggtggataaatcataaattgaatttttcctaatttaattttttgttaaaaattgctgcgagtgccaataattttttccctaaaaataaataaataaaaatgtattcaattgtaaattacttagatgaagaatgtgaaaggactcgcaaggttaaattatcgcacagtgtcaatgctcaaatttaaatttgatgccattgacgtggacatttcttttgtttcgataccggacaagaaaaaattgccgaatattttaagcgaagaatttgtgcaaaaatatttggacaaatttaattcggaagaaaatggcaaatttgagaagcaaaatcggagtttatccagtaactttattacaaaatcaaaaggaaattaataattttattttaagattaccgaaaaattatatttgcaattttaatttgattttgaaccgaaaattttgggttttcatataaaattaagaaataaaagtgcattctttgggtcctgctgatgggtcatgtgatcataaagctgacatctattttttacaccaaataaattttgtacaattttatcaaaaacttactcaaattttcaaaatttggaattttcgtcgttcaaaacaattgcatgaaatttcattatccaaacgaaaagttgaaagacaaattagaactaaaattaaaaaagcaaaaaaatcgacaagtaatttaaattgaaatggtctggaaattcttggattaattgaataattttaatattttttaatattttaaattaattaaacaattcatttgttattgttaaggttatcactctaacttatacatgaagaacttgttaatggatggccaacttgataatggtgaaaaagttctcaaaatttttcggtaatgtggttattacattaaaatgctgggccanaaagtaaggag

SEQ ID NO: 44643 - DNA, 889 bp, Heterodera glycines
acctggcaatagtagcacttagagggagcacatcaaacccttcagtgatctcacgcatcagaatttgacgaaattgaacgacagcagcgagtagaatcgccgtatcgttacgacaatacgtctttagctcgtccggcagataaaagggtgtacatttgttctcgtcatacctaaaaaacaataacaataaaaataccaaatcgaactaacaccattttatgaatttttcgtatttgtcccgcttcattgacccagggcagtaatcctccttgtccggcaaattttgaagatgcacgttgtagttttctctgagaaatataatcatttaaattaccctcatttggacatacaaaccttcggttgaaagcgtaggggaagaatggtttatcggcacagctaagactgaaggttttcggcatttcttccagacgaattggcatcagtagacatgagtctcgccatgtaagttttgagtggcgtcgagaatgttgtagacgaaactcaaaaattttgagcccattcatgatgacttcaggtcgtcgtttggtctcgccgaggtattttaacacaaagtggccatcaaatctcgaagcgttgtgggcctagaaaatatttatatatatttttatgcaacaaatgatgttgaaacgatcgctaactcacccaaataaatgtttggtacttgttgtcccatgccttcaaaatccattcgacaaacgccgaaattggctcatgcccttccgctttgctccaatccttcattcgttccatcgcaccgtatgttgtcaaacagattttgcaattgagtcgcacgccattttcagaatcacagcactccgtgcaggtaatgcgtgctgacaggtagttgaccttgtgtcgctgttgtccc

SEQ ID NO: 44644 - DNA, 141 bp, Heterodera glycines
cgccctgctcgccgcgctgcgcgcgctgcacctcgtccaccgccgcttccacctgctgcacgatggcccgtgcccgttcctgcaacagctgcccggcgggcgtcagctgcacgcggcgatggctgcgcacgaacaggcgcg

SEQ ID NO: 44645 - DNA, 734 bp, Heterodera glycines
ttttgaagtatgggaatggtacgttccagggatgggcctaggtttcgcttttcgcatttcgcctttcgcattattcgcattttttggcgtttcgcatttcgcttttcacatttcgctttttggcgcgaaatgcgacttttacacccctaagaattggattaaattcccataaaatttttcaaaattttacctataaattggctaattttcagtgaaaaactgtttataaatgatcaaaatttccaatttttttccccggcggcgcctatcggcaccgtcgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatcattttttggagaaaatctgtcaacaaattttaataaaattttcaaaaattttcccggcggcgcctgccggcggcgcctggcggtgccgcctggcccctccctcttcccaaaaagtttttttggaaaaagcatgcctcaaaaaagcgttttattgatttttaaagttggaataaaattttaaaaaatgatttttgctttatgattttatctattaaaaagatgtagaaaaaatttcgcttttcgcatttcgctttttgcattttcgcatattttggcttttcgcatttcgcttttttttttcatttcgcatttt

SEQ ID NO: 44646 - DNA, 1064 bp, Heterodera glycines
ataaaaacttagaaaatacactgtaatggaaggactacggtaggtttccatcctccaacaaattacgctgcaaattgcagagattgtcctcataccgtatccatttaaaaaacacacagtatcactgacttatactttctgctttcccaatttcgctttaaggaattcagtgtttagcagccattccctacatttttcttcccattcattagtggtgcggtgggaatgccattttttgcttttgcgtcgcctttgtcaccgccaacggcgccgcctctttttggcaatccgtcgctctttgctttcccaccatttttactcttctcaaccgctgtcaacagttctttttgtgcctgaattttcattaaattcaatgcataattattattttttattcatctaaaaaaatgaagtgatcggatgaaggaagtcccggaactgagagggaattttcctgggacatttttacaatagcccaagatagggactgtatcccaggggggagggggtaaaaatacacggaggacatacaccaaccccccccccctacccaaagggggggggcgggaatttttatttacgaaaaaaatcaaaaaagacgaccgaaagacagtatagaaaccaatgattgacacattcaaatatctaacgcacaatatgatagtatcgaacagaaatctacattgaagcatacgacactatatcactcattaatcacaaaatttctctaaaaaaaaattatcctgggtctaagcagaacaatcacgcaagtggacgaacttccaatcgccataagagacgcagatagtcactaatacacctgaaatgctacactctatcttgcaaacaactcggacgaaaggcgatgaaacaggggatgacggacaaaaagaagcatttccaatcggcaaaatgaatggcaatagaggtcaaaatctacgtacaatcagctgaacttattgactcacaagatggtgagctgatcgaattagaatgcgccgataataaatacggattatgtacacattgtctacggtacactgatcgaacctcactcaacaaaa

SEQ ID NO: 44647 - DNA, 869 bp, Heterodera glycines
cgatttagcaaatcgggcggattattttaatttctttgggtttattaattaaaatatattttatgaaatgtattttgttctttaaataaagttaaaaattaaataattacacaattattcatagaattcattattatattaatgctttcccaaaaataatcataatgttttgtataatacgtaatctgttgaatagcttaaaaaaccttttcccatttttaataattaatcctattaattcgttaattggttaattaattagttaattgattaacattttcctttacctctccctttcccttctccattttcttcctcttcctcttccacatcatcttccgcttgttcagtaccatggtgcttttttcctttgtccttcttcttcccattgacattaagacacatattttgcattaattttccaatcaaaatttcgatgccattatggcgttccttatttttgtgccgatcaccaccattgcctgacgtgctgagatggcactttgaacctaaagaaacatttagggcagaaatttataaactgattttggcagaaattaaaaataaaaactaattttttacaaagttccaaagtataaagaatgagaatatttaatatttagaggaaagatgaaaagttatagaaattagtccaaggcatttaaaatagggttgagcggtaccggtaccggtaccggtactgagcggtaatttttgctttctgtgccggcgctagcggtaccggtaccggttttttcaaaaatgaaattaccgttaccggtttgtctagtaccggtaccgccggtaaaaatttgcactggtaagaatgggggtctggtcgagaaaagagtaggaaattggtgaagaag

SEQ ID NO: 44648 - DNA, 995 bp, Heterodera glycines
ttttcaaaataaccttttcagaaccccttttttcgcaccgtgaatgttatttttattgaattctgaaccgttttgagtagattagactagaaaaaatgataattttgaaatcatgtttcacactcccttctcccaggggtattattttgtaaagtctttttttcaaaataaacttttcaaaccccttttttcgcaccgtgaatgttatttttattgaattctgaaccgttttgagtagattagactagaaaaaattgaaaattttgaaatcatgtttcccactcccttctcccaggggtattattttgtaaagtctttttatcaaaataaacttttcaaaccccttttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccttttttcgcaccgtgaatgttatttttattgaattctgaaccgttttgagtagattagactagaaaaaattgaaaattttgaaatcatgtttcccaccccttctcccaggggtattattttgtagtcttttttcccccaataaacttgtcaaaccccatttttcgcaccgtga

SEQ ID NO: 44649 - DNA, 670 bp, Heterodera glycines
  misc_feature (46)..(47): n is a, c, g, or t
  misc_feature (77)..(77): n is a, c, g, or t
ggaaatgtttttgccccccccccctcccgacattttcgctttgttnnttcgctcctttcgcatttttaattccgccncctcccttttttctgcttaaaaatgcgttgaatatttttgtgctactgctgcacaaacatttgccttttttcgatttgtttaactctttctattcatcgctttcctttcaatggctttttgtccgtggaaggtaccgtaatcacaccataggtgtacggtatcattacgacagcataccgtacactcaacaaaataattgatactgttccgttcattttttgggcaatgaaaaagcaaagcaaaagagatggaataaactgtttaacagcagcagaagaaaattaaaggatgaaagaagagaaatgagctgagcaaaaatgaatgtgtgaatgacagattttgattgactgttgtcccaataaatattttaaaaaaaacaattaattggcgggggaagggagggataaagccattccacggggagacaatgtacggacggaaaatggggagaatgaaatgatcccgggaaaggcggggatgaaaaaatggatctgaacagagagaaaaggccatcgtcacgccgtcccaattgttggctttttttttttgcaaattccgaatcgattcccccccccctaatttgtgcctttcc

SEQ ID NO: 44650 - DNA, 438 bp, Heterodera glycines
ccaaacaacatcacaaacagagtttgtcagctgatgatcatttcaggatgcattgtccgtcaaccgcggcggcgcagaaccttcagcgccgacttggttttccgggcgaaccaaacgaagccattgtggccgaggtgctttttactagtacaccattttgtgtgttgtttcagggcgctgttaataaatccaacccgaatcccccggtttctgaattgttcctaaaaccagctaacaataaacctgattccaattcatcttttataatctctttcataatacaaatttgtgtgtcccagggtgagtgaatgctcaaaaaactgaattttcgaccgatttaaatggctgcacttcatttccccccccccaaaaaatttttttttttaaaatttttcataaaaattcttaggaactttcttagtgcgaaaatatcaaaaa

SEQ ID NO: 44651 - DNA, 1425 bp, Heterodera glycines
tagaaatagtaatgggattaataatctaatctaattcagttccgaatacatggtttttttaatactctgtcatttgtctgcccaataaaatttattagagaaaattaattgcactatggatgctcgagaaatgtataccgagtcgagaaaaattcggttttttttttgacttatcgttgcgttatagattttgtcatagtgtccaatatccggcggcaatttacctcactttttggggtgaaagttttgcagttgaataaaaatcttatctttctggcgatttaacctttcacttttttcacctttttggccctttcaaaatggcccagtcatgcgctacagacaattaatggcactaccgtttcaggtactcgcgatgccaaagcagaaaggttgggccggaatgagcggatagcatcatccgggggttggagtgcagaaacgaaatccgatcgtactcataggaatcgcgcccgtgcttcagcttcagcagtgcattatgctaaacaaagaaattttagtgattttttaagaaaaaataattttaagttttattcaaaattaaattgaatttacaaattgaagcctttgttggtcactgagcatgcggtattccattcgcaatgctttgccaaaatatcgttgatttcttttccgtttttggcggttatttgagttcgtattctggctgatgagacactgatctggtgccgacgattcgccttaaatcaatgcattttaaccgacatacatgtttggtttcttgacagacaagtgattctcgagactcaaaattttagaaatacctaaacgggatcggtcccgggaggtctcagtctcgcgcttcctaatggcccaaatttgcacagtttaaatgaattttttgtctgtctgaccgtgcttttattgcccagcataccccccaaaataatgcaaaagacatgtcaaattcaggcatgcgtaaagttcggcgatcactcgtggtggcaattccgatttatcagcttctgttttttgggtcgtcttttgaacaaacggcataccttaaaatttattatatataattgtaaatttaattgaaaaaataaaataaaaaataaatttaaaagaaaatttttcaaacactgactcagtttaactgatggcggcggcagttcgtcctccgtaaattcgcctttctgctctgcctaaattattaaatatattgaaaaattctttgcctaagaaataattaacttatttattttcaagagttattttttgaaaaaaattacagcgaatcaatggtgtgttctcttttttaaataattttgaggattttgggcaaaaaaccttttttataattcttttaacagaaaatatttaacattttgtgactcgcgggggaggaagtttaaaattttgctaaacataactattgaccat

SEQ ID NO: 44652 - DNA, 1566 bp, Heterodera glycines
  misc_feature (23)..(23): n is a, c, g, or t
  misc_feature (52)..(52): n is a, c, g, or t
  misc_feature (176)..(176): n is a, c, g, or t
aatttttggtaaaacattaaaanaagtcgaaaaaattggttgctcggcgcgntgaaaatttcgaaaaaatttgggtgtgacttttttattagactttcccaaataaaattacctgtattaaatagaatacgaatataaaaatgaatacaatacataaattgctgataaatttgggnaaatttgaaaaaaaaattacttatgacagaaatttttggcattttgtttcattttgccataattgaatttattggaatatgaataagcttacgttggcacccgtgtgccagctgtcgcctggggtgcaaatcggcttcattgtcggcacagtccgcgtatgaattgcaggcgagcggtgccgggatgcattcctccgtgttctccggctgcttctcataaggcgacgatgccgttggcgttttgtgcctacaaaaaaattcaaaacaattcaaagtcgagattttcgatattggtgtttaaaaaaatgcgaattaatttgtcgaaattacaatattttttttaattagtgatgctcaaaaaataaaataaatgaataataattttgaaaaataataaatcaattatttatttttaaaagaaagttttagaataattttattaagaaattgataacatttattcaaaaaataatattaaactaattaaatttaaaaaaaacccataaataattttatttaaattagatgaaaataaaaatattattatgttctcacctttttgtttcacatgtgaattcagcttgccattccgcaccatttgcatccgttgaattgtgccgacatttctgcgcgtgccgaaacgacgacctcaacaatttttttgaatttaattttaaaaattagaaactaaaattttcaccaaagcaagcgaaatccctcggccgcataaggacttgctgaaactgtggtgctgcttgcccgcaaattgtctttggattgatccttaaattggaagcatttttgaagtgctatttattaataaattaaattttagaaaatttaacaaattttcttgatttatgtatgtttgaaaaaataaaatttgaccaataaacgtgaatcagaaaaaaaaatgcactttattggtgacgaaaatttgaaatttccaattaaagaaattagtagtcgtcagtaaatttaccgattgcttcgcgtaaatttcttctatttaattattattttttagtttttatagcttaattgatcagatgacactccattatagtggattctaaaaaattaaaataaatttagagaaaatcgcccgagggcatgaactaaaatttccggcataaaattattagaactcaattttctcaccatctgccgatttgttggttccgtgtgccaccaaagtgtgagcgcattgaacgacgattcggccagcaaaaagaattttttattttctaaaaaacaaatcgattttttgggttttaaatttgtatttttttttttacttttttcattggaaggaatttggccacaaaattcgcccaaaattcggcccggaattgcgccggcgggcagcggctttccgacgctaattcca

SEQ ID NO: 44653 - DNA, 969 bp, Heterodera glycines
aactatttgttttgcttcttctgatctctcccacccttgaaaagccgcatcagaaaagagccttagtgacaattgcattgattggcgccttagcacaattgaaggcgtatttattagcgcacaccggagttatattaacagcatcaatgataacagcacttacaacattgtctctcgctgtatatgttaagctcaaacgtgagatattgtttttaaatatttagaacttatttattttctaaattatagattgccgatgtggcgatctgttaaaagatttctttcccataaccttcgtcctgaactcgtacgagttctctgtgtcagtggaggaatttacacccgacaacatttttgaaaaaatttcaaaagagctaggccggaatgttcagcaattttgctttggtttgttttaaattggtttaaattattatagaaagatataataaattcagcttctccttcggaaacgactcgaaagattaaaaaaagtgatgaagacatggggcttcttttactttatgcaacccgaagccaaggacggctggaaatcttcgactgcccctgattcaggaggctggaaatcttcgactgcctctgtttcattttttatgatatttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcgcaagtgtcgagtccgcaattgtcgggtccgcaagtgtcgggtccgcaagtgtcgggtccgcaaatgtcggggttatccgcaattgtcgggtccgcaagtgtcgagtccgcaaatgtcgggttccgcaaatgtcgggtccgcaaatgtcgggtccgcaaatgttaaatccgcaaatgtcgg

SEQ ID NO: 44654 - DNA, 1343 bp, Heterodera glycines
  misc_feature (50)..(50): n is a, c, g, or t
caatccaaattgtgtaattgttttatgtgatgaatttctgttgcattggnttaaaaatgaatgatttgaatgacttggcttgtcgtccgaccataatttctttgtcctcctcctcctttttctgttaattgacccattaattaatggtgttggatcattactcaaaaactctcaacttaaaaatttttggcgaaaaaattttcatatctttgctcaagagtagcccaaatttttaaacattgatatcattcgaaagtcctctgttaactttcaaaatttcaaaaatttggtggactttcaaaaatttttgttgcctataaggaaagttataggcatttttttattttgatggttctttgcgtaacgctctttttgaggctttttgtttaacgttataacaccctcattaattagatcgagtccattaaattaattgatctattaattcctcccttttccataataatttttctttttgttaaatttctgccattgcatctttaagccattcttcgttttgtgccctgttttttgaattttaagaatatcgttttaaaattaattccttttatcattaattaattaatccattattattgtgttaaaccgaattttgtgagattattaaaatttaaaaaatcatttcattttgcacgaatccatttataacaacagctgattgtgtcaggaagaaaggtttcaacattgaaaaatttataatgaaaattttttaaaattttttttagaaatcttctcaaattcgtttgtcgcccgttggagaattacaattttaaaggaaaaagaattacgcaatttgaaacttatggaacccacagtggaatcatcaagcgaaaatttcgatcagttgggacaaagttggaacggtaaaaaaagattaattaattttagctgtaaactgtagggaactgtatcaattcatcacataagctggcatactgtcattgtcagtctttgtctcccccaattttataataattttgacaccaatttagatcggttttctcaacaggtggttgcgaaatattgtcgctaaaaaatggacctaattacgcaaaattatgagctttcattttccgaaaaatcccattttttagcttttgcgtgaagatattcagaagacggaaatggaattgactaggcttaaacatttgttggacatcgccactcgagctgcaaagcgaaaacgtgggaaagggaagggattaattgatcaattaggatcggcgattaattaattatgctctaatcaccggtgcaattttaaaagacaattttgccacccggtcggagggcacttaaattgaaccaactcaaattggtgg

SEQ ID NO: 44655 - DNA, 964 bp, Heterodera glycines
gccccctccccgcccttcagagcacgacaaatatttcaacaaaaatttttaaaaattgactagagcaatcgaacgctagcggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatctattttttcaagtgtcagtttggggtactcaaacatttatggggagcaaaaatccaacgcagaattaaagtacagactatagggaagctattcccgaaggattcgaggctccccataaatctggggggcatcggatcggggggactgcccctaaaacgaaaataaatcttattttttactgaggtcgtttgaggtgactcaaacaatgtatggggagctaaaatccgacgaatagtgagccgactgggtatcgtaaatactgctccgagaggatactaaatgcctgtacgtcttttgtgcttgaatgataaatgatgggctttttctgcgtgaaatgatttctctcctctttgatgtcctgcccgcataatttggacatgttacctacacaaacgttttcttcccggaaaattgttggccctgcttagtaacattagccatatttgggctttaaaagtcctgtgaatgtatgcataatgaacggtaatgggatgtggaagctggcgggggggggggg

SEQ ID NO: 44656 - DNA, 1527 bp, Heterodera glycines
cccctcccccctcacattcatcccattttctgcgtccgttcactcaaaattcaaacgaagaaacaattggaaggagggaaaacgactgataactcatcaaaagtgattgataagtgataagagaagggacggcgaatgcccaacactttcaatttgtacgtaaatattcaaatgtttaatggattggacagtaagtaatttatattatttttattatatgccaaaaaatgtttgaaatgtgaaaatgactgaaaactaaacgaactgagaaaaaaaaccggacgaagtgcagagacggaatttgctgaattgtattggacattggcgagatcaatggcgaatgattattaacatatagcaaagtttgtttatgaaaagcgaatgtcagtagaaaaggaagtgatcggtcgaactcgaaaaataaaaaataataaattcgttggcacttttccaaatataaaaagactgtccgatcgatcacttcccccacagttaaagaaaggttaatgattcggggaacagtgctttttgaaacacacaatcagacgaggagtagcggagtggttacggagaaattggcatccgccaaactgtcggcatttgggccgggcgaagcggaggaagacggacaccagaaagactgggcattgccaacacagcctttgctaaggggaaaaatcaaaagtgaaagaaaaaggcattgtgattttggacacggacttaaatgggtttttgagtccatccgaagagagttggaaatacgcgtaacggtgcgcatttagtcgttcattagtggtgacggcggcgagaatctgaagaaaaagggaattaattaaacggaaattgaaaattaagaggacgaccgatacttggtaaaattggatgcaaagcaaagcggtgacgaagaaaaagtaattgacggagaaaaagcccaaaacggtgacaaaaggcatgcagaaaagaacatttgtggcggagatttggccacagaaatcgcgccaatctttggggaaacattcgaaaaagaaaatgtgaaaaacatttacagaaaagacatccggagaacacgagaaggcaggagaagtcgagaacaatcagataaacgatgaaagcccctaaaatggagagaaattggcatttgtaagcgccaaataaaatctcatgaaaaaatggacaaaagccatcccaaaattcaattacattacagacaacaaacaattcattactgtggtttttttctccgatacaatttgccacccaaggacctaaaaagcactcaatcaattaattgtacacaattaattgttaattagtacagtggtgatcaaaacggaggatgcacttgtcgcacactctgaaattcaaaagcataattctagtgatttaaaaaatgcattttgtactcactggcaatgtttggagcgcaacggacgagtgatcagacaggtgggacagaaagtgcccttccacaacggttcctccgtcaacgaaatgagcatttggcaccgttcctgataaaacccaaat

SEQ ID NO: 44657 - DNA, 1117 bp, Heterodera glycines
  misc_feature (1048)..(1048): n is a, c, g, or t
ctgccattaaaaattgtggtggagcgctatcagttattgcggacctggctgattatacaaatacgacttagatatcacaaataagctccagtgatgtaacgccttctgctgaaaagaattgaactactgtatttaatagctttaatgaataaactttggaattattcggaaattcaaggacgacttgatggagcatttaaatgctaaattcttcatggaaaaatttagggcaaataggcaataaatgtttgttttattacaaacgctgccattaaaaattgcggtggaacgctatcagttattgctgacctggctgattatacaaataggacttagatatcacaaataagctccagtgatgtaccgtcgtctgctgaaaagaagtgatgtaacgccttctgctgaaaagaattgaactactgtatttaatagctttaatgaataaaatttggaatttcggatattcaaggacgacttgatggagcatttaaatgctaaattcttcatggaaaaatttagggcaaataggcaataaatgtttatgttattacaaacgctgcaattaaaaattgcggcggagcgctatcagttattgcggacctggctgattatacaaatacgacttggatatcacaaataagctccagtgatgtaacgccttctgctgaaaagaattgaactactgtatttaatagctttaatgaataaaatttggaattattcggaaattcaaggacgacttgatggagcatttaaatgttaaattcttaatgggaaaaatttttggcaaataggcaataaatgtttatgttattacaaacgctgccattaaaaattgctgcggagcgctatcagttattgctgacctggctgattatacaaatacgacttggatatcacaaataagctccagtgatgtaccgtcgtctgctgaaaagaagtgatgtaacgccttctgctgaaaagaattgaactactttatttaatagctttaatgaataaaatttggaatttcggatattcaaggacgacttgatggagcatttanatgctaaattcttcatggaaaaatttagggcaaatagggcataaaatgtttatgttattacaaacgctg

SEQ ID NO: 44658 - DNA, 585 bp, Heterodera glycines
gaaataaagccccccgcccctctcgccatgaattagagctgccctgaataaagcctctgaaataaccccccccccttttttgagttgagttaaagataaaaccctcgggggctctatttcaagaaatacggtattataaattttttttattttactttaccttgtcattgttgtcaagctgcccaaagaatggaaaagttttgccaatttcgaatacaaataataaatccatgaccattggcgctggccttgtacagaagggtccaaagtgacgtactttttcaaggtatgttgctggatatgattggttcggtatagtcttaattccaatgattcttccattttttatgcattatcttaccgaaaatttgttagacaattcgatcaaattcttttttcgtgaaaaaattgactcaaatgtatcacattgtgtgtaaaataattctggaattggtgtctgtgagtagcgaattcggcgcactttctcctcaatttgcagcaaattttgcaacataataaaattcattaactccttttgctctggtgcctaaaatgcgcaatttgttgctgttttgtggtgacatt

SEQ ID NO: 44659 - DNA, 1501 bp, Heterodera glycines
  misc_feature (22)..(22): n is a, c, g, or t
ctgaacattttgctaaaaatanttgggccattttggcactttatttctgcttctgcttgaccaaattctgtttggcacacataatttagggttccacccgtgccgcaattgtagcagccggtaaaattaattggttttatgtggcattttgtgccgtctgtgactgtaacaatttttataccattaactcttattgctaacttaactggagaatactcagtctcgcttaatatttttttaccttcttttcgaatatttaattttgcggttgtgaatggtaattttggtgtcattttttctattgttttttcactgcatgcgcattcaacttctcctttttctctattaatccaacactttctacacacttctttatttaatttgcatgaaaaattttttgcctcaattgggtcatcacatgtcaaatctgtcagaaattcttttccaccataaattatatcattttttgacattatgaaataatcattcaaaattggtgaaattggaggtgttaatccttccggtgtaaatgaaaatttactccatttaactgtaagaccaggaaacatggtcaaattttagattttgtatcgtttccgattgttaatgttaacctcatttttaattcataatcccatccggtacatctaattaattcccaaattgtgtttgatgttggttctgcgtaagttctataaaagaaacattccgatgatgggagtgcgcatttatgaccccaaattgcgtctccttttttacagaaattggttcctggaaaattttcataatcttccatttctggaattttttcatccattttaatgtttttacatttactttttgtacatgagcccattgttggacagcgtctttttgaaataacatttattttatatgatcgtaaccattttaaagtttgttggttacagtgtaatcgtaaaaattgtaaaattaattctaatgaacccattatttttcctttatcatcttttaatgctaatgaaactttttgtccagcgggtaatattgttaattcggttgttccactgactctacatacagaaccatttgattgtctttcacagtcttcggaagttgactgaattgatattacttcggcaccactgtgcactaaatcaggcattgtcaaacataaaaatagtaatattacaatgcttccaagtctatatagtcttctgttttttcttttttgaattttttttttctcttttttcaaattcatttaataaacttttctgtatctcatcgttaaattttttgtctaattttgggttcaagacccattttaacgccaaatatggcccataaaaacaaattttaataatgcgccatatttttatgataaactttatgataaaacttgctatgcaaataataaaagaaataatacaagtagttaggaggcctattagtatgagcgtttcggtcaacatccgggggggggggccaatttttctaggcaaaataaacatttaattaa

SEQ ID NO: 44660 - DNA, 936 bp, Heterodera glycines
ataaattttattttagcccattagaatggagatgcaacattttcttctcaatgcattggtctatgagcatgattcaacagtccggcagcaatcagctcaaatggcatttaagattgccacggattgcgttgattttaaatcaaagctgatcactttattcaacgaaatggcaccaaaagtgaaatatggaattgtgcatttgtaccgtttatttttatgtttaaaaattgatcagcgtgaattggatttacaatttattggaaatggtaatttttttttgaatatttaaatggcaattttttcgtttttgaatgtttctgtttgcaattctactaaataggtcattcttctataacattatttggggattgccgtttaatacttaattactgaagcaattatttttaataattattttagatgatggactgaaaattttgtttacccgcaccaaacttgaacaaggggaattgtcaatattatacaaaagtgaacttgttgattttctctcctactgtgttgaagttaatgagaaattgcttcaatttggtggcagtgattgcgaggcacaatgtgtgacagtttcgggtgcttgcttatattttaaaaatcaaattttcattattttttaaaataaaatttttgatttttgtaaacttttactacatatcaattataaattttactttttcagaattgcatttgctttttgagaacttttcttcttccactgaagatggtgaaaatgatgacgaatttctgttctggagcgacacacaaaagaagcaattgtccatttattcaaacggaattattgtaaacacttggcatttctaaaatttattagttgtataaacttgctcccggggtcattggtcacgaatctgaccccatttcgaccagtttcgaatcctaaatccgaaataaaacaaagtc

SEQ ID NO: 44661 - DNA, 857 bp, Heterodera glycines
  misc_feature (40)..(41): n is a, c, g, or t
cccataatctgggcgcatcggttcggagggactgcccgannaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaatttgcaaaaaataaataaaaacgaaa

SEQ ID NO: 44662 - DNA, 1207 bp, Heterodera glycines
  misc_feature (36)..(36): n is a, c, g, or t
tagaaaaactcatatctgactcgtataaaacatacntcgaacagtaggtatattgtgtgcaattttatagtccagccttcgctagggctctcaccgcggtgtattttaggttgtctttgatgtatcaaaatttctctcggccgtgttgtgactgaaaaataaaatgaacttaaattattgcaatattgtttatacgaagtcttttgatattattctgacgacttccatgataataaatacttatacaaagtttatctttttatatatttcctcatcccaaacatggatggaaaataggcaataaatcgacaaatatttaaaagttttgccatgctatttatctttcgggactcaatttatgacgaaaatatgggctccgattattttttattttctactaacacttttcaagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtatgtatatttgttgtgcaattttatagtccagccttcgctagggctctcaccgcggtgtattttaggttgtctttgatgtatcaaaatttctctcggccgtgttgttgactgaaaaataaaacgaacttaaattattgcaatattgtttagacgaagtcttttgctattattctgacgacttccatgataataaatacttatacaaagtttatctttttatatatttcctcatcccaaacatggatggaaaataggcaataaatcgacaaatatttacaagttttgccatgctatttatctttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctct

SEQ ID NO: 44663 - DNA, 1430 bp, Heterodera glycines
atatatttacatttaaaataaattattttagttaaaattattaattttttaaaatttgaaagttcctttgccaatttggccaatcgcgtggacgctctgaatttcattttgggccaattgcgcgaaagtgtccaattggtgggcggccgaggcgaagcgatggaggccaatctgagcacattcacagtgatcttcttcttttttgcttactctgatgaaaagcataaattaaatttgaaatataaaaaaattgagggaaaattgcataaatttttgggaatttctttcatttttattgaaattcctttaaatttttttagactgatttgcgcaccacattagatgcccaacacagtgatcaatggaaacgattggagacagatcgccaacagtctgagaaaaaatctaaaaatttaaattaaattaaatttaacgatgggaaaatgcggtgaaaggcatggaaatggagctggacaaaatgcgtgaacagcacacaaaggcaagcaaaagcacggattttaattacagtggttaaatgtaaccgtttctgttcgcctcctcttccaataattaattactaattaatccccctgatttctgattaattcctaattaatccctctgattttccttttcaacaaaatgtatttcttttaaacggtaacaatgaaatttgaatttatttcatttaaatgtcaaaatgctttattttctttctttctcctgtgttgggctaaaattgaaacagaaaagtgatcactgatcacagaattaatttaagagcacaaaaaatggttaattcatattatttttatgctcgcctttcttaattttaaaataaatgaaattatttaattatttataatataaattaattctttatttaaatttctgattatttctttcatttttttgcgctttgtttttttaggaaattgtcgagggccatcgttggcttgaagaacagcgggaaatgatcacagccgaacgcaaagcatttcaagtgaaaaaagaaaacaattagaaaattaaattttatttatttttaggaagaacaatcgctgattttggattggattgagcacaaaaagacggaaattgaggcgaacaaagtgaaaaataaataaacatttttattaaattttgaaaacaaaaaaatatttaataaatatttttaaaattattttatccctaattaatatatttttttttcaaaatgatttccttcgccgtgagcacgaccttttggtgcgtgtggtcaacgaacgcgcgctgttggagaatgaacggcgcgagttcacgcggcaacgcgacgcggacgtaatgcgactgaggtgacgcgggaataaaaatgaatttcaaaaataaaattgaaattaatttttaaaataattattgaaaatttcaagcttttaaatataaataaaaaa

SEQ ID NO: 44664 - DNA, 880 bp, Heterodera glycines
agaaattaaatggcgattgcgcaccgccctccctctccgctcgagcgcttttgtaacgtataaaatttctcaaaataagagatagtcatttttcttggatataagataaatttaaaaattctctgagaaattaaatggcgattgcgcaccgccctccctctcatgctcgagagcatttgtaacgtataaaatttctcaaaataagagatagtcatttttcttggatataagataaatttaaaaattctctgtgaaattaaattgcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagagcatttgtaacgtataaaatttctcaaaataagagatagtcatttttcttgtatatatgatatatttaaaaaatctct

SEQ ID NO: 44665 - DNA, 948 bp, Heterodera glycines
ggattagcatcggggttacgagatagaaaattgtcctaaaaagagataaccatttttctgagaattaattcacaatttcgcagctcttagggtaatggaaaaaattttgaagaggctctccggaacagattagcatcggggttacgagatagaaaattgtcttaaaaagagataaccatttagcatcggggttacgagatagaaaattgtcctaaaaagagatagccatttttctgagaattaattcacaatttcagcagctcttagggtaatggaaaaaattttgaagaggctatccggaacggattagcatcggggttacgagatagaaaattgtcctaaaaagagataaccatttttctgagaattaattcacaatttcagcagctcttagggtaatggaaaaaattttgaagaggctatccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacagattagcatcggggttacgagatagaaaattgtcttaaaaagagataaccatttagcatcggggttacgagatagaaaattgtcctaaaaagagatagccatttttctgagaattaattcacaatttcagcagctcttagggtaatggaaaaaattttgaagaggctatccggaacggattagcatcggggttacgagatagaaaattgtcctaaaaagagataaccatttttctgagaattaattcacaatttcagcagctc

SEQ ID NO: 44666 - DNA, 981 bp, Heterodera glycines
  misc_feature (91)..(91): n is a, c, g, or t
  misc_feature (887)..(887): n is a, c, g, or t
  misc_feature (923)..(923): n is a, c, g, or t
  misc_feature (930)..(930): n is a, c, g, or t
  misc_feature (945)..(945): n is a, c, g, or t
  misc_feature (956)..(956): n is a, c, g, or t
ggatagatcagatataataaaatgtctaatcgttacctttttcagctaatggatttatgaggacaatttaaaacaattgatttattaattntgatgatcacatgaaaacgctgcaaaaatacacttttaatgaaatatcgctaaattggcatgttgcatgttacaaaagagattttatgcaggttaaacctaacaagcgaaccatagcacatagtctcaagtccacctgttttgataaaaatcactagggatggatagaaatcgctatttctttgctacgaaacctgtaaagatccgtttccatttcaaataacagcctttctatgcaaattctaacggctttgagaatttcagttgctaaaagcctgaatccacggttgcccgactgggtcggaggaagccacgcgatattctgaaaatcggtattcccttcattttctatgatgtttgcgcaacacttcggaattagcttgcctaggagatgcattcctctgtaagttcctgcccatctatatggagagaaaatttgggttccttcctagaccttgtttttgttccggaaatattcaaattttgtgagcgatactgttgataaaacgaaaataaaagaaagcatttgaactcccctgctttatcacaaattcaccccgggatagatctgatataataaaaggtctaatcgttacattattcagctaatggatttatgaggacaatttaaaacatttgatttattaatttgataatcacatgaaaacgctgcaaaaatacacttttaatgaaatatccctaaattggcatgttgcatgttacaaaagagattttatgcaggttaaacctaacaagcgaaccatagcacatagtctcaagtccacctgttttgatancaagcactagggatggatagaaattgctatttcttngctacgnaacctgtaaagatcncgttccatttncaataacagcctttctatgcaaatt

SEQ ID NO: 44667 - DNA, 878 bp, Heterodera glycines
gtgggggggcgaaggcccaccacgaggccgcgaagagaccgagtgagtaccttcggtgcaggaaaattattaaattttttaattgctttataaatatgccaaaaaatgtaggcttaactttgttagtgaaaattcgatcactcatattttttgataattgagcagaagcgtaccaaactttgcagggatactccccggtaaaggactaacatacactgaaatgagcgccgagctagctggctcaaaaaaatttttcgaaaatatgagtctttcgtttttatttatttgcaaaattaattcataaatattttttcagaaagggttatgaaacgcaccaaattttatttacatgttagtttaggcactctgatgctttttctatcaataatggaggtgaatacaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatatactcaaaccggttcagaattcaataaaaataacattctcggtgcgaaaaatggggtttgaaaagtttattttgaaaaagaagactttacaaaataatacccctgggagaagggagtgggaaacatgatttcaaaattttcaattttttctagtctaatctactcaaaacggttcagaattcaataaaaataacattctcagagcgaaaaatggggtttgaaaagtttat

SEQ ID NO: 44668 - DNA, 986 bp, Heterodera glycines
aaaaatttttaaaaaatttttttcttttcctttttgatagaaaaagcatcagagagcttttatttatcttttaattaacatttggtggctttcagagcactttctgaaaaaatctttatgattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcaaatttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagatagccttatttaacttttaattaacatttggtgcgtttcagagcattttctgaaaaaatatttatgaattaattttgctaaaaaaataaaatagtgaagctttaaaaattaaaaaaattttaaattcagaattactggagttagcatcatagcagtgcttttccttgtctttttgatgctctcgcaaaatctggttcgcttctgatcagtttataaaaaaaaagttaagcctaaaatttttcgcatattaaaaagcaattaaaa

SEQ ID NO: 44669 - DNA, 578 bp, Heterodera glycines
  misc_feature (72)..(72): n is a, c, g, or t
tcttgagcctcgaggtggactaaaaacccctaataacttttttaattttaaaaacaggcgcgaagcacccgnctgagctctacaaaattacaaaaacgggcgcaaagcgcccgtttgaggccgcaaagcggcctaaaaaccgctataattttttaaaaattccaaaactcttcacaacccaatagtttatttttgtacctcgtatgagctcaacaacatttaaatacgggcgcgaagcgcccgtccaagttcaacaaaatttagaaatgggcgcgaagcgctcgtccaaggccaacaaaatttgaaaaacgggcgcgaagcgcccgactgaggccgcgaaacggcctaataagctaaaaaacgggcgcgaaacgcccgtcgtgagcatcgatgtggacttaaaacccctaataattttttaaaaattcaaaaaaatctctccaatcaaatcgatcaatttgaaccgcttcacaggctaggtagcgaagctccgaaagcgcgaagcgcttttcccagcgaaatagccgacggttcacgcacccgctagttaatatatacgttatattgacaaggagttt

SEQ ID NO: 44670 - DNA, 1013 bp, Heterodera glycines
  misc_feature (908)..(908): n is a, c, g, or t
gcattttgggttgctttgtcgtgtgacagtttcggcacattgtccgcacgcgcactgatgcccacacggatccattgcgaaccgaggctaaattgcactcgcttttaacacattgagtataaatttgacaatggaaaaatagacttttagaaacatttttaagccaaaattaagaaatgattttttgccaattctgaatttaataaatttaaatacctcttccgacaaacaaatcgcacatttatttgtacttaattgttgatttgaatgtgccggcggtaattgtcgattttggtacagcaccatttctgcgctttgtttgttttttttgttttttggttgaagtaaatactgtgggtaaattgaagaaaataataaattaattttaagaattattgagaaaaaaaataactttttagtcaaaattttcctttaaaaataattattaaatgtataagaaagaacaaagtgattttctacccaaatcagcagaaaacccactcgaaattggccatttgggcaaaccgtcgttttccattggtccatcgcaatttgcaaagaattatgtgcacaacatgtcaatggcaaatgatttacattggcacaaatttcgtccaacaattgtctgactcctttgattttttctaatattttcaatttgagtacatatttttcattggcttcgacaaagagaatgcctaagtttttcgatttttgtaaaaactttcaaaaagtgccaaaatcaccgattcgccggaaaagattcttatcgatttcgggccatcggcacattcgtctgatgtcatttgttgccgttcttttgctgaacagttcaatccaaaaatgaacaatttcaatagccccatttaatggtggtcttccgctgtaaatccaatgcgaaaatgcgntcatcacaatggtcgtttgcatggcatttgctgctttagcacacgcaacaaagcaattttggcaaaatgccattgcattatccacattctatgagataagcaaaa

SEQ ID NO: 44671 - DNA, 1004 bp, Heterodera glycines
  misc_feature (129)..(129): n is a, c, g, or t
  misc_feature (166)..(166): n is a, c, g, or t
  misc_feature (860)..(860): n is a, c, g, or t
  misc_feature (884)..(884): n is a, c, g, or t
  misc_feature (935)..(935): n is a, c, g, or t
  misc_feature (949)..(949): n is a, c, g, or t
aattataaaagtttaaatattttgaataattctaatttagatgaatcgaataaagtaaaaattaaaataaaatatgtacacatttttctggaaataatttgcgcgcatcatcgtgaatgatgatttatntaaagaacgaaatgatacattaatattgtaaaaaacncaataccgaacggataatcaggcttgtcgttattgaattaatgaattatctcttataaaaatgaactgatttaattaaaaaagagaataatgccttaaaactttttgaacaaaaattgtcacaacattcaaaccaaaatatttttaaatataatttttaaaaagaatgttttatttaaattttttaatataataataaattatatttgtataaggtatcaatacggtttaataaatgcattctccaattatgaaaataatcagaaaatattattttcaaaaagaaattatattttataaataaaaatatattttcaaagaaagaaattatattttaatcttttattgagaacaattaatattaattaaaatgtaatacatcaaatgacacatgcattactgcgcaatgattaaaattaaaagctagaaaaagaaatgaaattgaataaaacgatcaattaattggtatgaacttgaattatgcttggaataagagaacttcagaaaaccatacgaaatttccctgagatatgctttaataaatattatcttgctaggacgttttattaataatcataatttgattatatatgggcaaaattaaaaacaatatgtcagaaaaagtgaataataataaatataaattggactttattaataataataaaaattaaactaattttatttcatattanatgaaattatactaaaaatgatanaaaaagaggaaaagataaatgcaaaacactaagtaataatatattaaaaangaaaatactaatgntaacgatgatatggattctacaaaatcatagaacaaaaaatatcatgaaataaaa

SEQ ID NO: 44672 - DNA, 602 bp, Heterodera glycines
taggaagtgcccattgggttttgcttattaatcacccttattttgctcattgccattttcttcgcttccaatggccaattggcgccatcggccgaatcggcactcgctgcccttctccaccaaatgcttccatttgtgttgaactgcttggaacagctgttgttcatctccgagtccgtctccgcaaagtgtcgccaattcgtccaacggatggggaaaattacgcagaaaataattcattggcaacggcggcagaagcagtgaaagcgaagtcactttgcccactttttaatgggctcgtccgattttggcatttccatcgcacggaagcgaactttctgtgatggcaccggagaattttggcaattaatttaaaggagtaatgagtgggcaaagaaagagcaattgttttttaaactaattaattaagtgcccaccgattggcacttccgccgaaggcacccaaattttgatggcactgaacaaaatgaaaaaggcgaggagaaaaaggaggagaaacacaggccaaaagagggaaatatccagcggaagatttaaaatcaaaggaatttgaatggtcaaaggaaaagcggcgaattcat

SEQ ID NO: 44673 - DNA, 773 bp, Heterodera glycines
ccctttcatagagcaactttcattgaattgcatgtaagacttattaagacgatttgtaaatgatggaagtggaggtaaaagttttttatgaatttttttaaatatttttgctcccaagaagatccgcattcggcttcgtcatttttggttttatctttttctcaatgtgaattaaatttaaacacttatggcgcgcggtgctagaaaggccagttaaaagtcgcagaagttttttggctattttttaatattttgctttcacccaattaattacttcccaataaatcaatgtaatttcatcaaaaaatttttatcaaagataaaaaaggagagaaagaaacagaaaagacacacaagaaaaaagagaagagagaaaaagagacagaagagacacaaacatatactcccactgaaaaatttgatcagaaaattgattagaaaattaaatagtcgagcaatgatgactgacatataaaattatcaaaatatgtcatcatcatccagcaatccaaccttgggaaaacgttgccatggcttcgcttgaaataggagacaattcgcaataaaattatcacaaaaaaccaaaaaaattatgtgaaaaaataattgatcagttcgacgaaaatggatcaaatagaacatcaccatagtataagcgactaaattggatgcaagtagtggccaaatcaacgtcaagcctaagctgatcagctggagaagaatcgacggcacgttttgatcgttgtttattgtaaggtatgccatggtctgta

SEQ ID NO: 44674 - DNA, 1516 bp, Heterodera glycines
aaaaatggggtttgaaaagtttatgggaaaaaaaatcttaataaaataataccccggggagaagggagtgggaaacatgattcaaaaattttcaattttttctagtctaatttattcaaaacggcttcagaattcgataaaaataacattcacggtgggaaaaatgggggtttgaaaagttttatggggaaaaaaagactttacaaaataataccccgggaggaagggaggggaaacatgatttcaaaatttttgttgaaatatttgtcgttctctgaagggcgtgggaggggggggggcggaaggcgcccacacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttgtcggggcagtccccctgaaccgatgcgcccagatttatggggaaccgaatccttccggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggattgttgctccccataattgtttgagtaccccaa

SEQ ID NO: 44675 - DNA, 472 bp, Heterodera glycines
tcccttttgtgcactattttagtttttaaaattggttcttactttttggctttttgaaataaattgtgaaaaatatactaaaattattttagcttttaattattcagtacaatgcttttaagccccgccgtgaggcgggacagttccaaaattttgtaccacattttactgtggaaagtccaagtaccttattggacaactacgtgtcaatgagcacagtcgcctttggccagttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattattcag

SEQ ID NO: 44676 - DNA, 802 bp, Heterodera glycines
ataaatttttcaaaaaaagagatagccatttttttgggataaactataaatttaaaaattccttcaaaaaaaaaaggtctattgggcaccacccttccctatcattctcgagagcatttgtaggtgtataaaatttatcaaaaaaagagatagccatttttctgggatagagtataaatataaaaatcctctcaaaaataaaaggtcgattgcgcaccgccctccctatcatgctcgagagcatttgtatgtgtataaaatttatcaaaaaaagagatagccatttttttgggatagcctctaaatataaaaattctctgaaaaataaaatggcgattgtgccccgccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggata

SEQ ID NO: 44677 - DNA, 1088 bp, Heterodera glycines
tatttgggaaaaattcagggtgaaggggagggggggggaggggctcgggtgataaaacccggaagaaaaatttcaaaataaagcggatccctaatgggcttaaaaagtttatttttgaaatttcactcaatttatcccatataaattaaccccccccccccacaattaacgccctaatgacaaatttagggggacaattttgtattttacaaaattttcttcccctccccagtttttctgatgttcatcatgctttttgtgtccgttgtgatgttttacacaatttttttggtcctccaatccattcgattcataaaagcatccaaacggttgcaacgacggcgcagttcagtctatctgatcggccaaatcggtacaattttaattattatttttaacttttgtaaatttaattttattaattattttttagacccaagtttaatgagcattaaacgaccgtcgcaatgcagtcaaatgtgctgacaaaatggaaaaatcaagctcaaattttcatcaaattactatgaactttcaaatacaaatttcattaaatgtaaaaaataaaaattttccctacacatattatttttttgcatttgtcataaataaaaaaaaattctggaaaatatttataaatgtgggcctataattgaaaaccaaaaggaaaactctttttttaatataagggtaataatgtgaaaaaatccacctgaatgattggaatgaatgaaaagtaatttttatcggttaaaaaaagaaaataaaaataaatgaaaatgaaaaaacaaataatgggaaaaggtgcaaaaaacaaaaacaaaaaaatggcttaaccaaccattaaaattaaatcaaatttcccaattccatcatttctttccgcactttgtttttctgttaaaatgcccacgcaaatggcttatctgagcaaatccttggccacattcggtgcactaattgatgaaattaaattagggttggtcgggaccgggaccaaaacacggtactgaagttccggttttgaccgggaaattcccggttttcccagccaaaagtcccggtttttttacccgaaaagtcccggt

SEQ ID NO: 44678 - DNA, 875 bp, Heterodera glycines
gtttaattcgtaccaggtgttttcgacagtgatttggtttcgaaagtagttgatttagacagtactttataattaattttctacataatttattgtacacttaaattaatattattatataatttgcatatacaaattatttgaagtaattagacttgtataattaggtatgtttgtcaaaagatttaccgctttcctattttgtatacaagtatcttctgctcgactgtagtcgagaatacaaaaatttatttatatatgattctataatcgtgtgggaaaatctgctaactaatgccgtgtttgagtgccaagatgcaaatcaaatctgcaaagcagaattcgaaaatttcaaaccattcttaaatggataggagcatgtgtttatcattttaattttcaaaatttaacgagacttatgccatatagaacaagttttttaaaaagaacctttactgtcgaaatcaatcactgtcgagatcaccactgtcgaaaactaacagcaccgtttaactcgccttccttcgattcgtcaactcatccaaaatttacttaaaaaagcagtttccattgcttttcatgacgagtaaaatcatttaacacccattcaaagcgattcgaacccgaatcggcaaacggtctattatgttagggtcccgatttatgtgaaaaactttttgctcaatttttggctgaaaattatgtcatttttggactttttccgcatgcaatactttattttaattttagacatttaatgcttgaacaagcgactatgggcactagagaccggcgcaggacaggatcctgcgcaggattttgcaggatcccagtccgcaatcgtgcatatttggaaaatacaggatttgcaggat

SEQ ID NO: 44679 - DNA, 982 bp, Heterodera glycines
gagatagaaaaatttcctaaaaaagagatagccatttttctgagaaataattcacaattttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaaatcacaatttccgcagctcttgcggtaatggaaaaatttttggagagtctctgtggaacggataagcatcgggggttacgaagatagaaaattggtcctaaaaaagataggcatttttccgagaattaattcaccatttccgcagctcttaggcgaaagaaaaaattttgaaaggctccgcggaacggattacctccggggtaccaaaaagaaaaatgccctaaaaagagaagccttttttctgagattaattcccaatttcccgcactcttacgggaatgaaaaaaatttgaaaagggtctgccggaccggattaaactcgggggtacaaaaaaaaaaattggccttaaaaaagaatgccctttttctggagatttattcacaaattccccacctcttggggggaatggaaaaaattttgaa

SEQ ID NO: 44680 - DNA, 1241 bp, Heterodera glycines
  misc_feature (753)..(754): n is a, c, g, or t
  misc_feature (756)..(756): n is a, c, g, or t
  misc_feature (761)..(763): n is a, c, g, or t
  misc_feature (765)..(766): n is a, c, g, or t
  misc_feature (769)..(770): n is a, c, g, or t
  misc_feature (775)..(776): n is a, c, g, or t
  misc_feature (784)..(784): n is a, c, g, or t
  misc_feature (802)..(802): n is a, c, g, or t
  misc_feature (806)..(807): n is a, c, g, or t
  misc_feature (809)..(809): n is a, c, g, or t
  misc_feature (813)..(813): n is a, c, g, or t
  misc_feature (815)..(816): n is a, c, g, or t
  misc_feature (818)..(818): n is a, c, g, or t
  misc_feature (822)..(822): n is a, c, g, or t
  misc_feature (824)..(824): n is a, c, g, or t
  misc_feature (829)..(830): n is a, c, g, or t
  misc_feature (833)..(833): n is a, c, g, or t
  misc_feature (836)..(836): n is a, c, g, or t
  misc_feature (843)..(844): n is a, c, g, or t
  misc_feature (850)..(850): n is a, c, g, or t
  misc_feature (852)..(852): n is a, c, g, or t
  misc_feature (854)..(854): n is a, c, g, or t
  misc_feature (856)..(857): n is a, c, g, or t
  misc_feature (865)..(866): n is a, c, g, or t
  misc_feature (870)..(871): n is a, c, g, or t
  misc_feature (873)..(875): n is a, c, g, or t
  misc_feature (883)..(885): n is a, c, g, or t
  misc_feature (887)..(891): n is a, c, g, or t
  misc_feature (901)..(901): n is a, c, g, or t
  misc_feature (916)..(916): n is a, c, g, or t
  misc_feature (964)..(965): n is a, c, g, or t
  misc_feature (980)..(980): n is a, c, g, or t
  misc_feature (988)..(988): n is a, c, g, or t
  misc_feature (1010)..(1012): n is a, c, g, or t
  misc_feature (1020)..(1021): n is a, c, g, or t
  misc_feature (1026)..(1029): n is a, c, g, or t
  misc_feature (1035)..(1037): n is a, c, g, or t
  misc_feature (1050)..(1052): n is a, c, g, or t
  misc_feature (1059)..(1059): n is a, c, g, or t
  misc_feature (1061)..(1061): n is a, c, g, or t
  misc_feature (1064)..(1065): n is a, c, g, or t
  misc_feature (1073)..(1073): n is a, c, g, or t
  misc_feature (1078)..(1078): n is a, c, g, or t
  misc_feature (1089)..(1089): n is a, c, g, or t
  misc_feature (1091)..(1093): n is a, c, g, or t
  misc_feature (1098)..(1098): n is a, c, g, or t
  misc_feature (1104)..(1104): n is a, c, g, or t
  misc_feature (1131)..(1131): n is a, c, g, or t
atacccatggcctgaaacggacgaaaaacatgttcctcccaggtgttgttaagctacttcgagttattatgcctattccttggcttctatttttagagcctaaaaagcctaaaagatccaatttttgcctattttggcgttttacctaaaatttactaacaaaaatgcaataaaaattaaaaatgcccccccccaagaatcgacctgaaaatttttataaatactccttgagtattgaaaagtcagtaattaattttttcatcttgttattcaacgtcacaaaaaaaaaagaaaattttttattattcttttcaatgaaaaagataagtattttttcgataatacatgttcaatggaatgcctttgtttcaaaaattatcacttaattaataataagatttatattaaatatataatttaaactgaattatataagtaaaatattattgtaataaataatacattgtttgtctgttaatgcattcatcagacattcatagttgagcagtgttctttttttaaatttatttttgtgtatttaaataaatatttaaatatttattctagtttttaacaccatataatttatgtcatttatgtaaaaataacatattcatattatgcgtttaggtttttttggtcattttgccttgtaagctgagcttagttcacggttaatgtcaaaagaattttgatgaaatctcaaatttgtttcactaatatttcgcacgaaataacaaaaatatatttccnngnatgtnnntnngtnngatgnntgctgcgnggtgtttgctgttggcgntttnntncggntnngntttntngttcnntgnttnttttctnntttttntngntnnttttcttnntttnngnnnttggtcgnnngnnnnntggttgtttngtttgcttgttgttngtccgcctttgcgcctccctttttgtgcctcctccgtttgcgccctcnncctttgtgtccgccngcgtttgnctttttcgcccgttttttgccnnnggtgtgtnnccggnnnntcgttnnnggcgttctcttcnnncgcttgntnggnntttcttcntcgcnctgcctccgtncnnntcgtntgttcntgttcgtcccttcccggtggtggttgnttccgtggggctgcgtttctaaagccgcggggtatgtgtgttgtcggtggatgttggatccacagtaattaacaaggtaaagacgtgagataaatccttaggactctaga

SEQ ID NO: 44681 - DNA, 1000 bp, Heterodera glycines
tactcccggatacagattaaaacaatttttttcacccccagttttttttgtcatcggttgggtttggggttggacaaattgggtagtttttccccgcccaaactgttaccataccgtcactggcgcatcaattcgctgcacattgccttcctggagaagaatttcacgcgctttggcacacaacactttcacttcctgctcggttaggcattcacagcgcattaaagtttcaatttgtctaaaaaaaatggcaaatttttttgaatcaaaatttgttaggtatctaaaatataaaaacaaaaccataaaaacgagccattgataatgaaaaaattcgtgggcaattcgaggggcctagaaatcctttatttgatgaaaccattggaaaatgtgggcgcttttgagaggcctgtgaattggaagttggcaaatcaaaaatttggactgatttaagggtgtctagggcctagaactcggttttaatgccatgttaaaccaattttgcaattgaaaaattggtcaaagcctccaaacccaaattaccctaaaaacagtaaaatcagaaaccggcggcaactgccgcaccgccaaactgttcacctgtccaagtcggtgatgcgggcgcctcggcccgctgccaaagtgaccgcttcgtccagctcgcgcgtcgcctgctggtgctgttgtgcgtcactgttgtccgcttcgccgccatcgcgcagcgcggtcgacgtggccacactggcggcggacaatggccgatttggcgatgccgtggcatcattttctgtttccattatttttagtgtgaattaaacaatttattaattggcaccttaattcatgctcaagtaatgcttttctgtccgcactcaattagcgggaaatttatttattttccttgtgagaatttcatttggttgcgaaaaatacagtcctgaaaaattagccaaaaacgaaaaagaaaaccatcttttaaaataatttagaaaatacacat

SEQ ID NO: 44682 - DNA, 1079 bp, Heterodera glycines
tccttggccttcgaccgagcagcagttcagcgggacccttcaaattgggaagtgtgtcgtttggggtcgtccgatagctgatcagaaaaatgtcgatgatctccttgtttggcttcccctccccttttaattttctgaatgctctcttaaatgtgtcgacaaatctctccacttgtccatttgacattggattatatggagccgaaaataaatgtgtgatgccgttggctgcaacaaatttggcgaattctgagcttgaaaattgcgtgccattgtcagaaacaattgtttctggaattccatggcgtgtgaataaatagcgcaatttttcgattgtggaagttgctgatgaatttgccatctcaaatacctcagggtatttggaaaatgaatcaacgacaattaaaaatgttttgccgaagaatggcccagcaaagtcgatgtgaattcgttgccacgggccagttggttttggccatgaatggagatcggttttgatcggtgcctttgcagccaattggcacggctcacagttttggacataatcctcaatttctttgtccaatttcggccagaatatgtattggcgggcgagctgcttcattctcttcattccggggtggcctttgtgaaataatcggagaattttggcctgaaaaatcctcggaatgaccactctttcgccatacatgaggcagcctttcaaaatggtcagatcacttttgcgccgatggaaaagtttaatgatttccgattccttctcaatttgcttttcggttggccagccttggcggatgaatttgatgacattttgaatatttgcgtcatttttgctggcgatgaccaaatcctcgaatttgatcggcaaatttttcgaagctgaatggagactttcttccaaaattggttcggcggtgaccaaagcaatgacgcgttcgttttcctcttctccgccttttgcaatgagtcgggagagtgcgtctgcctgtccaaaatccgtcgttttaacgtattcaattttgaagtcataggccaacaaaatgagtgaccagcgcaacaatcggttgacgctgcactgc

SEQ ID NO: 44683 - DNA, 1019 bp, Heterodera glycines
  misc_feature (7)..(7): n is a, c, g, or t
  misc_feature (949)..(949): n is a, c, g, or t
tgaatantgtcgcctgggccagcaaaatcctaggcagcctctaacgctccacttccactcaacagcgaccaacaaacggtctttgatgctgttgttaaggcaattcagtcggacccaagggatgcgactgtacctcgccgtttctttatattcggcgacggagggaccgggaaaacatttctgtttggccaaattataaggcgattgcggaaggtcccatacacctacaaagtgcttgctacggcatccactgggtgtgcggctatcttgctgccatatgggaaaacagcccattccacgttccgtctaggcagagaagtctcgctagacaagcttccaagcattccgcttgaaagcttctttgcccgacggatacgtgaggcccaactcatcatcattgatgagatcaccatgctgcacaacacggtgatagaggtcatcgaccgagtgtgcaaagaaatggcaattccccagcacaaggacctcctcttcggaggaaaaacggtcatattcagcggtgactttaaacagtcactgccggtcgtgcctcacgaaggcctaactgcacaagttacggcctgctttcaaaccaatccactgtttggtcagtttaccacaatgaaattgaccatcaaccagaggttgggccaagggcagcaagcgtacttgcaaatgtgccgccaaatcggcctcggagagaccggagaacacttctggattcctccgcagttcctcgtaaagagcagggaagagttgatagactttgtctatccaaacttccaacaactccttggcaatgacaaagagctgctcaatcgtttgattctcgctccgcacattgacacgtgtgatgagatcaacgaaatcatgatggcgaatgtgcctggtcaagtgcgcgaatatttgtcctcggataagccgcttgacgagcgtccactggacatcgatngaacggagtccgaagtggcagcgttgaaccggcgcacagactctgggatgctcccccacgtctgcgactc

SEQ ID NO: 44684 - DNA, 1038 bp, Heterodera glycines
  misc_feature (893)..(894): n is a, c, g, or t
agaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaagaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaaacctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgnngggttattggcgatttcaaatcgatccttccggaacactgatgctgtttatatttagagcgtaatgagctgaaaatgtcagaattcaaaaagtggggtcgcgaaattagaaatctgagggtattgccgcttatcaacctgatcc

SEQ ID NO: 44685 - DNA, 1001 bp, Heterodera glycines
tcataggcgggatgttgtatattcccagcagcggtgccgcaaaattatccgaaaccgacccttttccggtcggcattttttttcattcacctttatggcacatcatcaattcatttccaatttaaattcttcaatttttaatggggcaaagtgcacctctctttctctctctcactttctgaaaatgccattttaattatgcgcaaattccgctcgccccattctctgctcgtcggcatcgccgtcggcgtttttcttggactttgcatcagcttattagacaataaaagcaaaatttacatcgcttttactgaagaagacacacaaaaaggtaaaagcaatgaattatttattttaaagaaataaatgtatgtatttagtgacaatttattcgaatttgccctcccatttaatgcgaatgggcaataaaaatgcgcaaacattgcattcactgaacatttggctacgttgcattgttttgttggcatcagatgaacaaaattggccagaaaagaatttgatggccattagagacacgtgggcgaagaaatgcaacgaaagtgggcaaaaaatgaaaaaataaatcattaccccaatcatttacagtgaaaaggatgctgtccagacctaccaactactgcgcgacacgatagtttatattactctacagaaaaagggggtttcgacttcaaaaacaaaatctcccggacgaaggccgagagcgccctgaaagtagtggaagggtcttacaactttttgaggcgcatctgggaaaaatagcaggtttttctcctccggtggtcaactgagtcccgagcggataatttctcacttttgcttgcggttgattgcccgtaactttatttctacaactctaatctatatatgcccggttgcgagggtacccctgccatactgtcctcttcttgctgagaattctttatttttataacatagcccaccccttgacctgctacaaaatggcaactgaaccgtgctca

SEQ ID NO: 44686 - DNA, 1105 bp, Heterodera glycines
  misc_feature (75)..(75): n is a, c, g, or t
  misc_feature (83)..(83): n is a, c, g, or t
tcatgctcgagagcatttgtatgtgtataaaattatcaaaaaaagagatagccatttttctgggataacctctanatataaanatcctctgtgaaataaaatggcggttgtgcacagccctccctatcatgctcgagagcatttgtgaggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataaagtataaatataaaaattccctcaaaaataaaagggcgattgcgcacagccctccctctcatacgcaagagcatttgtaagtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataatatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaatttctcaaaaaaagaatagacatttttctggatagagtataaatttaaaaattccctcaaaa

SEQ ID NO: 44687 - DNA, 881 bp, Heterodera glycines
cggtctccccataaatctggggcgcatcggttcggggggactgcccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccatatatctgggcgcatcgtgtcggggggggactgccccgcaaacaaaaa

SEQ ID NO: 44688 - DNA, 1034 bp, Heterodera glycines
  misc_feature (1019)..(1019): n is a, c, g, or t
ttttgtgcgttttcaaacacactattagtgctttatcaccgctacaatagaagacaaaaagttggtgtccaattcccgggtagggatttatagtgactttcagagatagccattttttgtcaataactatttttcgtgagttttcaaacacactattagtgctttattcagcgctacaacaaaagacaaaagttgatgtccaattcacggtagggatttaatcgtgacttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgctttattcagcgctacaacagaagacaaaagttggtgtccaattcccggtagggatttaatagtgactttcagagatagccattttttgtctagaactatttttcgtgagttttcaaacacactattagtgctttattcagcgctacaatagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtccaattcccggtagggatttaatagtgactttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgctttattcagcgctacaacagaagacaaaagttggtgtccaattccagaaggtgatttaatagtgactttcangagatagccattttt

SEQ ID NO: 44689 - DNA, 1400 bp, Heterodera glycines
ttttgttggggcaaaggcccccaaccatttcgaataccaatggattggggtggctaaactccatatttccagaaatagcaatggcagtttttttttaaaggccctacgaagtatgtttcgacaaacatccctgtacaccataaatcgattgccaaatttagtcgaactatattaatttttcaaaaaatgatttcatctttttttatggttagcgcatatgtctctagccttatagaaacggttaccgaatctgcgaggaactacttttttgagaatttctatagattattatttttgcatgaatccttcgcttaaattcccatttatcttataaagtcagattaaattaattaccccgatttgttttagaattggtccaaacacgcttgctaatagattttcttttcgaaaagagaggcgaggaaaaataaaggttgcatccaaatgtaattttttttacactgaagcatttggatggcttgctgtgtacagttggctaagtcttatttgcaagaagcagcagaacttttgtttgggccaatgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgcttttccatcccctcctcttcctccttgtccccctgcctctccctccccctcctcctcatccccttttcgcttcatccgcccccccaaattacttcgttttgttcgttcacttccctccgatttcgctggtcattttgtttgcccctctccaatgcgtcttcacttgccgtgctaaacaaatgtcgcctttcggtcagcccggccgaaagtggcggtgttggccaattcaaatcgcttccgacgacgggaaattttgggggaggaaaacagcggacaaatgccgaattggacggagccaacggaagaacggacgaagcggaagaagaacaggggatggaccagcagctgggattggtcctagacagaagaaacaaccgttccatattgagagggaaatggcatttcgcattttatcgaattgacaaaattctgaaaatgccgtttttgacgaaaatggggaggaggtaataggatttcaaattcgaattcgttttgaattggtcggatgactaaaaaaaactcgcctcggtttggccttcgcctgcgatgtctgttgttctccctttgttccattgttttgttgtttgtcgttgtgtgatggaactgtggtgacactttgcggaccggcagacgaagaagacgaatgtccggacgaatagagcggacttcccatggcaatgccccg

SEQ ID NO: 44690 - DNA, 439 bp, Heterodera glycines
gcgattattggcgggatgtgtgcaaatataagttatctctgggaccaggaacgcataattgttgaaatagaaaaattggtggcgttacatggaacaaatcaccgggaaagtcgcgaagtggatttcgattgaaattgtaataattaataaaaatcacaaattaattttcgttttatttgttaaatttgaattgttcaggaaaatgtgtggccatttgaaatggagagacaggcaaaggctgcacttggaattgtggaaatcacggacccttacgcatacaacaaaacagcgaacacaatcaacagcgcagtttctgaacgcggacctgaaaagtatttataataaaaagtttaaaaaatttgaaacgagtgaattttcttattgtttattagagatcggatcgggcggatagaaaagctgacatttgccaaagaatttg

SEQ ID NO: 44691 - DNA, 832 bp, Heterodera glycines
ctccagcaaattcaataaaatatttctactacaaattcctttatttccccaaaaaaattttttactcaaattgttatacaaaccaattttccctttgctggaggtcgacttttccgcttctttaaataaatttcaactcatatcacaactgcccattgacctattttttcatcacaaaatatacagcgttagttcttcaaataattattaaatataataaaaaagtcttctttttttgtggaaaaattatcaactataaaaattctagaaataaatattcataattatataaaaaaatatattcaattcaaaatattaaaaaagcaaaattgtaaaaatataagtaattaaataaaagtaaaataaataaattttaacattttaactttactctgcaattagaatttataagcaaattcctgttttgattactaaaattcaagcaaaaatttttattcttttctgattttgattatgatttattgacaatgccaagcaaagtaaaaccgaataataaaccgataattcttatatttatattttaaagagaaaaaatatatgttttaaattcgccgtcgcctgctttacggaggaatggaacaaagcgcaactgaggaacaatttgagtacgacgaaatggaaaacggcggagaacaaaatgtcaacggtatggtgcaacaaaatttggaaaatggagttgaagaaggggatggaggggattttggaaacgatgcgttggacgcacatggattgcgagccttttcaacacctcttaacgaacaaaacctaagcgccctgcagcgagacctaagaatgcaactcccggaaaatt

SEQ ID NO: 44692 - DNA, 1507 bp, Heterodera glycines
  misc_feature (236)..(236): n is a, c, g, or t
  misc_feature (352)..(352): n is a, c, g, or t
  misc_feature (1300)..(1300): n is a, c, g, or t
aaaaaatggggtagtaaaatcgtattacgctcaaaagcttctcaaacaatttagcgctccaattccttctacaatcgcctttatacatcccattatgagcgctaaaattatcagagtgccgaaaatcgcatgtatctaagcctagcaaaaatggtgtaagtaaaaatcgtattacgctcaaaagcttctcaaacattttagcgctccaattccttctacaatcgccttatacatcnccattatgagcgctaaatttatcagagtgccgaaaatcgcatgtgatctaagcctagcaaaaaatggtgtaagtaaaaatcgtaattacgctaaaaaagcttctcaaacaatttangcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctaccatcgcctttatacatcccattatgaacgctaaaattatcagagtgccgaaaatcgcatgtgatctaagcctagcaaaaaatggtgtaagtaaaaatcgtaattacgctcaaaagcttctcaacaattttagcgcatcaattccttctacaatcgcctttatacantccattatgaacgctaaaatatcagagtgccgaaatcgcatgtgatctaagcctagcaaaaatggtgtaagaaaaatcgtaattacgctcaaaaagctcctcaaacattttagcgcttccatttcctctaacatcgcctttatacatcccattatgagcgctaaaatatcagagtgccgaaatcgcatgtgatctaagctagaaaaa

SEQ ID NO: 44693 - DNA, 967 bp, Heterodera glycines
ccatttttctgagaattaattcacaattaccgcagctcctgcggtaaatggaaaaaattttgaagaggctctgcggaacagattagcatcggggttacgagatagaatattgtcctaaaaagagatagccatttttctgagaattaattcacaattaccgtagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaattaccgcaactcttgcggtaatggaaaaaattttgaagaggctctgcggaacagattagcatcggggttacgagatagaaaattgtcctaaaaagagatagccatttttctgagaattaattcacaatttccgcagctcttacggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagcacagtacggtaatggaaaaaatttgaagaggctctgcggaa

SEQ ID NO: 44694 - DNA, 806 bp, Heterodera glycines
gggttgcgagataaaaaattctcctaaaaagagaaacccttttttgagaaatttatctcacatttcccccctcttttgggaaaagaaaaaaatttgaagagggtctcccggacggagtatcacggggggggtgagatataaaaatgtctcaaaaaaagaaaaccatttttttgagaataaattcacaattttcccagctttttgggtaatggaaaaaattttgaagaggctctccggaacggattagcatcgggggtgcgagatagaaaattgtcctaaaaagagatacccatttttctgagaattaattcacaatttccgcagcttttggggtaatggaaaaaattttgaagaggctctccggaacggattagcatcggggttacgagatagaaaattgtcctaaaaagagatgccatttttttgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaatttcctaaaaagagatagccatttttctgaga

SEQ ID NO: 44695 - DNA, 724 bp, Heterodera glycines
  misc_feature (57)..(57): n is a, c, g, or t
  misc_feature (387)..(387): n is a, c, g, or t
  misc_feature (427)..(427): n is a, c, g, or t
  misc_feature (495)..(495): n is a, c, g, or t
  misc_feature (608)..(608): n is a, c, g, or t
  misc_feature (687)..(687): n is a, c, g, or t
  misc_feature (714)..(715): n is a, c, g, or t
  misc_feature (717)..(717): n is a, c, g, or t
aaaaaaaaaaaatcaattttttccaatttccttttgctttactcaaacaattattcnaatcaaaaatccaacccacaattaaactacattctatactaaacctattccccaattattctttctccccataaatctacacacatcatttcatggggactgccccgaaaacaaaaaaatcaattttttcaagtgttccgtttggggtactcaaccaattatggcaaccaaaaatccaacccaaaattaaactacaaactatataaaaactattcccaaagtattcgttctccccataaatctaacctcatcgattcgaaaacacttccccgaaaacaaaaataaatcaattttttcaactctccttttacactactcaaacaattatantcaacaaaaatccaacccataattaaaatacactctatantaaatctattccaaaaatattcattctccccaaaaatctaatctcatcatttcccaacaactcccccnaaaacaaaaaaataaattttttcaattatccttttaaaatactcaaacaattatctaaaccaaaaatccaacccaaaaataaattacacactatatggaaactattccccaancattccaactccccataaatctcatcacatccattcaatacaactaccccaaaaacaaaaaaatcaattttttcaaatntccttttaacctactcaaacatttatnnanaccaaaa

SEQ ID NO: 44696 - DNA, 1619 bp, Heterodera glycines
atcgatttttttgttttcggcgtagtccccccgaccctctgcgcccagatttatggggagaccgaatccttccggaatatcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcttaaattttaaaattttttaattgctttttaaatatgccaaaaaatgtaggcttaatttttttagtgaaattcgatcactcatattttttgctaatgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcag

SEQ ID NO: 44697 - DNA, 1218 bp, Heterodera glycines
tttcatagtttttattacaaaaaaattttgcacaacaccatggttcccccttttgtttttgataaaattcaaaagacttcttttaagtataaatacccaaaaccggactggcgtccattttcccttttcaaaacgaagctgaccctaaccattttttgagccaaaaacgaaatgaatccgcttttgtcacctttaccttgtccaaaatagcatctgtcaacttttcttgccggaaatgctcataacccgctgtttgactgactgctgactttcggccgcagattaacgttggactatagctccaacaacctcaaacacagcaatgccacccccctcatattgctcatcagagtatgaacaatatccaactgagggaccgtccaacagttttgtccacacttccgtttgacctcggcttgaatttgagtgaggaggagcgcaaagcgaaggctcgcgtgcctttgccttatttggacgcgcaaacagagaaaggtcaacactttggaagtttttcatttgtttggacagctaacaaaatgccaaaatcgaccctttaaaggtttggttggtctcaacatttcacacagcggcccaattttgggctccaagtacaattatgctggatttttatttagtaatcagaacgccaaaactttgcaaaacttaaaatttttttgggattttcccttgtaaaaatagaagagccgatctcgagttaaaaacataacttcgaaaaaataaacagggattcgatagagggggtcaaaatatgggcctatgcaaaatttcaagaaaatctgaccctaggaaaaattttttgacccaggacaaagttttttctttttctttcattttagtgtactatttccatgtctctaacatataaaataacacatgaaacatttatttgccaataaacaattttaataatcttttgactaaattagaaatattcttcagaattttcccttcaaaatgagcataaaatggttttatttgctctagtattcaccaagttataagctaaaaaaatttcataaaatcaagggtaaaatatagtgtgtaccttttactgtttgtatttgttcttttggcgttctgtatttattattattttatttatttgctttaaaaaattgaaatttatacacaaacacaaggaggatttgaacctgagaccccctttttgatgactaactcacagaccactaagacgaa

SEQ ID NO: 44698 - DNA, 785 bp, Heterodera glycines
ttttgggtaaaaattttcaaataacatagtaaaatgaaggtctggcgatgccgattttgatggagtttgttagtaaaattgagtaaatttccaaaaaattggccatttcttgttaaattttcatttcgggggggggggggtggatgtcccgaaaaggagccgacccatcacaattcaatttttcaaatcccataattttatattgccccatttttcgcgtttttgatttaaatataattattttcatttaaaaataaatgcgcaaaattaaaattgtgcaaataattggttcatccgtccatcatcatcaatcacaacagtgtgcctttggttgccctctttttgctccgaatgccttctgttgctgcgtttgtgccactcgtcgtcccttgcgcctcctccgtttcttcgtcgccgatcattcgcttccgaatcattcctttgcgtcgcatttgctgtattgaaaatatacaatatttttataaccacagggggagtatttccaggaatcaagagtcgggaatcccggtctcaaaaaaaatagcagagtgagggatgaatttttatttaatttttccaaattttcataagttaaaagtctcaattttcattaaaaaaagtttttttttgctgagctattatttttccaaattttaaaaaatttgaagcagttgtaatttactgggagcagtttgttttccctcgaaaaatcaaagatagaagaaattttttttctagaataatgttttccaaaaaaaaaaaaattaataaaacagggatcaggt

SEQ ID NO: 44699 - DNA, 724 bp, Heterodera glycines
cagcatttcaatcactgggactcaattctgcatttcaatcactggcactcaacccaccagcatttcaatcactgggactcaacccaccagcattccaatcactgggactcaacccaccagcatttcaatcactggcactcaacccaccagcatttcaatcactgggactcaattctgcatttcaatcactggcactcaacccaccagcatttcaatcactggcactcaacccaccagcatttcaatcactgggactcgattctgcatttcaatcactggcactcaacccaccagcatttcaatcactgggactcaacccaccagcattccaatcactgggactcaattctcctgcatttcaatcactggtactcaattctcctgtatttcaatcactgggactcaacccaccaacattccaatcaacgggactcaaccctctagcatttcaatcactgggactcaatccaccagaatttcaatcactgggactcaacccaccagcatttcaatcactgggactcaacccaccaacatttcaatcactggtactcaacccaacagcattacaatcactgggactaaacccaccagcatttcaatcactggcactcaacccaccagcatttcaatcactgggactcaatcatgcatttcaatcactggcactcaacccaccagcatacaggcactggcactcaacccaccagcatttcaatcactg

SEQ ID NO: 44700 - DNA, 947 bp, Heterodera glycines
ccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaaagataagcctaaactttttggcctgtttaaaaaggaattaaaaatttttaaaaatttattcatctccctttttgatagaaaaagcatcagagtgcctaaactagcatgttttaaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatattaataaattaattatgcaaaaaacaaataaataatgaactctcttccttaataattttcctgcaccgaaggtactcactcggccgcttcgcggcctcgtggtgggccttcg

SEQ ID NO: 44701 - DNA, 1264 bp, Heterodera glycines
  misc_feature (8)..(8): n is a, c, g, or t
  misc_feature (42)..(42): n is a, c, g, or t
  misc_feature (1119)..(1119): n is a, c, g, or t
gatcaggnaaattcatgccatgaattgaaaagtatttatttntattaaaatttgctgcttattctccgtaagaaagtttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatatttacaagttttgccatgctatttatctttcgggactcaatttatgacgaaaatatgggcttcaattattttttattttctactaacacttttctagtggatcaatttatagattcaggaaattcattgcatgaattgaaaagtatttatttttattaaaatttgctgcttattctccgtaagaaagtttttgggaggaatttcacaaccttgccataggaaaaactcatatctgactcgtataaaacataactcgaacagtaggtatatttgttgtgcaattttatggtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttggtattattctgacgacttccatgataataaatacttatacaaagtttatctttttatatatttcctcatcccaaacatggatggaaaataggcaataaatcgacaaatatttacaagttttgccatgctatttatctttcgggactcaatttatgacgaaaatatgggctccaattattttttattttctactaacacttttctagtggatcaatttatagattcaggaaattcattgcatgaattgaaaagtatttatttttattnaaatttgctgcttattttccgtaagaaagtttttgggaggaatttcacaacctttgcataggaaaaactcatatctgactcgtataaacataactcgaacagtaggtatattttgtgtgcaattttatagtccagccttcgctag

SEQ ID NO: 44702 - DNA, 1213 bp, Heterodera glycines
  misc_feature (1157)..(1157): n is a, c, g, or t
  misc_feature (1168)..(1168): n is a, c, g, or t
  misc_feature (1181)..(1181): n is a, c, g, or t
aagcagccgaatgtcccccaaaaaataaaaaaacgtgcgcgacgcgcccgtcctgaggtcgcgaagcggccgaatgccccacaaaaaattaaaaaacgggcgcaaagcgcccgtcctgaggccgcaaagcggccgaatacacttgctcatcacttatcaaacgcgcatgcactagcaacgaagtcctttgcgcgaagcgctcatgtcagcgcccgcccatatctaccaaaagtatactgcctacaccgagcaactgctgcgccacacgctagttatatatacgttagaatgataaggagtttcgtttcaaaaactaatttgagaagaacgggaatagctggggggctgaaattttgcacacaggggtaactcgagacggcgcatccgggaaaaatacggattttttggtccggtggccaactgagtcccagcggctcgaaaactgactttgccgccagtctcagtgttacgaaattttttgcttttgctttcagagcttagcggaccccaaaagcgaaatgccccaactatggcctacaactttgccagcaaaaaatttttgatcagatcaaaggcctgacctgtaggttaggcaacgtaagaatcactttttttggacacttcagtaccaggcgaatagctcgtaagggtttgctcggagcagggggtcgccagcggacttattgtagagctcaatgagctcgatttttacaaattttaaaatttcgaaaattttcaaaatttttcgagttaggcctaaaattcggtttttcggtttttgaattttatgattttttaacgatttttccagggaaaacgaagaccacttccaaaacatcgttttttgagctctatcgattagtgatgtttttagaaaattttcgattttttccaggaaatagaaaaattttttggcctaagcgggacatttgagtcccgggcccataactcgtcgggggttggttttagccaaaaatggccttagagcaaaattgtagagctttttaaatgctatcgaatggtgtactatatgtcgaaaaattttcaaaaattttcgagctaggccccctagaaatttttgaaaattttttttgggttgaagaatggagtgaaaatatttttctggggaatatttttgaggtgctgagcacgatatngacttttgttnttcgtttcataantttttagaattttttaaaaattcgaaattttt

SEQ ID NO: 44703 - DNA, 675 bp, Heterodera glycines
acaaaaataaagattcgatgggtgatcagtatgtgtactttttggtcagagtgatctctataccttctttatctatttgacaaaggctccctcatcactgatcagaagctaaattcatcgctttgaagggatataaaaacggcatgccatcctcatttacgatggcattggcattttcgcgccatcgttggcacattttgattactttgctcctccttctccttgtgccaccatcgcctgcagcagcttcatcagctaagtcggcaccacccgatgatggtggtgaattgccgcttcatccgtcctcaccgccccaccgcaaagcgccgccggctcagcaccagcaacatcggcactttattcagtacagcgccggcggcgccaggtccaagcggcaggcctaccaagtgtacctgggcaatgatgtaaaataattttgtaaaaattagtgaaaaaaatccaattcatcacaggtcagtgtgagcgttgaccgtggccaaaaggacagtgggccgtggggcccatggacagttgagcgcgaatgttgtaagtaccagcgcctttgatttttttatcagatcgggggaccagtcagtggtgattagtttccgcttttttccccttttaccatcaatctccctgaattttttaaaaatttttcttgagtaattttat

SEQ ID NO: 44704 - DNA, 1008 bp, Heterodera glycines
  misc_feature (898)..(898): n is a, c, g, or t
ggatattcgcaaaggaaataatagtagaatgagagtcattaaatagaaataagaattcaaatgaaaattcatgggtgtttatataatattcatagttaatgggcatatgctacggcaatcaggggttggatttcttcagggatattcgaaaaggaaatatagtaaaatgagagtcattaaatagaaataagaattcaaatgaaaattcatggctgtttatataatattcatagttaatgggcatatgctacggcaatcaggggttggatttcttcagggatattcgaaaaggaaataatagtaaaatgagagtcattatatagaaatgagaattcaaatgaaaattcatggctgtttatataatattcatagttaatgggcatatgctacggcaatcaggggttggatttcttcagggatattcgaaaaggaaataataataaaatgagagtcattaaatagaaatgagaattcaaatgaaaattcatggctgtttatataatattcatagttaatgggcatatgctacggcaatcaggggttggatttcttcagggatattcgaaaaggaaataataataaaatgagagtcattaaatagaaatgagaattcaaatgaaaattcatggctgtttatataatattcatagttaatgggcatatgctacggcaatcaggggttggatttcttcagggatattcgaaaaggaaataataataaaatgagagtcattatatagaaatgagaattcaaatgaaaattcatgggtgtttatataatattcatagttaatgggcatatgctacggcaatcaggggttggatttcttcagggatattcgaaaaggaaataatagtaaaatgagagtcattaaatagaaatgagaattcaaatganatttcatggctgtttatataatattcatagttaatgggcatatgctacggcaatcagggggttggatttcttcagggatattcgaaagggaaatatagtaaatgagagtc

SEQ ID NO: 44705 - DNA, 791 bp, Heterodera glycines
atttgagtgttgagcagaaaaagagatagacgttttttcaaaattttcagagccaaactcgcccagaaagaaaatccagaaaaattagggtcgtcgctggtattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaaaaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggagttcatttgagtgttgagcagaaaagagatagacgttttttcaaaattttcagagccaaactcgcccagaaagaaaatccagaaaaattagggtcgtcgctactattccgaaaatgtggttggagttcatgtgagtgttgagcagaaaaagagatagacgttttttcaaa

SEQ ID NO: 44706 - DNA, 656 bp, Heterodera glycines
atagggccataatttgtatgattttgcatattttttctgcgcatatgctatgaagaaaggagctcaaaaatagcatttctagtaaaattttttgatttggggaaggttttactgcatataaaagcatattttgggggttttcgagaataaatgcatatttggccatttttgcatttttagaacataactcggtcatttttggcaaattttcttaagaaaaatgcaataaaaatgaaaaatgcacccctaaggatcgatctttttgggaatttaaaaaatatacccttgaaaatagaaaaattttgaatttttgtaagaacttttgaaaaaaaattgttgatataagaaaaatgtaatattgttttagcaaatgacaaaaattttaaaaattcgaaattgcatatatacactttgaaaatcaaatttttttttcaattatctaaaaagccacttttttaaagtcaattctgtatttttacacaattttgctttttttttttgagagttagaagccattttgggtaatttttaaggcatattttagtgcatatttgggcatttttcgggtttttagggcatatttgggggatttttagtgcatattttatgcgcatatttgacatattttagtgcatacaacttataaccctagtaat

SEQ ID NO: 44707 - DNA, 1015 bp, Heterodera glycines
  misc_feature (59)..(60): n is a, c, g, or t
aaatagcttctgagataataaggtttatcataaaattcaaattaaaaataaccctcaannttattggtatgaacgatactttccaaacatgcacacgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaaataaaccctcaattattggtatgaacgatactttccaaacatgcacacgttttgcgctcgagctatttagcatcgggcttgtcaatccaaagcgaaacaacaaagataatggttgaacgaataaagggcataggttatttgaagaag

SEQ ID NO: 44708 - DNA, 1270 bp, Heterodera glycines
  misc_feature (106)..(106): n is a, c, g, or t
agtactattcttttaccttcatttattttgttgtatagttgattccgggagagcgtccggatttgaaaatttatcaaaaataaagaagtacaaaacttacttaaanaacacaaaaatgagaaataaaaacgatggaagcgctcctttcagaaatacacaaaataggtattcaattgagtttgcgttcgctaaaagactatgtcggcagaataaaaaaggtctcaacttatactaatttcctgataagtacgtctttacataattttcaaggtttttcagcttgatgagactagtcaccgttcagtatcagaccaatcggagcaaactatgccaaatacccaaaagttgtccatttttttttcttaaattattttaaaattaagtccgttaattcaaccccgctatgtaaagtgcttttcaaaaaaagataatgaaattgtttatctaatcggagaggaaaatgtgtggcgcaaatttatgtcgacaaatttcgtggaaccaatatataccttgtatgtactggttgcaaagaaatccaacgtttaaaaaaatcaaggttaataacatttttaggttataattttttcaatcattcagaacccctataatagcacgtgctattatacgagacgacaaacttttttttacaaaagctgaacaccataatgattgcatggctcatagtttagaatttctagaatctgaacaaatagagttatctcagcgacggaaaatattagaatgcacagaaatatggcaaaatgttgatccaaaatccctatgggccgaggttagatcaaatattaaagtccaaaaaaatacctaaaatcagggtcgcggaattgcgatgaagaaggacgttgagctaggaaaagacatagaaaatgatacatcttactcgctgaattacccaacttggcaaaatatacgtcgcacttacttgcgtagaaaagacagagcaattgcgcatggtcagacagtaaaagaggatccatttgacatcccagaaaaattacaattaactcggtttggaagtctaaaactcatgcttggaaaaagcattgcttctaacgatttgtacgattactttaaccagggcttcccatgtaaaattataccttaggtggctaatatatcgcagccgtaaagatggtgtactgatttttgctagtgacattcaagtacgggcggtccagaattgaaaaattttttgtcgccgatggcacatttgaactttgtcccaaaggctttgctcagatctggacttaca

SEQ ID NO: 44709 - DNA, 1048 bp, Heterodera glycines
  misc_feature (26)..(26): n is a, c, g, or t
  misc_feature (60)..(60): n is a, c, g, or t
tatgggcccgggactcaaatgtccgnctcaggccaaaaattttttctatttccgggaaanaatcgaaattttccaaaaaaaaataccagtcgatagagctcgaaaaactgttgcttggaagtggtctccgtttttctgggaaaattcgttaaaaattcctaaaattcaaaaacccgaaaaccgttttctaggcctagctcgaaaaattttgaaaattttcgaaattttaaaatctggaaaaatcgagctcaccgagctctacaataagtctgctggccaccctgcgctcaggtcaaagcctaatgagttattcaacggggactgaactgggcaaagttggtactgaaaagttgccaatttctgcagcccttccaagtataggtagaggcctggaattttttttgaaaattagaaaacacttcaacttagtttcctaccagcaagcattttttgatcagagttttagaaaaaaagttatgggccatcaaacgcaagcaaaagtgagaaattggccgccaggactcagttggccaccggagcggaaaacccttatttttcccagatgcgcctcaaaaagttgtaagacccttccactactttcggggcgctcccggccttcggccgggagattttgttttttgaaacgaactgcaacgtttctctatagtagtataaactagcgtgtcgcgcagtaattgctcggtgtagacagtatgctttttgtatgtatgggcgggcgctgacatgagcgcttcgcgcaaaggacttcgttgctagtgcatgctcgaattcaaaattcaaaattttaataggcttatgtttttttcaaaattttaaaggcgacatttgcagcttcgcggcctcagacgggcgcttttgcatccgtttcttaaaattttgttgggcttggacgggcgcttcgcacccgatttaaattttgttggggtcaaacgggcgcttcgcgcccgttttttaattttttgggaattttcggcagcttcgtggccttaagacgggcgcttcgtgcccgtttttagactttgtgggg

SEQ ID NO: 44710 - DNA, 853 bp, Heterodera glycines
ggaggggggggggcgaaggcccaccacgaggccgccttcggagcgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtac

SEQ ID NO: 44711 - DNA, 1033 bp, Heterodera glycines
gagcatttgtatgtgtataaaatttatcaaaaaaacctccatccatttttctgggataacctctaaatataaaaatcctctgtgaaataaaatggcgattgtgcacagccctccgtctcatacgcaagcgcttttgtgaggtataaaatttctcaaaaaaagagatagccattttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaa

SEQ ID NO: 44712 - DNA, 1065 bp, Heterodera glycines
tgagcgagtgcagacggaacgaaagaggaatggcgaaaatggagggagaagaaagtgaggaggacatgaggaggaagtggcgaattgggaggacttgccaatcggacaaatttttatcacctaattcgatgatcagggacattcatttttatttttgcccaaattctcctttttctttgcattaattatgttttaattttaaatgttttcaatcatttaaattgttaatttctatttctcatttcctctcctattatctccgacacacatctcttgtaaattgacggcggtctcatccgccaaatttaagccattcattctttcccattctccctctcttcacttcacttcgacaaacacaatttaaaatgctttaaaacatttttattgctcttcgcatttccatcaaataaatcacaaactttttgaaaagaggcggaaaaccatttaacaatttattggcattggattttcactcatttcgtcaaatcacattctcacctcaccaagggaatttgactcaattcgaccactgcgaccaattgacacggacaaccattgcgccggacaatcgggaaacattggacaaattggaaattggacgcactgacaatttgcaaattggacgctctgacaaattggaatttggacgcactgacaaattggaaattggacgcgtttgatccaaatgtatggcggatcaaaatcaagaggtcactgtttgtgaattggcgaatccggcaagggaaagaaaccaaaggaaattgggttcctttctcacagtttatgtgaaccacttctcaaagtggaagaggattagaaatacagtggcgtatattaggcgaatttacaagggacctctccaatttgtacaacgaattgagccaattcaggaacgtaaactgctcaaagcaagtagtgaaactataaaaagaattaagcctctcacggcggatgaattaagagaagctgaggaagtaattatcaaagagatgcaagtgaattttcctccagatggaaatacaaggaggaatttacaaatgttcacagacgagaatggtatat

SEQ ID NO: 44713 - DNA, 580 bp, Heterodera glycines
atttccacgtattcctccccccccccattttcctaatttggttcatttctcctcattttcggtccctttgtccaatgaatgcgtcgctttgtcttcgctttcgctgtcgcgcggttacaattatcgcgatcaaattgtgattaaccccgaaagattggccaattacggacaatgcatcagcaaattctttgaggagcatttggataacgccgacgaaattccatacattcgcgcgggggagggatattttgacgtgcgattgaaagaggtgagagagaaacagagaccggggagagagataatgggaaagagagagagacggggaaaaacgaataggatataatggagaagagattgagtgagataattgaagagagagacaggggaaagagagacggggagacgccccaacgattgggtgttaaggatagatggatttgaattttgaccgaaccgggtgatttgttggtttttccttcccgaattttcccccgattccccggttcgaaaaaggttcttccgaaggtcctaaatatcctaaatggcccttgccccccccccccccccccgcccctcctct

SEQ ID NO: 44714 - DNA, 332 bp, Heterodera glycines
  misc_feature (277)..(277): n is a, c, g, or t
acgccaagggattttcggtctacaggcatcgcgaggacgcattcataattttgtggacgactttcggccgcttcgcggcctcaggacgggcgctttgcgcccgtttttaaattttatgggggatattcggccgcttcgtggcctcaggacggttgcttcacgctctttttaaattttgtgggggacattcggccgcttcgcggcctcaggacgggcgctccgcaccctttttatatttttaattcggccgcttcgcggcctcagcacgggcgcttcncgcccgttttttaattttttgggagacgttcggccgcttcgcggcctcaggacgg

SEQ ID NO: 44715 - DNA, 1207 bp, Heterodera glycines
ttctcaattttcccccggcggcgcctatcggcacccctctatggctttttttcactttgtttttgtttaaaaaactcacattttaaagttgcaattttttcgaattcgaacaggaaattcgaataattattttgatattaaaccaaaaatataaattgatttcgatttcagggttagaacaattctcacttattttttggttcaaacatttgacgagcggtaatttgtttcaaaaacccgagaaatttcccgagtcgggaatcgagactctcgcacagcaataatatgcaccgccggacccccccccccccccccatgttcccaaaaagttttttgaaaaaatttttctcaaaaatggcaaaatatgtgaaaaaatgtgccaaaccccgaaaaatgtgcgatatgtttattatttaggcgaaaaattggggtggaaggccggatttgaaccgccgctcggggccccttacgtggatccgttgtcttagccactagaccacatccaccactggagggattactgttgttatggggccatctttccttcattttggcccctgtctttttgctcccacagcaatttgagctcccacagctattttcgatcagccattacattcccctcctctcatattcgagcgccctcgctcgagagatggcgttgggccgttcccgctatgcaaggatcggcgcgcctccggttcttttgccccagtgccagctgttgtttctggagtgtcgagtggtgtgaagaccaaacgacctggggtgtccgccaagtgtcaccataagccttttcccattggaccgttttctcttttcacgatgatttgcatttgtttgctcctttccacagtatccaaagtccaatttggagccgtctccgtttgtggaggtttcgctgggccgaatgactcagcggacgccggtgaagccgaagactgtcaacccgttgttccagagcaaattcaacttcttcgtcaaacagcccgaggggcaggaactgaaaatccgagtgaggacgaaatttggcaaaatccacgaaaaataatggaataaatttgcaggcggtggacgaagggacgaaacgcgacattggcgaattgtccattccgttggctgccgttatgagagagccgatgatggagatgagccagcagagcttttacctgacgcatggcgtccattccagccccaattgtgctga

SEQ ID NO: 44716 - DNA, 1003 bp, Heterodera glycines
  misc_feature (50)..(50): n is a, c, g, or t
aggtggaacagcatgaggacgatgcaaacgcaacgaccgtttcaagcagnacagaagaaacagctggtactgcaaagctcttagagcaggaggacgatgcaaacgcaactactgcttcaagcagtacagacgaaacagcagtgactgcaaaggtggaactgcaggaagatgatgcaaacgcaacgacagcatcaagcagtacagaagaaacagctgttactgcaaaggtggaacagcaagaggacgatgcaaacgaaacgacgggatcaagcagtacagaagaaacagcagtgactgcaaagattgaacagcaggaggacgatgtaaatgcaacgacggcatcaagcagtacagaagaaacagcagtgactgtaaaggtggaacagcaagaggacgatgcaaacacaacgacggcatcaagcagtacagaagaaacagcagtagctgtaaaggtggaacagcaggaggacgatgcaaacacaacgacggcatcaagcagtacagaagaaacagcagtgactgtaaagttggaacagcaggaagatgatgcaaacgcaactacggcttcaagcagtacagaagaaacagcagtgacagcaaagatggaagaacaggaagatgatgcaaatgcaacgacggcttcaagcagtacagaagaaacagcagtgactgtaaagttggaacagcaggaagatgatgcaaacgcaactacggcttcaagcagtacagatgaaacagcagttactgcaaaggtggaagagcagaaagatgatgcaaatgcaacgaaggcttcaagcagtacacaagaaacagcagtgactgcaaagatggaagaacaggaagatgatgcaaatgcaacgacggcttcaagcagtacagaagaaacagcagttactgcaaaggtggaactgcaggaagatgatgcaaacgcaacgacggcttcaagcagtacagaagaaacagcagtgactgcaaagattgaacatcaggaggacgatgcaaa

SEQ ID NO: 44717 - DNA, 1131 bp, Heterodera glycines
tgctaattgagcagaagcgtaccaaactttgtagggctttccccggtaaaggactaacttacactgaaatgagcgcccagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgggggaaaaaaagaactttacaaaataatacccctgggaggaaggaagtggggaaccttgaatttcaaaatttttcaattttttctagtctaaatctacctcaacccggttcaaaattcaaataaaattaacattccccgggggaaaaaaaggggtttgaaaagtttattttgaaaaaaagaactttaacaaatataccccctgggaaaagggggggggaaaatggttttcaaatttttcatttttttaaagtcaattaactcaaaaagggtcaaaaattaaaaaaaaaaaatttccggggggaaaaaggggggtttgaaaatttttttggggaaaaaaaaattttaaaaaaaaaaccccccggggaaaagggggggggaaaaaatttttaaaaattttttttt

SEQ ID NO: 44718 - DNA, 1172 bp, Heterodera glycines
gggttttcgcaggcgcggatcacgaatatgacatccatttcgacctatttcgaatcccgaattcggacaaaagtcgaaaattaatttttcaccaaaatttacactttgtccaaaactggattttttcatatttgatagcgggagttgagccagacaattgagaaggatagggatgggacaacagataaattcgatgggaaataggcttaaatcggaactgatcagttcgaatttaactgatgagtcatgattcgccgagatcgtccccatttgcattcctcgttttgctccgattgaataaaagtcccgtgcattctgtgcagtgtgacgggaattaattaaaagtcaacatatttttctcatttatcaatttgagttggtaaacccgttaaatccataattgaaaacacatgaagcacattttttgtatgtttaacgtcaaaacttgcgataaaagttgggagaattccaagaaaaagtggaaaggcataaggtgaagaaattacatttatacgacaaagaattgatattgtctcttttcgtgtccacagttgccccatttctgaacaattttgaaattccccaaaattgcttggcaaaatgcgttttttagcaaaatattttgatcaggcattaggattatccaaaaaatggtggcacacaaaaagtacattcgccaaaaggtgacaaaaacaacggttaggaattgactggctgatgactggggtcacttcctctctttctttgtgtgacacatttttaacgcgccggcattgatcgaacactgacgtgttgcagttgccgctgtttgcctatgctcggccccacaattttcttcgccgtctccccaacccgtcgaactgtgccaattttggtgggattcattgctgccgtcggtttggcaacgccaaaactctcgaaacagtccaattgatagagcaaattgactgactcgtggaccagcaaatgctcctattgtggtaaagacgtaattagagaggaacaatgcctttgctatttttcaaggcatgtagttaaaaatcaaattttgcaaatgtaatttaagacaaaagttgataactgtttagcgtgaaccctcacatcttttgacattttttctttaaatagcttctaagacattttttagtgcttttattggtcgttgttgactg

SEQ ID NO: 44719 - DNA, 822 bp, Heterodera glycines
tcccgacaattgcggcccgacatttgaggccccagccaataaccgacatttgcggcccgacttttgcggccccgacatttgcggcccatttttatgtttttttcgtaaacattaaaataaattttctttttttacaatattaaatgaaacttttttttaatctattaaaaaaataaaaatttttatttaaaaaatgattgtataaaaaatttagaaaactaaaaaaattattaaaaatgggggggggggaaacgagctgctcctccgcgggaacctccccccccccactctcccatctggttaattaattgtttcaaaaatctttaactaattgatttatttttcatgcagaccgtgttccttgccatcactttgggcctcttgcacggcctcgtcttcttgccagtcactttggcactgtgcgtgcgcggtgttttcagcaccacagcaggcgctagtggcggatgcggcgcgccgtccccagcggcagccattcgcttcaacgtgtcgaccgcggcgccagcagcgatgccgcgacgacgcagtgacagcagcagcggcgtcatgtccaacaaatgaatgaccgacaacggactgactgaccgattgattacattttgacatttaaacaattggggctttggcagccgttttttgtgacttccaatgctttttgggtgaccctttttagttcgattttatgtttttgtgtcgtcttcctttttgcgttttttggtcgaactcaaaattcgggttatttcccgagtggatgggttcaaagattttatcatttttgttaatcgcattggacacacaaaagcg

SEQ ID NO: 44720 - DNA, 605 bp, Heterodera glycines
tggcaactcgtacaatatgcaactcgtacacggggcaactcgtacaaaaaaaattctaagaattttcaattaaaacatagaatttttttagataaaaaaaaatctaaatggattttctagcctagaaaaactttttaagacacttaaatttttaaaaaatttaagaaattaaaaaaaaatcagctgaaaaaaatagagctcgacctggacctggatccaagcctggatttttcctggatccaggtccaggtccaggccatttttcggcaacctggatttttcctggacctggatttttgtccaggaaatccaggtccaggtcaaatgtgaaaaaaaatccaggtccaggcaaaacaggaaaaaacctggattttcctggacaaaattttagaatttattttttcaagtgaccgatgttttttcaagttttcaaaaacaaattaaataaatttaaaaacacattattattattaattagatatttttagaggtttataagcaattaattgactttttcaaacctttttttgatttttaaaattagtttcaaaaaatccaggtccaggcctggatccaggtcccgatgagcctggatttttcctgga

SEQ ID NO: 44721 - DNA, 950 bp, Heterodera glycines
cccaactatcctcaaaatcttcatttccttcaaaaaggtggccaatctgtggcaaattccttatttcaccaccatttatttctcccccatttcttcaaaattttcgagacgtcccgaacctgcattaaccattggcgccatcaacgctaagtgttcggccatcctttcttcgtttgctgccggttcaaattcgccaaattcgtgtgggtccacttccaaaagttggtgtctcagctgcgtttcactcaaaatgctgccgtctcctgaaacatcatttaccgggttaatcggttcattcaggtttctcatttcattttgctcagaaacaggaatcattatctctatattttgttgctggttatccggtgcccgaatttggtttccctcgttgttcaaaattattccctgctgtcgagttctctggcgagttaagtgtggcgagcgtgtaatgaccattcgctttcaaccgtcttggttctcgaatttttcacacaaaaatctttggtttaaccgtcttggttctgccgaattcaaaccacttttctcaaccgtcttggttctcgaaaaatgcagcggtgatttagtcgaaaatgttgcagtgaattgtagaattgctttatctcagtctttgagcgaagcgaaggtaatggcgagtgttgttcccagtctttgggctcaaacaacaagaagaagacaatctgtcgctccccagtctttgggcaaaaggaacgagatgaaatgtcgacttcgaattgaagcgacaaaattcctatcccctgttgaaataaaacggcaaaatgagcttactcagttgagtccagaagcgccacgtagaacaaaaattgggcggggatgtgctcgaacgtcttcgactttgtccgagggttgcaattgaccacggtgtaaaaaagacaaaggcacaacgataaagaaaactcctaatcaaaatc

SEQ ID NO: 44722 - DNA, 1304 bp, Heterodera glycines
cccagtcataaaaatttaaaaatatattttaatgaattcgttattatactttaaatagttaattattaaagcataaatttgcttgatttccaatgcttttaccatttatgatgttatggatatttctttttttaattaaaataatttaaatgtgacgtttgatcgatcctcaatgaattttttttggttcaaattatgattaatttttttaaaatttatccggacctgtccggatctgctttatcaagaaaaatcaggattttaatagtccgggttcgttatcaaaactttaatagatctgaagggcaagaatttttgagaattcctcatctcaattgcagataagaggggcatcgccggaaaatttttaagaatatggaatttattgcgatttttttgccctattttggcaataaatgctcaatttttttttgtatttgaaggtaaaagtgttgtatattgcgggaaatatttattcaaaaattaattataattaccctttttcggagattgcccattggttcttgcttccggcgtatttttgttctgttttcctggtgccgctgcttgtctggacggggtcccactattccctgtttaaatataaaaattttaatttaatttcaaataaataaaataaaattataaaaaccatttttattggcacgatttctgtttgctttcctcgtcgtatttttgcccgcggcgcatgcatcatgtattagcaatgcaacgatgcataataatattaatataatgggaattctcatatttttttatgatatatttgggagggatataggatatatttttatggattgtataataaggtttccatgccgtatttatacacacgtttcatatgatttgaatacgcactcctatgtgtgtaaaaataatttccatcgctataactctgctttatacaaccctattattatatacacgcatataaggcattcatcaaagatatacattttacgtgcatataatgaataaatgcaatgcccaaatttgtatgatggcaaaaatgccaccaacaattgaagaaatacattcacatcattggcatatgcctatgattgattctacacttcaatgcaaagtcaataaacgcacgcgataggcgtgaaatatgcatatgccttttataaaaaaaaaacaatcaataaaagtaataaaattgaaataattttttatattataataaaaagaaaaattgtgttttataaccagggctcgcagatctgaggctttagcctcattttgtgggtttttgataggccaatgcggctaaattttca

SEQ ID NO: 44723 - DNA, 859 bp, Heterodera glycines
  misc_feature (796)..(796): n is a, c, g, or t
caaaaaacctttacatgaaaatagcgaaaaagtcgaaatcttgaaattttctcttaataacttttacggaagccaaaaaatctttttgctttttgtatggctaatagagcatgcaaagggctttcgaatgatatccacaattttggatttcgatgacaaaaaaaagatatagaggaaaacatgctgggcccaaccgtgccggcccaactgagcgagtccaacctggacataacatgtccgggcgacgtttcggcggtgacgttttgtccgctcccaaaatttcatgaattttaaatcccttgccctgagctgttgttatcattatcagtggaggagacagcacattgtgtcaaccaatgagaattgtaaccaattaactgaaaatttttgaattttttttcaatttggcattttgttgcattttttaccaaaatgtttggctgcattttgcccagtccgacagtttgcagcagaccttggacaccggcacgaagtgattgatgtgcaacagcagagtaaaagcccttgatgtgctgttcgtacaaccaatcggtgaatctttgtgtaaaaattggtgaaaacagtgatacggatgtaaatttttgcagtaaatctatcaattaaactaattaaattttaatttgtcaatcaaaaaggaaataaatttaatacaaaacggtgcctatcagttaagccggcaccccaaaactccaaaattttcttaagattactaataataatcgcaaaaattgcaatttttggtgaaatatgtttgtcgctataaggcgtagccagngggggggggcggctgagcaggctatagagcccacccgaaatgaaaacaggtatagagaatcag

SEQ ID NO: 44724 - DNA, 1841 bp, Heterodera glycines
aacggacacttgaaaaaatcgattttttttgttttcgttgcagtcccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcggcagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagtctgtactttaattctgcgttggatttttgctccccataaatgtttgagtaccccaaacggacacttgaaaaaatcgattttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgatccttcgggaatagcttccctatagcctgtactttattctgcgtggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcaggaatactgaaaggaagagaaataacctattttaaatattat

SEQ ID NO: 44725 - DNA, 1336 bp, Heterodera glycines
gtagaaaacgttgaaaattataattgaattatttttaatttgaaattattattttttgccaattcaataaaaataatgaacttatttatttttcaatgtaaaataattattaatttaaattaaacatttattcatcaaaaaatttttattttaaaaaatttatttattattaataaaacaaaacaattttaaattaataaaaaccctgaaaataaccctaaaataaatagaaatataatgtgttgccgtccggatttgaacttgcccccacccccctaaaatgatgcctcagaatccccaatcacacggggattctgaggtcttgacgatgtcaaaagtaaaatctgatcacgtattcgtgatcagcatcataaaatagccctaaagacatgtttttggaagatttttggtgaaaaaattttttcaatcaaaaatcctggtcacccccctttggtcccgaatcccaaaatcggttttatttttgtaacaattcgtaagaaagcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaaccatgtgcacccccctttggtccggaatcccaaaatcacttttatttttgtaacttttttcaaaaaggtgataaaaatgtaaaataaaacttataaaatagagcaaaaaattgcgaatttttgtagtattttacttttacagaataactttcccgaagggagttaagattttttttctgaaaattcgaaaatttccaaaatttctggaataacttttttcatattgatgctaaaaatcacaaataaagcccataaaattctcctgatttttctctattttttaggcttaatttcatgaaaattgtaccacagtgaactgatttacgaattttcaaaatttcacccaaaatcccttgggccaaaaaaatgaaaaataatttcgaatttttaaaaaattccaaaaaatctgaaacgtaaaactaacatcatattcgtgctcaggacctcgaaataccccaaaaaaatatttttcacccccattttcaacccaaaaaaaattagaagaggtacaaaagtgattagaacaacagtgatcagaagaggtacaaaagtgattagaagaggtacaatatggtttgaaagtaaataaataaggaaaagtttttattaaaattaaaaatcgaattcatttaaatttaaagaatttttataataaaaattttttagtaattaaaaac

SEQ ID NO: 44726 - DNA, 693 bp, Heterodera glycines
cgtttcccccccgccgtttcccccccgcatcgtttcccccccgaatcgtttcccccccgccgtttcccccccgccgtttcccccccgcatcgtttcccccccgaatcgtttcccccccgccgtttcccccccgaatcgtttcccccccgagaaaattttttaaaaaaaattgctaacttagaaatttttcaagaaaaaaatcttagaaagtttgtttacaagaaaattctaagaaaaaaaattttttgagaaatttttatggtgaattactaagatttttcaaaaaaatttcaaaaaaatcgctaaaaatttctcaaaaatttttttttcttagaattttcttgtaaaaaaactttctaagatttttttcttgaaaaatttctaagttagcaattttttttttaaattttctcgggggggaaacgatgcgggggggaactgattcgggggggaaacggcgggggggaaacggctgggggggaaacggcgggggggaaacggcgggggggaaacggcgggggggggggaaacgagccgccccgggcattgagcgcacttctaccaattgagcttttttgattcccgaaatcgcgctctaaaagatttttatagtcatgaaaagggaattggtgaatattttttgtatatgaatagagagagccctgatttttttagatttttcctattttttac

SEQ ID NO: 44727 - DNA, 1139 bp, Heterodera glycines
cgccgccgggaaaaatttgtgatttttaatgcgatttgtttacatgtttttgtccaaaaatgaccaaaattttcgattttgggctaattttttaagaaaaatagtgactttatgccataaaatttcaaaaaattctcaatcatgagaaaaaaaattacatttttattggcatagtgccataatttaatcaaaatattgttgaaagttacaaaaatttatcaaatttctttgtattttttaaaacttttccaaatgctcattttcaaggacttcttgaattcaaggatacttttaaattttcaagcgggagggcccaatttcaaggacgtccttgccattcaaggacggatacgagccatgagttaaatataatataaaatgctaaaacggggtcaaagaattttccaccaaaccgaaacaatgcttatttgttaataaaagatcacaaaccagcctacgtaaagctaaatttcatatgattaaaaatattatataacttaaaatattaccccgatgcataaaacaacacgaattgaatattaaaatggatcatttattcatatagattttaaagctacttatcaagcttacaggtcatttgaactctgctacatattttaaaaatgcaatattaaaaattgcatagttgatgcatttgtgttaataaaagtttataaaataaataataattaaattaataaatgtaaaaaacaaaaataatttacatcgatgaagataacatgataaaatggctaaaaaaagaaataataatattataagtacatattaatataaattaaaaaaaataaaatctcagattcatagaataattaacaaggtgataaaattaaattaattaaattatacaaaaaggcttaagaaatgttaattaacgaattttaataatatgttatattgaatatcgaaatgtcaacttacttaaaaacgataaaactttacttttaaaaattaagtagcctatgaatgttatgagtaaatgctgattaaaattgagaatagtaatatataaagtaataatataaaaataaataaaatctcacattcagagagaaataattgaagagccgattaaaataaaaatgttaaattatataacttataaaattattttattaaaa

SEQ ID NO: 44728 - DNA, 1375 bp, Heterodera glycines
  misc_feature (1330)..(1330): n is a, c, g, or t
tgcgcagtcacttttgtccaattcatcaccaatttctttgcctctttgttcccaaaattgggaagacaatttttcaccaaaatgcttcgccatgaaagcgtaaaaatgtgcggcattcgaatttttgtgttgttgttgttggtcattttgggaacggaaaatgcgtcagtggaaaatttgtcagcggttaaatcagtcggtcggtaaaaaagtttttttttttttgagaattaagaatatttttttatgattggcaaatctatttttaatggaaattttttttagccttttattgagctttaaataaacacaattataatttttaaaacttaattaaatttgttatctaatttattttaaaaaatcaaaatttttctcagaaaataattcttgtgaatttaatgaataataatgaattcgccaaaaaatatttacttgcttatttttcatttttaaggattttcagcaatacatatcacttaaatatttccactgactaattctccgaattttgaatagaaattctgtcgtttttcatttttattgttgttaaaattatttcgagcgcttcatatacatcataatatgataatttgaattcaaatagccgtaaaatcaatttgaaattttctgaaattaaaaattaaaatcacaaaataatgaaaaatatttggaaaaaattgtttttgttgaaatacgtattcataatagaaatttctgatttcattcacatagtttttttggaactttgtttgatacgttgctacagcataaaccatcaacaaatgaaaatttttgacagaaaaattattcataacttcgcttaaattgaactaaattttaaaatcttggtataattcgattattgtcttaaaattcaaaaaaagtcgttaatttgcacaaaaattatcacctgaggaataccagggtttttagaacattattaatcataattttttgaaaccttatggtttttttttgaaattatgaagactaatagagaacaaataaggctatcgaataatataaaataaaaatttaattccttttgagcgaagttatgattttttatgaataattttaaatttttcatttgctggtttttaaactataatggcattttcaaaaattttaaatatcgctcagaaaataaagtttatatttaataataaaagtgggtaatgctcttgacattaagattggttgctatataattatgctttttatgtggcaaaagccctctaactttgggcgtggcaatttttcaatcaattatggtcaataaatgtttaaaaaaatccataagagacacatagttttaataaagaanaccccaaatatgtataatattgttttgattttcttttttatttca

SEQ ID NO: 44729 - DNA, 493 bp, Heterodera glycines
atcttacgttcaagagccacgatgcttatgaactatcatactcgggcgataagatactcgaaggcgttgtgggaaaattggctacagggcatggcgtgagcatactggtcagcgatttccgtggaagcgatggtactggcttcacgcttaaaaaacgacctcgcctggatgccatcaatgatttagtggatagattaactgttgcggataaagggaaagatacaggaatactggccttgagtctaacgggtgatgattccgttcaaatcagaaaaattttaaacagtattatcaataattatctgcaacagaatgtcgagaggaaatccgaagaagcgggtaaaagcctggaatttcttaaggcacagctaccgcaggttcgacaaaacctcgatttagcagaaaacaaactgaaccaatttcgtcagcagaacgactctgtagatttatctctagaagccaagtctgtattggatacgatggtggcggtgga

SEQ ID NO: 44730 - DNA, 329 bp, Heterodera glycines
aaattgtttaatacacggaaacgaactgaaagtccttctatgcttcaattaaaaatcatttaaaccatttttagactaaaaatgaaaaataaaaaaaattggtacttgtgtgttatctgtgggcagatgttcaaatttttttatgtttttctctataacttttttctttggcatccaaatccaagattggtatcattcgaaagctcttcatatgctttattagccttacaaaaaacgaaatgattttctagcctggaaaaaattttattaagaaaaaacttcataatttcgaccttttctcaataacatgtttttcatgcataactttt

SEQ ID NO: 44731 - DNA, 870 bp, Heterodera glycines
aacatttatgggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcatttttttcaagtgtccgtttggggtactcacacaattatggggagcaaaaatccaacgcagaattatagtacagactatagggaagctattcccgaaggattctgtctccccataaatctgggcgcatctgttcgaggggactgccccgaaaacaaaaaaatctattttttctagtgtgcgtttgtggtactctcacaattatggggagcaaaaatccaatgcagaattacagtacaggctata

SEQ ID NO: 44732 - DNA, 1258 bp, Heterodera glycines
tttttaagtctgaacattttttaattttggaactttcttataaatttttttttagtccaaaacaatgcatcaaaattatttgggctttgctgaaaatttcttgaattccttaaaacttatgaaaaatactaaaagatttccccttattttttctttttctcttacacatattttgcagtcggatgcgtgttattaacaccctctataggggtatgaataattttttccatatataattattccctggggtggtgtgctatttttgtccgtcttctcctgtttttatcgaatttgattcatttttagattgcaaattctgacggaccagttgttgattcggcacgtttggtttgttatgcatggaaggcgccattttttcgcctgactcctcaattgagcaaatttgtggcccttgacacaactgacgattggattttagtggacatgctttgggaggccagggtgggtttttgatggtagtggcagcaaataaattgtccatgtttatcgaaaatcggtatataaatgcctccaccgcgtctaattgtttttttgggagggtgccaaaaaagagtatattgtgcagaatttgacccaagaataaccagattcgtcatttacagcggattaaaactggttaaaattttatattgtttggggatttaaaaaaagaatgtcaagttttttgaattctccttaagaatcacattcatcaaacacattccaaaaaaggagtggatgctttgatcaaattgctgcgaacgaataacgaataaatcagacacgggaaaaaatgcacattgaaatatttatttattattttcaaattatttgttctttttattggtttcttctaccgcgtcaggacgagtcgacaggtgaaaactcagtgaacattggtggaacaattcggccgacagacaactcatttttacgaaaatttagaaagtaatcataaaaattgaaaatcattaatcaataaaattaaataattaaaaatttttaatttaaattaataataaattattaattttctaatttaacaacgtctttcgttaccagcttcgttaaatttcgaaaattaatcgtaagtgaagatgaattgaattagaatttataatgaagctgtaacgaagacaattatcaaattagaaaattaataatttattattaactaaaatttaaaatatttttaaattattttatttatttaattttattgattaatgattttcaacttttatacttattttataaa

SEQ ID NO: 44733 - DNA, 1148 bp, Heterodera glycines
  misc_feature (103)..(103): n is a, c, g, or t
  misc_feature (349)..(349): n is a, c, g, or t
gctcaacagtaataggaatcccaccgcatttctcagaatattacgccgatactaattgttctggaattgtttctctgcgcgtttgtttggaaaaattgggaanaatggctatctctttttctgctcaacagtaataggaattccaccgcatttctcagaataattacgccgatactaattgttctggaatttgtttctcggcgcgtttgtttgggaaaaatttggaaaaattggctatctctttttctgctcaacagtaataggaattccaaccgcattctcagaataattacgccgatactaattgttctggaatttgtttctcggcgcgtttgtttgggaaaaattnggaaaattggctatctctttttctgctcaacagtaataggaattccaaccgcattctcagaataattacgccgatactaattgttctggaatttgtttctcggcgcgtttgtttgggaaaaatttggaaaattggcattatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattggtctggaatttgtttctcggcgcggttgtttgggaaaaattttgaaaattggctatctctttttctgctccacagtaataagaattcca

SEQ ID NO: 44734 - DNA, 933 bp, Heterodera glycines
ccagaggatttttatatttagaggttatcccagaacccccctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgatagattttatacacatacaaatgctctcgagcatgatagggagggcggtgcgcaatagaccttttatttctgagggaatttttatatttatactctatcccagaaaaatggctatctc

SEQ ID NO: 44735 - DNA, 910 bp, Heterodera glycines
taaaaagagatagcatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaattgtcctaaaaagagatagccatttttctg

SEQ ID NO: 44736 - DNA, 867 bp, Heterodera glycines
aataagcgttaatttattttaatgatatgggttgaaaaaggttaaaattggttgattctattccttttagtatccctgtaaagtttgatgtgtttctgatcattcatcgaaaaattatgcggacaaaaaaaattaatgaattaatttaaaaaaaaaaaaattaaaataatggaaaactcagaatttcaaaaaatttttttaaaaccaataatcgttgaaatattttcaagttaagttagtcctgtaccggggagtatgcctataaaattttgtgcgattttattaattataaaaagagttgtttttcgaataaattttttaatttcatgaaaaaaatttgaaatgttttttattaaaaatttttcgaaaaaacttattaatttatcatcaaatttcaaaaaaaaaatcgctgaaaattttcaaaaatttttttctttatgttttcttataaaaaaaatttctgttttttcttgaaaaatttgtttgaatttttttttttaatttctgcggcgcggtttgtacgtccccgcttccccctccccgccctcctctcaaaatttaaaaaaactaaatttttttacaaattttttttttttgaaaaatctctgtcacccccccccccccccccaggaacagtattcacacatcgatcatgttccaggcgcatttcttcacattctccaacggttcgtcgccattttcaccaccaaacggggacagaccggacagcaaaatgaacgccagcacaccaacactccacatgtccgagtaaaagctgacgtacttgccgagcaccacctcgggcgacgcaaattcagccgttccttacgggagaaaaaaaataaataaataaattttctatttttt

SEQ ID NO: 44737 - DNA, 1611 bp, Heterodera glycines
  misc_feature (1167)..(1167): n is a, c, g, or t
  misc_feature (1176)..(1176): n is a, c, g, or t
  misc_feature (1184)..(1184): n is a, c, g, or t
  misc_feature (1201)..(1201): n is a, c, g, or t
  misc_feature (1214)..(1214): n is a, c, g, or t
  misc_feature (1217)..(1217): n is a, c, g, or t
  misc_feature (1222)..(1222): n is a, c, g, or t
  misc_feature (1234)..(1234): n is a, c, g, or t
  misc_feature (1260)..(1260): n is a, c, g, or t
  misc_feature (1283)..(1284): n is a, c, g, or t
  misc_feature (1294)..(1294): n is a, c, g, or t
  misc_feature (1312)..(1312): n is a, c, g, or t
  misc_feature (1316)..(1316): n is a, c, g, or t
  misc_feature (1320)..(1320): n is a, c, g, or t
  misc_feature (1324)..(1325): n is a, c, g, or t
  misc_feature (1339)..(1339): n is a, c, g, or t
  misc_feature (1345)..(1345): n is a, c, g, or t
  misc_feature (1361)..(1361): n is a, c, g, or t
  misc_feature (1379)..(1379): n is a, c, g, or t
  misc_feature (1386)..(1386): n is a, c, g, or t
  misc_feature (1402)..(1402): n is a, c, g, or t
  misc_feature (1412)..(1412): n is a, c, g, or t
  misc_feature (1417)..(1417): n is a, c, g, or t
  misc_feature (1439)..(1439): n is a, c, g, or t
  misc_feature (1446)..(1446): n is a, c, g, or t
  misc_feature (1461)..(1461): n is a, c, g, or t
  misc_feature (1466)..(1467): n is a, c, g, or t
  misc_feature (1473)..(1475): n is a, c, g, or t
  misc_feature (1478)..(1481): n is a, c, g, or t
  misc_feature (1484)..(1484): n is a, c, g, or t
  misc_feature (1487)..(1487): n is a, c, g, or t
  misc_feature (1490)..(1491): n is a, c, g, or t
  misc_feature (1496)..(1496): n is a, c, g, or t
  misc_feature (1499)..(1499): n is a, c, g, or t
  misc_feature (1510)..(1510): n is a, c, g, or t
  misc_feature (1522)..(1523): n is a, c, g, or t
  misc_feature (1538)..(1538): n is a, c, g, or t
  misc_feature (1545)..(1545): n is a, c, g, or t
  misc_feature (1554)..(1554): n is a, c, g, or t
  misc_feature (1560)..(1560): n is a, c, g, or t
aggaaattaaaaggcacaaagaaataagaaatatgattctctaattgatacacattcagctgcggactgggaagcggacaccgttcagtgaaagagcaaaaaaaaaaaaaatgaaatgccaaatttggaggacctttgcctgaggggagttgtgaagtgtactttcggcacaaggaaaagagtgccaactcagtacagcggggcggacaacacagtacaggtgccgaaaaaggaggacgattgatgacgaattccctgaccctgcaggcattgatgttagccgagaaaagcctccgcgaggggcccgaaagtcgcgcggcgggcaaagcctatcacataatggacggggaagggccggtgccgtgccgggggaggggggtgattagctgtcatttgccattcttaggtggactccttccgcttttggtaccctctgatcaccgccattggctgtcccgtgccatccgtgcgcatttccttcacttttgcctatactttgggcatttttttcgagttcatctacaaattggtcgggtgggagccgtttttcacgcgatacgaagtgccattggaagggagggattgttgaccgttaaccttccctttcgcttaattcggcaggtggcactgatgggcgtgccgaacacttattccattgaaagggcacgccgcgacttaaactattcgccaattccgtcttctgacaaatggcacgcaccatcgaatttctgaagcagcagctgaaagacaacggcacaaccgccaattgggcacaaagcaaaagcattggcggacaatggctgcgcgatcggaaatggcttttcatggcctatttggtcgaagaggcggaacgaggcaaggaaaaccaatagaaattgatcatttcattttttaatcattcaatttttgatattttcgtctgatcagttaataattcatttcccatttctctttagcttttcgtcctttcaaatggtcattagctttggttgttctgctgctgcttctgctattgttcaccatttttttcaaatgttttctctttgcgccgttttcattgaattgtccaatggcattttagtcgatggcattttcaaagtcaaataatcaattggttgatcaaccaatcaatcaatcatcaatcactaatcattctaatcgtggccnactcaactnatcggagnatctctttctttctcancttttttaaattnctncttantttaacatttcncactaaattttaaataaataattttnatcattttttttattaatcattnntacctttatnaaataattacacaaaaantccntccntccnncacctcccccctcncccccnccccccaatcaatganttaatcacttcccattcnttaattncccaaattaaattacntctaaaaggnccttntcctttctttcttcaccaatcnttcattnctacaaaaatcaatnttctnntttttnnnatnnnnatnttnttnnttttnttntttctcccctncctttttccttnnctcttaaaagttttnctccctntttcctttncctccntcctctcctagaagaataagaaactcattcccctcaaaagacggctgaggg

SEQ ID NO: 44738 - DNA, 862 bp, Heterodera glycines
caaaaaaacccccctattttttcatcagattgccctaatgggcgctgtggtcggtcctgtcgatttacaccaaatggcattcccgcgccggcgcattttcgtcttccaacttggctacttcgagttcgaacagatcgctgatcagaagcccgacctggtggactacgggccgtggatggccgacatggacattcaggtgagccaaattgcacattttctaacagttttaaagtgggacaaatccagaaaatttttaagcgcattttactagggggtttgggcaaaacattttttaaatttttttttgaaaccccttcacaaccgaaatttttgttggaaataatatttttgatcaaatttttctatttcacattactgctacgcactcaaacagtgtttgttatcaccaaaatttcccaaaaaattttgcaaaatttttcctcacatccaccaaattaccaaatttttttttgtgtgaaatctattaaaaaatatgcccaagaatttcagaggcagtacccctctcgaaaaccaagccggaattctgggaccgtcccaactttttacgcttttcctctatcctttcgaaaaaaatatttaccaaaaattttcagacaaaaaagtcctcaatttttggattggaatttttttaaaaaaaaaaaaactttttcaaagcaacaccaaatatggccgttaaatgtttgttttctcatctttttttgctcaatttttataaaatttatggtaaaaatgtgattttcattctcagggtttgccgttgccttcggacgaattcattgagcaaaaggcgcaaatgctccaatcattttttggccgactcggcataccaacaacaacattt

SEQ ID NO: 44739 - DNA, 997 bp, Heterodera glycines
tacaaatgttccgagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggcatctcttttttgcgagaaattttgtaccatacaaatgttcccagcatgggcagaggggcgcggagagcaatggctattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatcacatttttgcgagaaattttgtaccatacaaatgttcccaacatgtgcagacgggcgcgaagagcaatggccattctattctacagggaaattctacatgtattctctatgccagaacaatgtctctc

SEQ ID NO: 44740 - DNA, 857 bp, Heterodera glycines
aggattttcatttaaaaaatgataaaatatgtatcaatttataaaaaaaactatgaggaatcatattttctctataggaaacccacgagtatacaaaaataaaaaattgaaaataatctaatttatgtagagggattgaaccaggggaaagaagaagggaaagtcaaggagactagccattaggccatttgcacacttgggtactgttacttttaaagaatatattaattattattttttatttttccctttgactccaattttcttcactaatttttcactcagaccccattcttaccagtgcttgtttttcccggttcccggttgccctaccgggaccgggacctgagcttttcaaaacccgggaccgggaaccgggaccgggacctcggatgaccgggaattcccggcccggtcccggtcccgtggcactctacttaaatataaaaaagttatggttatttaaatccacaaccttaagtctgaatttttgtccagaacttttttgaaactcaattaaattttttgaaattatattggtaaaagaaaattttatcttattgcttctggaaaaaagttataaagcattaaacagactatgttttttgccacagtcatgcgaatataattataaacatttaaaatttcaagtaataaaatgcaattgagccaaaattaatttatatattcgatagcgcttagaattctctatttacctttaaaatttcagaaaatttcattgattttgaaaaaagttatggacaaaaaattccgacttaatattttgtggaattttggctccataacttttttataatttcatataaaaattttctaaattaatattctgatagaca

SEQ ID NO: 44741 - DNA, 1123 bp, Heterodera glycines
  misc_feature (8)..(8): n is a, c, g, or t
  misc_feature (130)..(130): n is a, c, g, or t
taacccgnatgctaatccgttccgcagagcctcttcaaaattttttccattaccgcaagagctgcggaaatgtgaataattctcagaaaaatggccatctctttttaggacaatattctatctcgtaacnccgatgctaatacgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccccaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgtaagagctgcggaaattgtgaattaattctcagaaaaatggccatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccggagagcctcttcaaaattttttccattaccgcaagagctgcggaaattgtgaattaattctcaaaaaaatggctatctttttttaagaaaattttctatctcgtaaccccgatgctaatccgttccggagagcctcttcaaaattttttccattaccctaagagctgcggaaattgtgaattatttctcaaaaaaatggctatctcttttta

SEQ ID NO: 44742 - DNA, 1208 bp, Heterodera glycines
atatttatgtagataaacatcatgtcgaacagttcttttgtgtttttgcctagtaatgtgagtgattaccctgacaatcagccgaataaattccgtgttcggcttccaaaacctttacattttaacggctcgtgggtgtgcggactgcacagtatcagttacccctactcatggtcaaccattggcacattggatgagcaatggattgacattcacttcaccgaccgcagagcgaccgatgaggacagacagcgagtgatcagagtgccggtgcctaaggcatcgcatagtcgggttgagcagttgagagaatttttgtctgtcactttgaggaatcatagcggtgcaaaactacaacctctccctcgtgaggtggaagagaatcggaatcgtacaacaacaaagcctctcggctcgccaccgcctttgaaaagacagaaaagagatacggtgtttgacgcgaatagaaaacagattgcccctcctccattgcataatgatggcgagaagaaattattgcccctccaccaccgcatcatgaaaatgatgacgatgaagaaattattgaggagtcaccacctcatcatgaagaagatgatgaagggccgattgaggagtctccgccgcattacgatgaagagcaaaatgatacagtaacagctcctgtcacaccaaaagtgccggtaccagcacctgtcacaagccctgcgaaaccaacaacagtaaaaacaccagctactccatctgtaacaacaccagcgcctcccacaactgcaaagctgccagtaaccgtcccttctccaaccacaaaaccaataacaccgacccctcctcctacaacaaccacacctacttcaaccacaaagttaacaaccggccctccacctaccacaaccacacctactccaaccacaaagtcaacaaccagccctccacctaccacaaccgtccctccagcaatcacaaagccatcaaccggccctccacctaccacaaccgtccctccaccaatcacaaagccatcaaccggccctccatcaacagaaaagccaataacaacggtgcctgcaccgccaaagacaacaacaacaagtacgccagcaatacgtgcagttcctagcccatctgttaagccgacgattccggtaccgccggcgcaactaaaaagctcggcactgtctccaaaatcaacaacccccatttctact

SEQ ID NO: 44743 - DNA, 271 bp, Heterodera glycines
cggacatctaatttttgaattgaaaaaaattgctctcaacttcctttttctccatattgaccatcatactcatactccccccacccttttcttcttccgccacccacctcccccgctacgcgccgctcccctccccttcgtgctcctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 44744 - DNA, 967 bp, Heterodera glycines
  misc_feature (895)..(895): n is a, c, g, or t
cccatttaatcggcaattagatcaattaacccttattattccttttattggcacacaaacatcaccttttccttctcagctgaccgtcacttcgttgtcccaatgcggtgccgttcgcacccctgcgggcggtgcgcggacgcccacgtcaccgaagaatgcccctggcattgctgaggaaggactcgtcgtgcgcacggtgcaactgacgcggcaccacagcgaatgtgttgacgaagcggaagagggggaggaggaggaggggagacgcgaggaggtcgcgcgagggagaggggatgattagacattaattgatggaaaggggagcaattaagcactaatgaatcgggggaggggcggggtgggaatggatgatgaattcagcaaaagagacggcaaaattaaggggattcattaggcctatgaagctcctcattaagggggaggggagattagggcattcattagcggacaattagccaaattggccctttgaagaggcgacttacggcggagcatcgcgcgatgagtgcggaagagcagagggaattgtacaacgacggaccgccgacaacgacgacggccagcggcggcgcgtcctttgaggaggtggacgaggcggcggcgtcggacgacggcgacgacgcgcggcaccgcccccagcgaatggccacgcgccgaagcgcccctccggcaattcatatcgcatgacaatggatgaagaggctaatctgttgttttttgttggattgctcgccgattcatccgccggtaaaaaaaacatttgccgaaaagaatgccaaaacattggccattcaattcaatcacttcccttttcattcattgtgacagatttcctacttcatttttcatttctgatattgctcattgtctntaattaatcgctttaaagttggtatttggccattttggcacttttttcaattgttcgtttttttgtctgttt

SEQ ID NO: 44745 - DNA, 1354 bp, Heterodera glycines
ttttcccaaattagtcttttttttttccatctttccatttccctccttttcttccccccccccccctccaccgtattcctttttcggctaaaagtgcgttttttcttctatcatttttttcctattctctgtgaaacttaacaaaatggtcaaaaaaggaatttgatcagattaaatatgccattttgcataaactccctttggatgaatcagcagagacaaatttacatagaaagggattaatgaaatagattttcttttggaatcgatggaggggcggcggatcagcagagagtgaaaagaaacgacgcaaaagggggaaataatttaaatcaaaagtgacagacattggaggcgcattaactggccacaattggcaattaaaatgcaaaatgggccactcgaagatgcattggaaacagaggacctgaaaagttgacaaaaaagaatataaatatgcacaaaatgagaatattttaaaaaaataagaaataatttggacaattaattgtgccattctctgcgctttatttatgagtccatgtaaataaattgtcgcttcatctgttaattgctattaatatgtatttgcatgttcgtaaattgttttctctctggtcctctttcaatgcttctccgccccgttgctgtcctttttgcttagcatcggcaccggcgcgtcgtaagggggcggtcttcgctgctccagggaatttgtctgtgcttggtaatcgcgccttgggggaaaataaaactgaaaaaggtgattagttatattggacaccaaagagtggagatcagttgagaagtgaccaagtcgccattgttaagcgcaatcagccgaatcagcaaaaggccgtcgggtcgcaaagttcgaccgatgaaatcgcgaatttgggctttgcgggaaagcccaagccgagaagagctggggtcgatctgaactcaaaaagatggatcagaagccggaagtggacaatttgccctgtcgaggtaactgctgatcagctgaaaattgcttctggcgttgaacacccgcagaagccattgaaaacagttcaaaatgctgaacagagcgacaaaacaaaaccaaaaccagaagaaaatgaagattttttcgttgaactaaatgaaataaagtgatcgatagagaaagaaaaatgatggtagagaaaaagaaaagcaatcgatctagtggacaacaaagtgatcgatcgattaaacaggatggcagagaaaaagagagagaaaaacgatagtgatcgatcggggaaatggaatgatgacgtagaaaaagaaaaaaggtcgatcgcggagaaattgacggatgacagagaaactattaccgtttgaa

SEQ ID NO: 44746 - DNA, 1000 bp, Heterodera glycines
tttaaagcctaattagcagaatgtgaaatcttctcatttgtttctttatgatcattttgtttaattcgcaaaatccagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatcctttcggaacactgatgctgtttatatatagagcgtaatgagctgaaaatgtcagaattcaaaaag

SEQ ID NO: 44747 - DNA, 1122 bp, Heterodera glycines
  misc_feature (1045)..(1045): n is a, c, g, or t
  misc_feature (1060)..(1060): n is a, c, g, or t
  misc_feature (1076)..(1076): n is a, c, g, or t
  misc_feature (1088)..(1088): n is a, c, g, or t
agcaggtgtcatttcgcgttcttcagcagtcccactgatgctggtggtgtggtgacagagctggcaattcttctgccggaactgatggctgtcgcggagcaaatggccgtcgaaaacaccgggcggaagcagcagcagcaagagggcaccgcccattttggtccgtcgtcgttcgcgtctccgtggcggtggcttcggcgctggtggcccctctgctggcatcagtgcgtcctcaattctttccgccgggcgcactccctccgcgggtgacgacggcatggacaacggcggtgagccgaagcggcagcccgacctgttcagcttcttcgaccaatgaacgtcttggccacgatgtgaatgtgtgggggctataaacgatggaacgactttctctgatcagtgatcacttaccccatcttttgctgtttcttttgtccaaatgacttttttattactgtttctccttaaagcgatgaccatttcccattttggattaacccaaatgatcacattgacttgattgatgatgataccctttctctgctgctgatgtccatttatttatacttttttccatttttggccctttttcttcaccaatgcgatgaatcagcgcctttctgtcaattgtctcgatcaatctttctttcttcctccccttctgttgtgctttctttctttcccataccctcgagagtgcttcgttctctaatttttttgtcccttcctctgctcttgaggttgcgcaattccaatccataaaatataagtacctatatgcttacacaacaccgaccattcccttccgcctgtccttgacttttaaggattccaataaaaatgtaaaagcactttttaacaaaataaataccagattgccaatttatgcactaattttttgatttgtaaaatttccaattttctctatgtccccttcggctttgttcgtttgttttggcactcggcagaaaggaggacgcaaaatgccgtgcacaaattgtatggcggaatacacacgacgcagaaaagaagtgggagaactttngtatgatccaaatgngaaaaaatgccacccnaatcagatcggntgtgcccgtcgtcgtttcggcttttgcgagcgat

SEQ ID NO: 44748 - DNA, 1186 bp, Heterodera glycines
  misc_feature (1133)..(1133): n is a, c, g, or t
cttcgccttgcccaaatgcgtgacaaaagccgcgacgttaagttgcgccgccgtttgattgccgacatggcaccgctccgcgcatctccgctccgcgcatctctgccccgctgctgctcactgcccgcactgttggcgttgtttttcggcacgtctccgttcgtattccccgctttggtctctgccgctttgccaccgtttgctttacttgggtccaacatcgatttcgactcgtccccactgccattcgattcgtccgaagtgtcgcccgtggtatcccgtggcgccaaaggggcgagtctgacaataaagaaaatgcgaattgcacattttgccaactttgcacacaaatgcttttgcaaaatgttcacctgtcctgcgattcgtagatcatttcgctgggccgttcacttgtcaaattttggctcgcctcggaccttcaaaaaatgcaattgattagaaagcactcactgatcgatcggcttaaaagtgcttcacctgtcctccaacaaacattggtcttcactgcgtctgcgcgcaaaatcggctgacaatttgatgttggcaacatccaaattgccacagctcccattgatttgcgcatagacacttggagatgagttacaattgatgcttattggcacagtgcgcggcgggtccatgctgaaacggtgccttaaaattgcacatgttattggcgaatcaagcgaaaacggcacacatttccaaatggtgtttttcgcgcaattgagcagtccgagaaatgaacaatcttggcagtttcaatcttgagcagggcgaatttttgtcgttcagtccgttggttgccgttttttccgccttctttttgtttgcattttcagcgaccttaaaagtcaggtaatttttttccagaaatattccccctttacccacctgaaccattccaccatatgtcgatttggtggcattcattgcggccttataaatgcggacgtacacaaaaatgactatcacatatggaacgtagaagctggaggaggcactgaacagaatgtagtacatgccggaatttggacggcgtgcagcggcacgcgttcggattctgcagcacaaactgttgggcactgggtggtgccgttgcgttccatctngtctttcatgtaactcttccgtttgctggacgctaccagaaagcttggcgagc

SEQ ID NO: 44749 - DNA, 964 bp, Heterodera glycines
ttttagaggttctctcaggtcctttatcccactttctcctttctccgttccttctggcatcacattccgcctccctcggaagaccggtccctcgggctctccttggcccttcaccgacggacttggacactccttggtccagtggtcccggaagtgttgaagggatccacccaggagcgccatgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacatgttaaaattttattatttttttaattcatttttattaatattgattcttctaaattcttttcgatttatttatttaatagaaaggttaatcaatttttttcatttaaaataattatttataaaataaatttaaaatatagatcattttaaaagagagcagcagcaaacgattccagctcatatatatatatatatatatatatatatatatatatatatatatatatatatatatatatatatatatatatatatatatatatatatatatatatatatgtgtgttaatagctgaaaataatatatataaaaattataattaattaataaaaaactaatttacgaattgtttgaatattttttctttgcttaatagcagaaaaaataattatttaaaaattatttgaaggcataattttttcaatttataatacaacataatgaaaaaatttataattcgagttgtatttgcacatggtaaaaaaataaaattaaataattggcttatttctacttttaaatatgcacaaataaacacattgaattttacttgcatatatttgaataattgtttaatacacttcttcatttctgatcagttaattaaaataatacaatgagt

SEQ ID NO: 44750 - DNA, 829 bp, Heterodera glycines
ctatcatgctcgagagcatttgtatgtgtataaatttatcaaaaaaagagatagccatttttctgagatagagtataaatataaaaatcctctgtaaaataaaatggcgattgtgcacagccctccgtctcatgcgcaagagcatttgtaagtgtataaaattatcaaaaaaagagatagccatttttctgggatagagtataaatataaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatataaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggata

SEQ ID NO: 44751 - DNA, 1357 bp, Heterodera glycines
gctcggggccccttacgtggatcagttgtcttagccactagaccacatccacccactgagggaagactgttgtttggggtcattttccttcattatggcccctgttgcttttgctcccacagcactttgagctcccacagctattttcgatcagccattacaaccagttcagtcactccggaactaagccacttatcatattgactgtttcgatcgttggatggaatttttattaacttatagcattattggtgcaaaatctgttattaaattgtacaaaaattccaatttttttctggctgtgcctatcagtagcgcctgaacctttatggcaaccctggtttagtcggtataacggcttatacagacagttgtcccaaaaatgaatataccaaagcaatattgctgttgaacgttcgttatcacttcattggaagtgcaaattaagtcacggaaaatgaggtgacctgaatcacatttttgtattttttatgagcataatttttttaatattttgtaaaaaacaatagaaattaaatgacccggaatttaagaaacaccataatatggatgaataaaattttgcaaaaaatgaatcatccgaattttggaaaatctaatttcgtaccaatgaaaggggcggaaaatgagcgttggaggacagcagacaaatgcattttttgaagcgacttttgtctttaaaaattggagcaaatgacaaagcccatgatgaaattgattttaactgactaaggagtatattcgcggatatggtttaatttttatgataaatatctgaattttttgatcagttagaattagaattttaattaatggcgaaacagtttttatttatattattattattattataaaattattaatttcgatcattcagtagagagaaaaaattcactttacaatttaattgatatagtgatcctgtcaatattttaccattaatgtaaatttataaggaagagaaaaattcatttttgagaaatatttttattattatttatttctttttttcatatcgaataaattataaattttaatttttaataaaaagaaaaattgtcaacaatgaaattatgcctattttcaattttaattgcctttttaattgctcaaattgaaattgtagcggaaaagaaaaaattggaacaaaaaacatttgaagaaatatttggagaaaaatgggaagaaaaagaaaatgaacagaaaaaaagagaaattgttcaaaaattcaacaaaattaaagaaaggatcaaacaaaaaggaagaaaatattcagcaaaagaatggaaaaaaataaagagaaaatagcgaaaaaattggcacaaatcgaaagaaa

SEQ ID NO: 44752 - DNA, 1341 bp, Heterodera glycines
  misc_feature (1215)..(1215): n is a, c, g, or t
aactcagcgccgggccatttgctgcagcattcgccgtcgatttcttcgccggatgaaagcaaagcttcaacctcagcggtagaaacacggcgcagcaaacccacgcgaaagaatggcggagagcaatttatgggtaataaaaatttaaattttgtaaaattcagtgggtgttttaaatttaaatatccctcgatctaccgtcgcctgatcaattccgaaattcaaatttggcatgttggcattttgcccccgtatcgctgaacaatctcttcgatttcagaatttggcacaaaatttaaatttttttttttggcactttaccatcccaatggaatgaatgcctttgaaattttaagcataggaaactgtttaaataaatttaaatttggcacaaaaattgtgacaaataatttcttggcattttgcccagaggaacaccgtattccgctggaggccatttcctcctgtatgctgcgcaagcacaaaaacaacagaaagccgcgcaccccattctccacccaacaactgatggcattggagcgcaaatttgtggacaaaaaatatttgtccatcgccgacagagcggaattttcgtcaaagcttaaactgacggaacagcaagtgaaaatttggtttcaggtgggcttggcaaatgggaaatttttttttaaatatttttaaatgaaattttaaatatttttttaatttttaaaatttaatttggaaattaaaaattcattttgttaaatgagaatatttttattatttgttcaattttctcaatagtttttatttaaatgattttaaattcgcttaattttcgtcccaaatttttttcaaattgccacaaaattcgtaaaaaattttttaaatcaattttttgattattatttctttataatcatcttcttacattttttgcgatttgttttttttctgatcttttggcattttaaagctttttccaacccttcggcggttggacagaaaaattttctaccaattttaaatttcaacgatttttctctgttttggccaagcctttgctcaaattttgaaaatattgctgtgttgtgtgtgtgccgtaataagcataattttatgtgccgaaatggccccaaatggccaacaactcgtaaattttacggcatttcccttccccctcctccgccggggggatttgtgccgagaagcccatccgattaattaccattnttatcgccgctccccccgggggttttccccttttttaccgtagccccccccccctcacttaaatataataataataaatttatttcacaccaccaccatcaagcagtagcagcagctgcagcagct

SEQ ID NO: 44753 - DNA, 953 bp, Heterodera glycines
atttgatcttccttcacggttttaattttaaaaaccccccccaccctccttttttaatggaatgagaccttatgttaaagtatatttaaagttatttctcccaaattacatacataacattaattgtgtcattctttctgtatttacatgttggtagttgcaaattttccggcacgtttaaaacaataacaaattattcatttattttcctgttttttcatacgctatcataattttataaccacatatttttcacctgtttctttaacttcttttcacctgtttttcacttcttttcacctgtttttcaaccgttttcacctgttttcaaacacacacgcacacacacacacgcgcacacacgcacacacgtacgcctgtacgcacgaataaggttttttaatcgatatgatggaaggaatggaaattttgggcgaaaagcgcggcaggggaggaggagggattggatgctggagggagggcgggaaattcggtcatatttaagttgttttttctgtctttctatctttatatttttcgcgtatttcatttatttagttttcatctctaagaatttttttgattcgctgtcaaatgcgatatattacaatttttcatttgtttcattgtttttagacctaccaccttttctcgtatattttttcattttttcgttttattcatctgtttgacacatgttatgaccttttttctacgaaattttcagatgggttttgacctttttttcgcaaatactttttcaaatgttttaatcgatgagcatggttaacaaatacgttcacaaaagaaaaaaatattttgtgaaatattatattaattttttgtaataataacaaaagagttgaggagagaaaaattggccaataggagagaaaataggcctaacaattcagtttttcgcacaatccaatcaaaaaacatgaaaatacacc

SEQ ID NO: 44754 - DNA, 862 bp, Heterodera glycines
ccccccccccatttcccccggcgttttttgatcggtgcccatttttctttgctcttcgccaccatggcatattgtctcttcctcacttcctacaaattgaatacttttcaaaataacctgtttggccccttcgcccttttatttttccctcccctcaaatttcaatgcccaaattcttttcactttcactgctctcgacagtaatcgatgaatgattggtatacccccctttcccccgcaattttgcccattttcgcgcagttcgcttccctttgaggcaatgattattcatccatttcccactatcctttccattcgttcctttctctattttacggccacatttgctccgttgaattgtatcacaacacaaacccaccccatcccttcgtcggttacgtttcccccccccccccttttccccttccgccgccgtccaaacgtcgcgtcgtcagtttgtcaaccaacacctctcatcacccatcatttcaccccctttctcatccgctccatccctcctctctttactcccctattccccttccatttgctctttctttcctcttccttttcctcttccatttgctcttccttttcctcttccatttgctcttccttttcctcttccatttgctctttctttcctcttcctttttctcttcctcttccttttccatttgctcttccttttcctcttccttttcctcttccatttgctcttccttttccttttccattgctctttcttttttctcttcctcttccatttcctctttctttaatcttcctttttctcttcctcttccttttcctcttccatgaggcttccttttcctttccgtttggtctttctttttctctt

SEQ ID NO: 44755 - DNA, 1481 bp, Heterodera glycines
cggtaatcagtgttctctgatcaactttgctgtttagccttattataccacgcaacagcagtgctgatggtcgagagtctcggtctcggggttctcgctctcgggttccggattttggtctcgggcctcggggttttcagtctcgggtcttggggttttcattctcaaactcgaggatgaagcttaatttcggggtcaagtctcggtttcgagagtgtcgggaaattttcggtctcgaactcactaatcagcacccaccaccacccgactaaaaagcgaccgaccgatgctcgagagtcttgagagagggtttggggtttgcgtgtgtgttgttgtgttgcccccccccgcccctcggtggggcgggaggagggggcgggaaggccaagatacctctccccccgtcggcgctctcaaattttcccatttcttcgttttcgtcccatccttccgtctcccatcattttggtcccctaacagaccatcatcatcatatatatcaccaccatcagcagagtcatcagtcatcattccatccgcgattatacgaaatttctcacttctattcgaattctgaattgtacatccatttggtttgaagccgacctcgaattcatagacccaaaaaaaaccttaaaattttacggatttcccaaaatggcttaattgttgatccatcatcctatattacctatctataaaataccaatttttcaatttatttacacttttttttcagctttcatggcctcatctttcatatatcgcggaagacacaaaggcaaaaataaattaattaaaatttttcatttattttgccaaaaattttcagggcaatattgttggctatgttttggacaaaatggaagaagaaatggaagacgacgagccccatggacacatcacttcgttggctgtcaagcgtacctttcgttgactcgtcttggcccaaaaatttatgaaccaaacggcacggtcgatggtagaagtgtaagtgtgcgaattcaagcattagtgtaattattcacctaattcaatggaagtgcagaagaattaaaattccaataagaattaaattttaaaaaaatattaaaattttactgtaaaatctaaataatttaaatagccgtttttcaataaaaattaataatttttaatggaattaattaatgagcattgaattcaaaattttattttcttcatttaataaaataatcttttatgaaataaatttttaattttgagagtaatatttaaaaataagtaaatttaaaaattaaattaaattatttagtctctcagaaatgaaaatatatcaacaaaagtttgttcgttcagagtgagctaggaattcatcacagagacctcaataggaattgaaccaagctcaatgtcaaaattgacaaagtaacgtaccactaaaccaaaaatcgtttgcgaatcacaaacaatttttccctttaataaaaaagatatttatt

SEQ ID NO: 44756 - DNA, 1758 bp, Heterodera glycines
  misc_feature (1727)..(1727): n is a, c, g, or t
  misc_feature (1737)..(1737): n is a, c, g, or t
ttgagcgcggcagagacgggcggaaagcggagagtgatgccgagagaagagagaacgacggaggtaaacttaagatagacagggggcgaaagggaaaaagagtgagggaaaagcggagagtgagccgagagaagagagaacgacggaggtaaacttaagatagacagggggcgaaagggaaaaagagtgagggaaaagcggagagtgagccgagagaagagacagggaaagggaacgatgggaaaagcattcatagaaacaaaacctcgtggacgcgcacagtgaccaaaaccctcaaaagtggtcgagactcgagcttgataggtttgccccttcccacctgaactcctcgtcctcccccacttccgcttggtccgtcctcacgtcggcccatccgattgtctcttccgttcggtaattttccgcctcgtcgttcgtttcaacttttacgaaaattcggcgtaaaacatcgctgaacagagagaatggattttcggcaccaaacttaaaaagaaaagttttgtcggcgtttgcgttggtcaacggaatgacctgacgagcaacggatttgacccggtccgcacttctgaccaactccctccacttggccaactccttcgcgccctcgccctcctccaattcctcggcctctcttccgctcaccaaatttaccgctcggttccatttagccactaattgttccgtcattccgcttgtttctttgccttcaatcattggcccttgggacgaattgtcagcgatggaagcgacgaaattgtcgaaaaggacgggagaaaaaagtggaagcaaagaagaagaagggaagaccaacttgaacggaagtgaggggaaaagaggaggacaaagagggaaaaagggacagagagagagggaaggaaacatggagtgagacggaaggggaagaaggttagaaaggaacgtagggacaagtagatagagggaaaggggactgagagagaggaggacaggcgagaggggaagagaaatatggaggagggagaggagaagcgggggagggacggaaatataagagagacggaaggggaagagagttagagagggacgtagggacaagtagatagagggaaaggggactgagagagaggaggacaggcgagaggggaagagaaatatggaggagggagaggagaagcgggggagggacggaaatataagagagacggaaggggaagagagttagagagggacgtagggacaagtagatagagggaaaggggactgagagagaggaggacaggcgagaggggaagagaaatatggaggagggagaggagaagcgggggagggacggaaatataagagagacggaaggggaagagagttagagagggacgtaggaaaaaggagatagagggaaaggggaacgagagagaaaagggagaggaaatatggagggagacggagagggagagagggacgtatggatgggagacgagagagagaggaggacaggcgagagggggggggggaatatgaagagaaaggagaagccgaggaagcatagggcgggcgagcagactcactttcagctgggaaagaaattcgctgaggaaagttggaaaattggccagctgggattcgatcagagacacagcggggaacaaggaatagagtccggcacggaacggtttcaagtggcccatctgcgggtcggtgccaagttaggtgtgtgacggtagggtggngctgacctgnttgaaacagtgggcccctctg

SEQ ID NO: 44757 - DNA, 1373 bp, Heterodera glycines
  misc_feature (996)..(997): n is a, c, g, or t
  misc_feature (1004)..(1004): n is a, c, g, or t
  misc_feature (1007)..(1007): n is a, c, g, or t
  misc_feature (1015)..(1015): n is a, c, g, or t
  misc_feature (1034)..(1034): n is a, c, g, or t
  misc_feature (1037)..(1037): n is a, c, g, or t
  misc_feature (1039)..(1039): n is a, c, g, or t
  misc_feature (1041)..(1043): n is a, c, g, or t
  misc_feature (1045)..(1045): n is a, c, g, or t
  misc_feature (1047)..(1047): n is a, c, g, or t
  misc_feature (1064)..(1064): n is a, c, g, or t
  misc_feature (1135)..(1135): n is a, c, g, or t
  misc_feature (1142)..(1142): n is a, c, g, or t
  misc_feature (1168)..(1168): n is a, c, g, or t
  misc_feature (1178)..(1178): n is a, c, g, or t
  misc_feature (1183)..(1183): n is a, c, g, or t
  misc_feature (1192)..(1192): n is a, c, g, or t
  misc_feature (1224)..(1225): n is a, c, g, or t
  misc_feature (1234)..(1234): n is a, c, g, or t
  misc_feature (1243)..(1244): n is a, c, g, or t
  misc_feature (1250)..(1250): n is a, c, g, or t
  misc_feature (1256)..(1256): n is a, c, g, or t
  misc_feature (1271)..(1271): n is a, c, g, or t
  misc_feature (1277)..(1278): n is a, c, g, or t
  misc_feature (1281)..(1281): n is a, c, g, or t
  misc_feature (1296)..(1296): n is a, c, g, or t
  misc_feature (1303)..(1303): n is a, c, g, or t
  misc_feature (1308)..(1308): n is a, c, g, or t
  misc_feature (1313)..(1313): n is a, c, g, or t
  misc_feature (1316)..(1316): n is a, c, g, or t
  misc_feature (1318)..(1319): n is a, c, g, or t
  misc_feature (1321)..(1321): n is a, c, g, or t
attgaccacaaaaaacggattcaccctctggatttgccctccttttgcgacatcgaggtcaaactcgtcttaacatttcctcatttgactggtgagcatcgacagaccaaccacagtcgtagttgaacccaaaatccacatcagttcggtgtgttcgggcaaacgactctgttggaccagcaaagtcttctccgaatcgaccgacaaattgaacattcagggattggttgactcaacggccaatgcttaccccacaagcgagcagtgtggccaatgtgcgaaagcagttcaaccgcaactgaaacagcgcaccaatgggaatgaccaattgacccccccccccccattgtcagcagtcacttgggcaggttcatgtcggcctgtcgaaatggagtgaaggtcagcgaccaacaaaaccctacgggcgatggacatatcctaaagcaagacggggtctgtgagaaaggaacggagaatccattctctcacattttgaaaggcaacgaaggatttgatgaagcccttaagaggaaaaataaatgaaaattaaaaagtaatccaaaatcggaccaggtaatttccgatgtgcaaattgccggtgggctgaatgccggaaacgagaacctttgacatttggagcagaaagattaagggaagctaatataaaacagacaaaagcataaattaaagaaaataagtgacgctgacaaaaaaaattgaagaacaaatggacgaattgaaaagcaaattgaccaattacaaattcaaagggaacacaattcgatttgaggggcatttgatgcgacaaaaggggcattcgaccgaagaagtgtcgttggacaagtctttcgaggagagagtgagcagacaatcggaacagaggcagtgaccgcagggcaaacagacggagcgacgcatttggccgaaggcaatttgggaagagcaaattttgcaggaaaatccctgaaaattgagtatacaggatggaagtgcttnnggtggtngcncgtcccgntggcgcttctcggttttgngtntncnnngngncgcccgtttttgcccgntttttgctgccgcttgccttcgctttgtgtccgtgggtgcttttctgtcgcttttttgccctgctttgccntgttggnttcctgcgctgcggcgttttgtgcgntggtggcccntccgnccttgtccncctctttcttgggtttcttggcgggggttgtnntgtccttgncttcgtttnngttttnccgttntgggctggggcctcnggctcnnttngcgtatggaaggcgnccgtttnctganccgcngananncncgtgttccttaaaagaaaccaagcggaatgaatttggtcgattccgacggga

SEQ ID NO: 44758 - DNA, 873 bp, Heterodera glycines
aagatttgtccttattttggggctattgttcttatttgcctattatttactatatatattcatatttgggaatttatggccaaatgttctttttttcttataaattaaaacaaattttccccggcggcgcctatcggcgccaccggacgctcctgtccaacctccaaaattttttaaaaaatgtcgcaaaaaaagccttttgaatgtaaaaatggtcgccaattgtctcaaaatcgaaaaattgataatttttgatgaaaatctgttaacaaatcaaagaaataaaaaaaattttccggcgacgcctatcggcaccgccggacccactcccctcccccgttcttcaaaatttcttggaaaaatgcgccgtaaaaaatttattaaaaattttattttttttagataaaaattgatctaagtttgctatttttctccccaaaattgttaaaaataatcatgggaggtgaaaaatataatatttgatacatttttgatcgaataaattgtaaaaatatctgatttgaagcaattttgcgaaatgttcttatttttgaccataaaatcttattttttggccttaatgttcttattttgaaaaattttcgatacgaaccctgccttaaaatgacttaaaaagtgttctaaactctgtttgaggcttctaacatgcatttttttgtgacttttttttttaccctttttgggatttttatgacttttttgagtttttgcgacttttttcgtgattttttttgactttttgaggcgaaatttgaattttagcgaagaaaatgccgaaaaatacaaagaaaatttcgatcggtgaaaaggcaatgaaacttggatgagttttttcttaattgttggaagaat

SEQ ID NO: 44759 - DNA, 404 bp, Heterodera glycines
atattgtatgcctccatttactgtattacaaccccttgatgtttttgtctgtctctgtacttactgtatgtatcccttctaatagaaaataaaagcgaaaaatgagttttgaggttttaatccgagcttttaggggactgtggacttttgctcaaaaaactgggtgtcctaatctgagtttttaaggcgaaagtccgttctccggcgattgggtcatttgggatttgaaaaattgacgggagcgcgaccgggaatcctgtaaaactcccagtgagcaaaaaatgcaatctgaaccgtgaatccccataaaaatcccgtgggagtcccaatcgtcacgggctctgctcattaattcatgctttctgaagtgattttttgcataaatgtggaacattttttgtgca

SEQ ID NO: 44760 - DNA, 1101 bp, Heterodera glycines
aaacatttccgaaataagagcaaaacatgggaaaaaccatgctatacttaaaacccattgcttttttaacgaaaaagaaaccaaaaagcaaaggcttttttccgtacggttaatttcaagaaatcaaccaaaaattttcggcgccgacggaatcagaattattatctatgtttttgtataagatttttcattaaattttccagatctattgaattcatgtttcggattgaattagaacaaaataaatattatattcggaatctacgcctcaaaaaacccatagaaagtaaccaaacaccactactacataagaatgaaaaaacaaattactttatttaataaaaatttggcaaaatggttaaataattcaaatttgtatgttttttgtcttttctctcacgaaagaattccattcttagggttctatatttaacccgaccccgagtcggggttaagggttggggttgtcgcggctgggagcgtcggtgtcggggttatccccggaaaatgttcaaaaaagtcggggcggggccggagtcgcaaccctaggctaaatataaaattttcaacacatttccatttgagtagagagtcatcgaccaaaatgtgatcgcttgtctcaaccgttttggccagcttgtcgccaaatgtccgattatatttttccatcaatacgtgcagtgatcgcatgttgcacttatgatgtgcaacttttacctcaagcactagaaaaatatgaatgtcacggatctgaatgtcaatgatgcgctcgtttagagacaaattacttctgctgccattatggacagcattggcccattcgaaatgacagaaggcagacgaataaatgtgattttcaaaatttaggttttttaacttataaatatcacttattttgttacctttttgctcatattttccttgaataaaacccaatgctttggaaatatttgggcctttttatttttgaaattttttcacccttaaatttattttctgaacatgaaatgccaaaatttgcatgattttttttggaataattttgcccaggaaaaaaatggagcgaataaccaaaaatttcaaaaattcggattaaaaaaa

SEQ ID NO: 44761 - DNA, 993 bp, Heterodera glycines
  misc_feature (845)..(845): n is a, c, g, or t
  misc_feature (965)..(965): n is a, c, g, or t
aattttttattttttcattttatattttgtcatttaatattgataaatttttgtcttgatcaatcacatatagactgactgtatcatgattcaaccatatattttttatgtgaaattattaaagcaacgaatcggttaagttttttttgatttttaatttttaaaaataaaaaaaattattttggttgatttgaatgatgtcttgtagaattgaatttaatttcaatcaagttatcctttcttctatcagataataatatgatggcatgatattctgactttttatgcgatttttcgttcgccttttattatagtaatatttttaaacattttttaaatttggattttatattgaatttttccatctgtaattattggttttattcttcagtcattttatatgcttaatttaatatatgttttaggtattaattttatatgttttctattaatgttctccctttttaatatagagtaaatttcggaatttaaaaaaacattaggttttaattttatttattgtagtaatttttttataaatacaattattttcgcaattaatcggcataaaataacatgaattttaaaacttcagtaaaggttttgaatttcttgtgatactttcaattgttgcaaacaaacggttgagagtgtttcttatacgttaactaagtttatttatgaaattaaataattgtaattataattatttggtgtttgttatttcatgtaacttcttaatagagaatttgtaggaaacattcatttgtatttgattgtttaatttaataagacaatctatatttctgctcaaaaattataaatttatctcttattttcattanacataaaaattattttcattatattttaaaagtctagataaaatatttttttgaatttaagattatttcatgaactggactcaaatcttgctactagtagcagcatggattttgtataanattatattttatttataaatgaacaatc

SEQ ID NO: 44762 - DNA, 1618 bp, Heterodera glycines
  misc_feature (1491)..(1491): n is a, c, g, or t
tcggaggttgaatgatggcatttgtttttagggttatggctcggctactcaaggtgattattaatgtttttctactatatttaattatcgttcatccttaataattgtaaacccaaaaatataaataaatttcacaaatttaagaatttttttcttggttttacaatttctatgaaatttatttcgtttcttcaattttcttttgtaaaagtttttttttttaattttgcctttctcggttctattatcccattcccaaaccccaaaaaacagttcgctggttgcaagagtcgccacgtgttctgccgttggcggtgatgccgccaggcactcttcagcccatgccgcacggcacgctgctgacaacaacaacggggccttctttaccgtcaccattaccatcatcaggcgacacaacagcgcaattggtgatgccgcaacaacaacagcaactgtaccatcagcagcagcaacatcatgttttgtcgttgccatcttcagcgacagcgggtggccgagctgttcagcaacatcatcaccgacgttctgccgcttctcctgcggtggtctatcaacaaccgcaacagcagcagcagcatcagcaacactaccaccacaatcagcagcgatcaacagcagcaaatatgatgatgagcagtggtccggctaacatgaacatttcagtccgtgaattcttgagcaacaacaacgcggccagcagagggggagaccgttgatgatctgattttttttgattgaatttctctctttcttttttttttgcttgtttctcctttttgctcttcttcaggctttgatatgagacgcgcgcattgattgattattgatcatttaatcattatcatcttattatttgtgttcccactttgatcgtttgaaaatgtccgttttgttattttacctatttatttttcattaacggcaccgactgaagacacaaattttttcagtggcaattttcaactcactttattgccctttgctcacaacacacacacacattttattttacaaacatacagacggacattcatttcataaccaatggcatggcattggttagtttctgattggactcaataaaattgatagacaaacgaaaacactggttatcatagttcccaagttcaaaaacaacctaaataggtaccaaagtgtccactttcaagcatttgaggtgcaccagcagatccgtaaaatgggcaaaaacagacagagagagcaagcagcaaagtgtcatttgttgtccaatgaaagtgagtggaccacgacgacaacgacatgaaacccattccttcccccatcagctgctgcccatttcaaaaaaaattggattatttttgttacttttcttccacacattggtggaatttttgcttttagttggtggcgtgggtgggtgggtgcttatttgaaaagtgcactacatatagtgagtggataaagaaaatactgatgaaaatgcccggngggggatgcttttccctcgacctctcttctctgcctgcccaccactcattttcacttcccccgtcactgatgaggaaaaatgtatgcttaaaatcattgaggagcattggcggcgtatgccagcagc

SEQ ID NO: 44763 - DNA, 1008 bp, Heterodera glycines
cgaccccgagtcgggttaagggtcggggttcggggtccttgggggtggaagcatcggggttcgggtcggggttaaccccgaaaaatggccaaaaatgtcggggttcggggtcgggggcccaaccctaatacatatgttaaaaatcgcaaatttggtcatttttccgataaaacatgttaacaaattgcaatcaaattttaaacagcctgcaaaattttaaggattttcatcacctatgagtttttttaaattcgtcttttccagccttttatgtttaagttacatatagtatgatgatgtgccgaccacggcactttcccttttttgtgccgttttcatttgttgcagcttcacatataatgggtcaaacttaataattctttgaactcatccataaattgactgtgtacttcttcaattgccatcgaattggcacttcatggtgatcgcaagtcgatcaggtgtccactgaatgttgctgatcggaagggcacccgaagggttgccgaaaccgatcgaatgaatagccaaaaggaaaagcaaatatggataattagtgacggttttgattatttatattgaagaaatttgatattttctttcgcattggccacagttggtcaaaagtggtggtgaaaaagtcactcttggacaaatgttgaattttcacatgtccaaccaaattagtggtaaatggcaactcgtacaataaattttggggcctcggaatgccatccctgctatgtacgagttgtcagacacccaaattagttgcctaaaaagccgtattcttttttttgtctataaataattttggttagacaattttctttaaaatccaaacagcagtgaacaaaattcttcagttgatcagccgatggagtagcagaagcagcagcaggccgtatatccagaaaaaaatttcggggagggcacccgattttttttttgctcttgggccaacaaaaaattttgcacagtattatttccaaaatttcagcgccgggg

SEQ ID NO: 44764 - DNA, 1129 bp, Heterodera glycines
attcatttaaaaaaaaataaattttaaatttgggtttagtgcgttttgctggatttttaagataaaagataaaaaagtaattattttaaacaatcttccccatttttcaaataattcgcattttaaaattttttagatttgtttatattattgaaaaaatcataaatttttctaaaaaagaccaatttcattgcgttttttgtcctaattatagttttggccatcagcttttgcaagttaatgaaatttttgaaatttgtagaataatggagaacaccacttttagatctatcgaatttaattttaattttttttcaaaaattttccatttaatagttttttgagtgaagcccttttgctgattttttttaatccaaaatttggccctaaatgggaaatttaaaaaatgtggtaaaatgtttggcgcctcggatgggaaccgaacctatattgcattcatcatgtgggaaactataccattgagctaccgaggcaaatacgaccattctttggcgcaatacaatgtttttgatatgaatatttttgaaaattcttaaaatttattaaaagaacacagtaaaaattagaaaatgcaaaggcaaataaataaatatatatatatatataatttttattgtccaaaaattctccctataaaaaatatgtttttaaccccccccccccataaattcttaagaaatttaaaaaaattctcttaaaaattgttcttgttcaaaaactctcccctaaatttataattgaatttattttaaaaatccccccccccacataaatttagataaaattgaaaaaaaaattcgctaaaattttattgttcaaaaatcctcaccataaataatgtttttttaatccctccccccccccccaataaatcccgacgaaattaaaaaaatattctctccaaaattgtttagtcaatcaacaaatcatatcaaaattgagggccatggaatatcatcgaggtgtaatcataatttcaatggattcattttaaattctttcgtcagaatttcaacagtcaatttttgtcgttctgcttcatacaaattgtttggctcaagtgtcaacagttttccaaaatattcaaatcgctttttctttttcatta

SEQ ID NO: 44765 - DNA, 1150 bp, Heterodera glycines
cagcataagacgccgatactatgtttctgaattatttctcagcgcattgatcgtgaaaatttggaaaaatggctatctcttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaattattttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaattattttctcagcgcatttgatcgtgaaaattttggaaaaatggctatctctttttctggtctacagtcaagggaattccaaccgcattctcagcataatgacgccgatactaattgttctggaatttttttctcagcgcatttgatcgtgaaaattttggaaaatggctatctctttttctggtctacagtcaagggaattccaaccgcattctcagcataatgacgccgatactaattgttctggaattattttctcagcgcatttgatcgtgaaaattttggaaaactggctatctctttttctggctacagtcaagggaattccaaccgcactctcagcataatgacgccgatactaattgttctggaattattttctcagcgcatttgatcgtgaaaattttggaaaatggctatctcttgttctggctacagtcaagagaattccaaccgcactctcagcataatgacgccgatactaattgctctggaatt

SEQ ID NO: 44766 - DNA, 1257 bp, Heterodera glycines
  misc_feature (15)..(15): n is a, c, g, or t
taaataaacaaattnttgcggacattaattatattattccacccaagataatttttcattatactaatataatgtaaatcctataaccaatttaaatataaataataaaagggctgccaatttcatttaatacattttttcaatgattctatgtgatttaaataataggaaaacagattcttttttaacaacagtttggacttttatttacatatttggactttttaaaaattcttaagaatttttttaatttcccctcaaaaagatatcaaaaacaatttccaaaatacttaaccgttatgctaaatatattttttcatttttatcacatattgttcttatttattttctaagaattttttgtctaaaaaatcataatattataaagatttttattcacttattttggcacatctttgggggtttttgtaaatttttcttacatatttcgagatttttcaacataaaaaaatttccgtcaattcttaattgatttataaatacgaatttctaatttttaaatttaaatcccccctcactttttcagcttcctccaacactttctccgttcggatggcctttttccgctcgtttctctgctcaatcagtgccattgccacggcccttccgccgaatttctcgcccttccccttttggcctccattcgcgcgttactcaattcgacggtcggtctttgcaaatgtttcgttgttttatggcatttcaatcaaatggccttaggccatccgtcgcatttcccattaaatttgccaattggtcccaatttccgtcccccctgctaattacccccccccccattagcaaaattcatttccatttccatcccaaaatgctttttggcttctaattcgtctccaaatgcttcttccttttcagactggtcgtcagttcgttcagcaatcagccgaaacatttcagtcgatcgcatgggctttgcaatttcaaagtgcgcgttgtaaggcgaccatttgcaattctgcgatcgttcttgtcaccgactaggctctcctttcagcagccattcagtgtcgtctctcattggcatcagctcggtcgcttttggcattcgttctccgttcagcacaatctgtgacatgctttaacatcttgcatgaatggcactgccacttttggcatccccccaccgccgatcagtccgatcattaatgcttcatcctctctcccaccgattgatccgttggaagcatcggttcagttaaaaatcgccttcctctt

SEQ ID NO: 44767 - DNA, 1654 bp, Heterodera glycines
  misc_feature (72)..(72): n is a, c, g, or t
  misc_feature (115)..(115): n is a, c, g, or t
  misc_feature (1625)..(1625): n is a, c, g, or t
ggcacacgacctttcctccgaagccttcgttttcaactccaccagaatcgccacagaatgagtgcacgggcnaattgcagacagaacagctgtgacttcctccgtaaattgcttnacaaacacaacaaaataattccattgataaagctgaaaataaacgtgctaaaatacttatgtacgtcattacgagtggtcggaataatatgtttgggtttttaatatttataaaatacatattttagcagggttgccagatctgaggatttatcctcattttgtggcttttgataggtcaatgaggatttttttggaaaatgaggatttttgtggctttttgagaaattttgaggatttttgaggcttttggggaaaatcctcagaatattttaaattttgataaattggcataatgtttggcaattatttaatttgaattttagtttttaatagagtatcaaacggaaatctcacccaaatttagccagaaaattacaatttttttcgaaaattcacaaaattatgaattttttttaatgaaaatctgctaaaaatatggtcaaaattctcaattttcccccctccgatgcctatcggaccctaaaaatcctttttctttttttttcaattttactcaaaattgcaaaatttggccattttgtggacaaatctgttaacaaatcacattaaaaattacaaaaattttccaggcgcctatcggcaccgccggcccctcaattctccaagttttttggaaaagcgccgcaaaaaaatcaacttcgatttttcatgctcagaatctcacaaaatgcttatttcgaacaaaaaaaattactcaaatcgatcatggacaatcaaaaatataacatttgaacattctatacgtgttttgaataaatttgtaaagtgaggctttttgacccaaaatgaggcttttttgcttgccaaatgaggcctttaaaaattttcatctgcgaaccctgggtatgtatgagttgggtttggatgagttgggtatggatgagttgggggtgactcacaaaaaatattagttatttacctatataatgtatataaaatttcagatgaatattctcaaaattttacatacctaactatttttaaataaaaaaattacaaccagcctgttgaatggggaattcgtcaactactgctcgatcgggtaagaattaaaaagggaatttcaaaatattgttacaaaaaaagatgatccccagtcgacactaacagccggtgaaacgctttctgattacgatgagaacattatcaacaggggtacgattgggaggccaaaaccgctattaaaatttcactcggtgtgcgggacgaacattcaattgctaagggaagggcgagtggcacgacgaaaagagtcgttttgcaagggtcttgcattcagcaaccgacccataagcatcaatgagatcgtatgcattcgattgagtgagatcggcactaattggagcggagttatgaggtgctgtgggctaattataagagggcggcggagggattaatgatgaacgagacaatgtgaataatttgcttattcagattcggtgtcactaatgttgatccggccagttttcgcgacattgaattgccanaagtattagggttttttaaaactaaaaca

SEQ ID NO: 44768 - DNA, 936 bp, Heterodera glycines
  misc_feature (762)..(762): n is a, c, g, or t
  misc_feature (785)..(785): n is a, c, g, or t
  misc_feature (791)..(791): n is a, c, g, or t
cccccccccccccccccccctcgcctcacgcatcattttcctccaattctcattctcagcgccaccacatcccgccaatatttcaccccatccattcattcattcttcgtacaaaacagcagtacggccattgcttgtgtcccctccgccatcaccatttccttggcttcgcaatttttgcttcaccttcaaattttgaaaaattttacaaaattggactgtttttttattgcatcataaaaatcattgtttctgtgcacaaattgttgttattttgttcagcaaatgcaataaattacaggctttttggccgatgaataatttattttgttcaaatttttcttgaattttctaaattttagaggaagaaatatgtgttccaaaaatgattcatcagtgcgcatcgacttgaagcgatgtccatgcattcactcattggctcaggtgtggtggtctttgttttgcagattttgcgcagaatttagtccaaaaaacgtaaaatgtgccgcaaaataagtgccgttgtgccagaaaatttaaaattttcgccctcttccgccctcctaatttacatccccatttttgctcagttggtggatgtgacattgcaatcgctgctttaccaacgacaaatgatccccgagccggcctcaacacttttgcacggctgcacaccggtggcggaccagttcagggacacctaccaaaaagtgggtaggccgcaaaaaaaaaatggaaaaaatcatttgggccatgcccganattttcttgggttagggcattanaaattnttagggtataaaatggtgaaaaccccgagcatcgttttaggggttgatcacggcgccaacgacaaaaaattttaaaaaaaaaaactcaggtccaacaaattctgcgcggcacttccgctccgccatggggacggacgcattcgcg

SEQ ID NO: 44769 - DNA, 1022 bp, Heterodera glycines
  misc_feature (905)..(905): n is a, c, g, or t
  misc_feature (911)..(911): n is a, c, g, or t
  misc_feature (975)..(975): n is a, c, g, or t
  misc_feature (1004)..(1004): n is a, c, g, or t
agcaaccctctgttgagagtggcaatgctatttgctcctcggtttgcttacacagaacttttctccagcaaaattggagggttgtggaacagctaatcgaattttcaaaagagagttggttgaatattagaatatttggtaattaaaatatgagtccctttagaattggtctaccctacaacagaaattgacgccaattttgatgtgggcaactttggtccggttgagccaggaactgcctgtacatttgctgaccaagaattaggtcaaagcagcaacgagagtatagagaaatgtattggcaaattgcatcacctaaagctcggggcagaaccctactccaatctccccttaaaaatgataccaatgagtcaatatctcaacaaatttaagacataattgaaataattttcttgtctgcgattcgacgggccctttcgtgcatattttggccagcaccggaggaaatactttgtcgaaattcgggtccaatacattggaaatgtaagtgagcatttggcgatatttggcgcccgtgttgaaaaggcatacgatcagtcccataagttccatgtaccgtagggcccccgctgcgggaccgtaatttgtctgaatgggaaaaaaaactatgcttggacgtttcgttaattcagctagcatgattgtttctcaaaaatcacagtggtttttcgtaaaggaagccgaccatttcgtcactaggagttttttcaaaatacatcgtgacatttcgtaaattcgccaaggaaccagaaaattggaaacctgaatttacgattttgtttaaatagaacagagtggtaccattatcggttcatgccaatttttcaaaatgggaattaccgtattagtgaaaacttcattaaacaaggcaaaccctcccattnttttanagattcatctataggtaaatattgtcttttttcaaaagaatttccaacattttttgttcatttnattttttaattttttagataatgtcaaanaactatgaaagaataatt

SEQ ID NO: 44770 - DNA, 856 bp, Heterodera glycines
aaaacaggttaattcttttcctttcagtatccctgcactacccggggcgcttctgataagtttctgaaaaaaaagataagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgtgggcccttcgccccctcccctccccaaaaaaggcttttttcaaaatttcgcaaaatatatatataaaatgccaccacctgcgcaacggaatccgcgaatgccaagcccacgcgcgcacacggcgcaacaggagaacgcggcgctgaacaggttgctgacgggcgcgtaggtgtgcacgcattggttgatcggtcttcccttggtccaaccgtagccgacaaacggacggggtggaccgaaatgtctgaaattttgaggaactggctttgcctttgtattcattcctacatgttcaatgtgctgatttgcttgggcgacatcgctgcctaatgct

SEQ ID NO: 44771 - DNA, 1044 bp, Heterodera glycines
  misc_feature (187)..(187): n is a, c, g, or t
ctggaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgccntgacactgtcatcggcgcgggtcgccgggccaccgggtggcccgacttaaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcatccgtcgcattttcaagggccgtgtggagcgcacgagaca

SEQ ID NO: 44772 - DNA, 1182 bp, Heterodera glycines
  misc_feature (98)..(98): n is a, c, g, or t
  misc_feature (102)..(102): n is a, c, g, or t
  misc_feature (926)..(926): n is a, c, g, or t
  misc_feature (1071)..(1071): n is a, c, g, or t
  misc_feature (1075)..(1076): n is a, c, g, or t
  misc_feature (1132)..(1132): n is a, c, g, or t
ccaatgttattttgtcgaaaccaatgccaaagggctaatgattgggcttttgccgttttgtcatgcgattctttgtttatctcggcacaaacgtcaancttntgcttggtggattggctatttgatgccggacgatgcgaccattctgtataattccgatttccttccgggtcaatttttaatttcgttgaattttaaaataatgagtaattctgttttaggccttcatacacgtgaccattttttgcctgaatggattccgatcaaactgatcaatggcacaatggctctcgattatcaagcggagtgaaatggaagcgattttgaaaaattgttttaatggaagtggaaaaatgctaagaatgttaacccacaaatttgtacacaaaaatttaaatttgttatgctgattctgattgtccttgctataaaagccattcttaggaaataaaacgtgtggaaattttgtttaatgctgtaaactaaactgataaaagtatcagttgttttgttcaccgacgagtaaatgttgaaattcatgggcttttaccttgagggtgattaagcgaaagagaaacgcaatcgatttggtttttgatttctttcaaagtcaaaaaatggcccatatgtaggcggaaatggaattaaaaagcgtgaagttaaagaacaaaagttaaatttataattaatattaaaatcttttattaaaaaaaaattcatccatttgcattgagttggatatttttatggaaaatatgtttatggattataactccatcctagaggcttaaaaccaatataaaaagcacgtttttatgtgtttcgtggcactcacagcccaggtaaaaaaattttatccaaacttcaaaatttgaaaaagacttgaagcttattaaccaaattaaaaataataattaatttacaanatatttttgtcttttccgcctaacttaatttttcaccatatcctcttttttccatgcataaatttgtttgattagaaataagagaaaatgcaaggcatattttgttatcatcgagcaaaacgctgaccccaaaaatgaatatganaggnnaaacatttttcaaaaaatctttttttttgggtcaaaccaataattaattctgtggntaaaccaatcctcagcgcggtcccaagttatgagaagactcaccatattc

SEQ ID NO: 44773 - DNA, 1556 bp, Heterodera glycines
gagtctttcgtttttatttattttttgcaaaattaattcttaaatattttttcagaaagggttctgaaacgcaccaaattttatttacatgttagtttagcgactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggggggggg

SEQ ID NO: 44774 - DNA, 1729 bp, Heterodera glycines
aaatgcaaagtcgctatttcgcggaagcggtgttttttagtgtaaggatgggcgcagacgtaaaaagcacattttcgcaaaatttggtcaaaacggacaaagtgtcgacactcaaaacggacaaagtgtctacacacttgctgggacaaagtgtcgacaccgtgttttttgtgcgtgtagggcagtggcaagtgcatgactgtctgttttagaccttttggtcaccacagggacaaagtgtctaccccgggacattgggtcgacgcgatgtctgtctgtctgtcatccactggcctttgtataatatttcttttattggcttccactggccatttagacaattttcttttaattggcatccattggccattttataatgtttcttttattggcatccactggccttttcttttcttggcttccactggccattgtttttttattggcatccactggccttttcttttcttggcttccgctggccattagacaattttcttttcttggcaaactgctcacgggtgccacgcatgcccattcgccaagccctcgggttccaactgctcacgggtgccacgcatgcccattcgccaagccctcggatttacaactgctcacgggtgccacgcatgcccattccaactgctcacgggtgccacgcatgcccattcgccaagccctcgggttccaactgctcacgggtgccacgcatgcccattcgccaagccctcggattcaaatgctgcacgggcgccacgcatgcccattcaactgagcacgggtgccacgcgcatgtgccggtagctgctgctgcacgaacatccagacacgcatctttcggtagctgctactgcccagtcaacctggactgtgcacccgttactggctacaactcgaccggctagggtaagcaagtgcacgctccccacgcatgccctcagagcggctagttatctgtatataaaaataacgggggggctaaccactaaacgatttccctctccttaagggctcaacggatcgccacgggaccggtaccaatcgaaagagctcggttttctctacaaaatggcccgtgtggaaaaaattcgcaccagcaaaaattttttgtaaaattgggttaaagaaaaaaaacccggctttttacaattggccaaaaatgggttgtaaaatgtgtgttttcaccttatttctcaggaaccgtaagagctacgcttttgcggtaagcgaacaatttgtagagctcgtcgagaggaagggtgagaaaaaaatttcgtagctctgcgacaaattcgaacaaaggtataccccggcaaaggtcgaaaaaagccgattttttttgtgttttcgccttccggtttacaatccgtttacaattgcaaattcatccggaatgtccggaatttcacggattttgatgtttttcacgtgttttcttcacgtttacgtgcgtttttgacgtgaattctttaaaccggtaccggtttttcacgtgtgttcttcacgattacgtgtatttttgacacgtttgcttgcgttttcaacatttcacgtgtgttttcgttacattaacgtgtgtttcaatatgttagcatgtgatgtcgagtattatcgcattgtttgcgttgtgttttactatgctgcttcgcatgcaatttttacacgatatacaccataacgtctctgatggttctgcaatgctgcataataatactgatagtgatgttac

SEQ ID NO: 44775 - DNA, 1202 bp, Heterodera glycines
tttcatttcatgccattgtttcattttttatttgcttctcccttttttagtattttttcccgaccatgcaaaaattgaaaattggcccgctaatttttctcgaattttttatggtcaaaaaagtaacctgatataacaaaaaagaaggttttctgtacaaattagaccagtagaatccgaatatggccttaaatctgacctatcttttaaccctgagcttgtactgctccaactccatgcatgaagttggagctgtacaggtttgttgagaacccagagaccaaatctaaagccatattcggactcagcgtggtcaatttacttagtttaattaaattcggaatttcgaaaaccacttttaaaacattttgttatttgatggtcttgaaaaatgccgtttttggagaccatttttagactcggccctccaataattcatttttgaagtaataaaatttttttcttataattttttatagtcctaactttgctctatttactcacgttttctctgcctctgtatctcttttcattttctttaaatcagccatcaaaaatacatacctcgaaaatgaccatttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcggaaacttatgttacaccctaagtacataattagggattgattgcacagaagaaagagaacaacacgagctgagaatgagaacagagagaaagagagaggggcgatgagaaggacggacggagtgacacaatcgaagacaatccgtcgcggataattagcactaatcacccaattggcaaagtgaacaagcccactatgatggtgcatcaccacactgaacaccttttggagcccaaattcattgcacttccaaccggacaattgaaatgtttggcaaattggggcaaattgccgagtacgacgttaaccctaaggcagcaaatgaatgaacgagtgttttggcattcttttgtcattaattcccatttatgactcacctcgattctggcggagaatgagaatcgaaaagggcagcaaataccgcggcctaaaaaggaaaatgaattatttgccatggg

SEQ ID NO: 44776 - DNA, 1242 bp, Heterodera glycines
  misc_feature (156)..(156): n is a, c, g, or t
agcgatttgcttcctcagtcgacttttatcctcccgggtcggattgggtctttgagttgagccattgccacggatttcgagtggttggcgcttggaactgaagaaatcatagttaagtaaggtacgtaaaaattattctgtcttcccggtacaccncaaaacacagccgccaaaatacagccgagacataacacaaccgggaataaattttaaaaaattagaaaaatcttagaaaaaatgtttcttagaaaattcatagaaaaaactttctaaaaattttccagcgatttttttgaaaaaacttggtaatttatcagtgaattttgaaaaaatcgttggaaaatttaaaaaaaaattttgatcgaattttctaacaaagtaagacctttttcttgaaaaatttctatttgaaaaatttaaaaaaatctattccggctgcgttatgtctcgactgtgtttctccggctgtgttttgtctttttccgctgtcttccacgtcaaaattttattgaaattgttaaaatttgtgtgtgattgattaatgcaataaaataaaaaagcaaaaccaaaggaaggacctgatactgacgcataaactgcgcgtccggcatccaaatgtgcatgggccgtttgctgaccagcaaatgtttggtgcattgtatggaattaagatgcgaaaatggttttagcatattcatttttgtatgatgaatttctaattaaataagtaacaaaaaaaattcgacaaatcggagggaaaataaaagggtacttatgtattatctgtgtacagatttcaaaaaatttgcatatcaagggtaaaatatagtgtgtaaaaaacatattagaaaaaactatcaaaaatataattataaaaaatgggaaaaccttttgaaatgaataacggaaaattgtttgaaaaggaaaagtgcatttcctcaggaatgaaaggaacgaaaattaattaatattaaatggcgaattctgttaaggattgcgttcgtaaacaaattattaataattaattgaatatattaaaggaattggaattgtaaaggaaaaagtggaaaacaaacatttaatgagaaaatggcaaaaccccaacggatataacaaaaacagattttaattaaaaataataaattggaagcgactatggtttcaaaaagccgtataaaagggcttggttttcagggatttcaaatcgctcattggttccccccgaaatttcatttcttcccc

SEQ ID NO: 44777 - DNA, 816 bp, Heterodera glycines
agagaaatgccatggaattgggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggatttggggggagagacggacagagcagagaaatgccatggatttggggggagagacggacagagcagagaaatgccatggatttggggggagagacggacagagcagagaaatgccatggaattggggggagagacggacagagcagagaaatgccatggaattgggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatggcattggggggagagacggacagagcagagaaatgccatg

SEQ ID NO: 44778 - DNA, 957 bp, Heterodera glycines
  misc_feature (889)..(889): n is a, c, g, or t
tgaactcgaaaatatactttatttttagtttcagacctcacccaggtgtttaaaattttttgaaaaatcgtcaaaattcctgtcccggaaaatccagtgaaattttgaaaattcataactctcttcgtttttggtcaaatttagtgggaataaagtttgaaaaatagcaaaaaattaggagaattttatgagatttatttggaatttctatcttccaaaataaaaaagttattccagaatttctggaaaaattcgatttttcagaaaaaaattcctaactcccttatgaaaaagtattttataaaaaaaatatactcaaaaaatccgcaattttttgctctattttataaattttattttagctttttatcacttttttgaaaaaagccgcgaagcggccgaatttccccaaaaaaattaaaaatggcgcgaagcgcccgtactgaggccgcgcagcggccgaatgttcccaacaaaataataaacgggcgcgaagcgcccgtcctgaggccgcgcagcgggcgaatttccccaaaaaaattaaaaatggcgcgaagcgcccgtcctgaggccacgaagcggccaaatgttcttaacaaaattaaaaagacggacgctattttgaagaagtgacgaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaccaattttcgttgctctaattaaccgcgataaaaacattcgaatcaattaaatagcttctgagataataaggtttatcataaaatttcatttaanaataaaccctcaattattggtatgaacgatactttccaaacatgcacgcgttttgcgctcgagctatt

SEQ ID NO: 44779 - DNA, 1361 bp, Heterodera glycines
  misc_feature (42)..(42): n is a, c, g, or t
  misc_feature (431)..(431): n is a, c, g, or t
  misc_feature (529)..(529): n is a, c, g, or t
  misc_feature (531)..(531): n is a, c, g, or t
  misc_feature (556)..(556): n is a, c, g, or t
agaagaattaagagtgaaggtaaaagagaaaatgtgtgtatnaaaggattttaatgggaaattttggtagaaataaaaatgaaaaatggaagtaatgataataatgagaaatgtttgggtattttatttttgtgaaatgttttaaatgaaggtagaaattaaataataattaataaattgtaatgaattgttattaagataaaaattggagttgtaaatgttgggtaatgattagaattgtatcagaaaagtgaggtgtgatggatataaggagagaatttgatgagaaaatttttgagaataaaaatggaagttggggatattgtaattttatttattttgtggtgagtgataattaaatttttgattaattgataagaaattatgaagaattaagtaattgatggaagtaagaaaaggattttataatnaaaatgaggataaagtgagattggaggttgatttgattgtatataatagtaaatatggtgaaataaaagagattcagtaatttgtataataatatctngnttttttgaaaatggtattggaaaanttgttaaaatattataataatggatggggacaagtaaaataaagcaacgaacaacggaaaatttctaaaaaatttttcctattttatagtttcaattttttttttcaattaccactaaacacgaaattctcttgaataaaaattccaggtcccggttttgcctataattcccgcgtctcgtacaactgtaattgcgtgaaatctatcataaatagggatcggattcttagttttttaactattttttctgcggctttaactcgacgagaaatgcacgaaaaacacattctttttcgaaaatttttcgtttttagtgccactattcatcactaggaatcactattttggagcttcgccactaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgacctaaaaaattttcaaaaatacacccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagctatttaaaaaattacacccctaaatttggaactttttcgccactatttttgccactattttggaatttttttctcactatttagttaattattttgggattttttatcactaaaaatccgatccctaa

SEQ ID NO: 44780 - DNA, 891 bp, Heterodera glycines
tcatccattaaattggtataactaagagaggatatcacctaccctggcactaatcgctcgccactaattttataagctaaaaattatgaagagggttccggttttggggcaaataccttttttttaatttggtttgaacttctaggccatgttttttcgtgcccttttgctgccttttgggattttcaggccctttttgggttttagaaaatttattgaccaaaatgcaataaaaataccccccccctaaaaactggttggtttttctcaaaaatcatccactaaaatttgattttcttgactaaatattcggattgtgaaaacttttaatcatttaagtttgaatatttttgttaactatttttgggccgtctttttttgctcttaaaatttttctaaatttttagcttgaaaattgtaaaattccgtaaaataattgcaaatattaaaaatatatatgttgtatttgcagcaaaatttgcctacagcgtttcaccgagccttacaccactgtttgcggccatactttttggttggtgtgaaaattggatttttgaaaaaaaagcgaaaggtttgagccgtaaatttaggcaaaaaatggtggcacccctttttcgaaaaaaatcaaaaaattttcccatgtaaaatctttttattcagctcggatattttctgacacccatttcttgaaatcggactcgaacataagccgagaaaccgggctttttctatttccaaattttcgatctacacaaggcattaaaatatgaaaaaatatctgagtatcataccaatactgcgcagtaatgggactttgttcgagtcccgtttcaaacgccgaattgggtcgaaatgaaagggctccattttttaggcaaataaaattcacga

SEQ ID NO: 44781 - DNA, 926 bp, Heterodera glycines
cccaaattttaggcccccagccacagccccttgcttccccaccttgtaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaacctcagatttttgaatccgggtttcagaaaaatgccttgtggtgaaaacatatttcacatttcactccataac

SEQ ID NO: 44782 - DNA, 1371 bp, Heterodera glycines
agttctttgatggaaagtttgttgattgggcggtcgacattgcgggcggcgattaccaaagggatttcctaagaaaagattcgctttaagcggctaattcgaaatttactccgccagaacgagcgcgactgctcacgaaaacatcccaaagttgttcagcccgactcgaattctgagaggaaaagtgaaccaaatgagaggggggggggagtgacttggtcgaggaagggcaacagctcgtctttgctgggaaggcacactttgagcgacaaattgtcataagtgccggggggaaggcctttggcgctgcattccgccggcttatcccctttgaagatttggatgaactggcgaaaaccgccaatcgtttggcaaatgtcgcagtggacacttaaaagaaaatgggaaagtcagagggacagaattggggcggggagcatcacaacagacagaaactcacaaattgacagattcaaaagcccttcgccaccgcacttaccacacacaaaagtaacgaattatcattttgatgctcgagaatttcaagaaaaacggagaatccgaaaaaatcaaaaagatatatacagaaaaactgaaagttttagttttagtattttttagagtttgttggcaattgttccgatgacctgacattttgagaagccctcaagggcgagactctcgattacactgtcatccctccccccgttccctccttcttcctcccccctccccatccgcctttctcctcttgtcttaccacgaccctatgccgccacatccctccttgtcagggttcacacatctctctggcttcccgtggatgccaatccttgtctccacgtgtacgtaatatttcttgttgccgtccaatcctggagcatacaccttcaaaaaatgccattagcttttggcattgtgccgttctcctccgtcccttggacctccactttccctccgcccatttgaaagcatttgtggcccgcgtcgtccttctcttctttgaaggcgacacccgtggatttgtagctggggaatttgatgatcagattctccttttttggacctgaaatgttttcaaattgcttaaaaaaatagcgaagcaccagaagcggcggaacatgggaaatggcgttcaattttgatagaaatttcggcgtcaaccgatggattcgtcataaaaacgatcgatgcgcacaacaacagcgccgtggggagcattttggggaatggcgcagagaatcgacggacagaacggcggcgacaactgtccgcccccacgaacattgcgaacgatgtgctgacagtgacagaagcggaggaactttttaaggggatcatcctaagaatgagagggggggggggaatagt

SEQ ID NO: 44783 - DNA, 1099 bp, Heterodera glycines
  misc_feature (48)..(48): n is a, c, g, or t
  misc_feature (126)..(126): n is a, c, g, or t
ttgaaggaaatgcactgggacccatcgagaagtctaaaatgggagcancagtaagggaccacaatttctgctagaataagagaatttggaattttttttgggagaaagggaaattctcccgggccntatttcgtgtcgataccgtatttggtcctattttggaggagaaatggagcattactgtattccattacccccgacccccaattttttcgcctcacccgtctgtggtgccgttgtgaaagccaaaaggcccgacgaattggtgaagcatttgtggagcttagagtcgataggaattcgggacccattggattctaacgatgatgaattagcttccgacctttttcgagactcagttaaatttaaggagggaagatatgaggttggatggccctggcgcccagggggtaaaattaaactgtccaacaactttttcctggcctactcgcggttgtcaggcctatcccaaaaattgcgttccaattcggagtttcgggaaaagtaccaagcaaccataatggagcaatttaaaaaggggataattgagcctgcagttcgtacgggtggcaacgagcattttattccccaccatgccgtcgttacccccaaaaaattgcgcatcgtttacgatgcctcggcgcatgagaaaggaaaagcatcactaaatgaaatgattattcccgggcccaacttagtcccggaattggcgggcgttttactccgttttcggtcctccgctttccctgtcctgggggacatccaaaaagcctttttggccgtcggtcttagggatgaagacagagaggtggccaaattcctctggctaaaggatccttccctgcccttaacccacgaaaatttagttgtttaccggttcaagcgcatagcgtttggtgtcaattcttcacccttcctcctggcttccgttcttcagcatcacttaaccttgaatggggaccccctggggatgaacggaatttctatgttgacaatctgcttctttgtagtgaaacggctaccgaagcagccaaagccgtccacattgctcgccaagtgatgacaagggcagggatgcacctccacgaatttgtggcag

SEQ ID NO: 44784 - DNA, 1315 bp, Heterodera glycines
cttttatatattgaacgtttatttcgttataacataccctcctcaactttttacacatttttaatttggttaattgagacaggcattaattccattgcttcaaatgtggtacgagagattgcccatgattatcgcggccgttagtatccccgcattttgtaccagcgactattacccactgcattggtatgggacgaatggctgcaaacatcatcgagttctgaaaggacatgagcagtcggctctccttatccgtgacagagagttgaccggctacgaatacaatttgatgggcatcgactcaattccggaggaggattaactgaccaacgagtgggattttagaacattagacgatgacgaattcctcgattatccattatgctgtctaattgtggatataatgtttaaatgaaacaatgttatgtgcaattctggcctgttttcctaatagattttctcttttggttgtgttttgattagtttctccccaattattggccgttgtagtcgagtgttagaaaatccaaacattttggattttgatccggttcaaaaatttcggctggtaaataacttagttgtgtattactcaaaaacatttaactaagtttaattttcacggttttcaattgttgcggtgaaaaacgtatttttctgcaggcggcgaaatgtctcgcagagaaaatccagaggcgaataaagaaaaaatctaggcgaggtaaaatgttttttttaatttaaaaaaaatccaaaaaagataaaaggcacgccaaaagtaagcaggaaaaatttagacctcaactaaatacaatactggtttggtatgatttactacatctttggtatatttcgcacatcactcttccttatacataggcattatggttgccccatttaattattttgtactgttgccgataaccttcttttctattctgtgcctttcgtttttcgtcgctggtgttgccgctgactcttcaaacgatttggaattgagcattggctcttcggcggctaccaaacttgttcagggtgccatagatgggacacttcgttctccgcgtttcatcgaattggaattggccagcaaaaatagtccacgtcacgccttggcccatgtttactccattaaccgagtgaatgttggtcagtcttttgtccttttcaatggctatttttcatgtctttattccaggctttctcgaggttcactttaatcagagccaaattcgggtggagacgcgaagggtggtgctcaactccacttctctgaagggcatgacatcattgccgttgctgtggacgggaagcg

SEQ ID NO: 44785 - DNA, 800 bp, Heterodera glycines
tgtatattctctctttttattttctctttggcattatgtatttccaataggcgaaatgaatgtttttggcttagtaggcgaaatgaatgtttctggcttagtaggcgaaatgaatgtttttggtttggtaggcgaaatgaatagtaggcgaaatgtcagtaggcgaaatgaatagtaggtgaaatgacagtaggcgaaatgtccggttttgggttagtaggcgaaatgaatgtttttggcttagtaggcgaaatgtcatcgtgccgatttggacgagttggtagtttttttgacactaagatcttatttttggcctcaaggtttcttttcttggaaagttttccaaaccctacttttaatgcaaaaaaagtttaacaaaaaccccgtcctgtttaatagaatttaaaaactaagtttctctttcctttcaggcaaactatgatcatcccatttaaccggttttaccaaagaacagcaggccaagcaaaaaactgtcctttaaggacacattacttctcaataaaatttactgcccgggttagttgaatacacagaacaataaaaaaaattttgcccattgtttacttttgtacgtcacagacgcctgcaaacaactacccaacaaatgccaaaacggcggatatcaaaaccccaaaagatgttcaagatgcctttgccccggatggttataggggaacatactgtccattctttctatagaggttctgttgggaccggtactctattgtccgcccatattattttcattcctttattctctcccctttatctctcctctc

SEQ ID NO: 44786 - DNA, 1107 bp, Heterodera glycines
  misc_feature (60)..(60): n is a, c, g, or t
  misc_feature (71)..(71): n is a, c, g, or t
aaggaaatagtgacgatttcggaattaatgcgatttgatttgctttttgagcatttctancagagaagttnttcggcacattttccttctttgctcctatttttcaaccatattaatcactagggctgctcgggattcttagtttcggttctcaagccgagaaatttctcaggtttttggcgtctcggacccgatatttactttctttttgaatgagaaataaaaattttaaaaattacttatcgacttttcagtggaagaaaaaatttgtgtaaaaaataaaattgttatcaatgttttaattatttgcatagaaaaaaaagcaaaaataacatcattgtttagctattttcgcgccatatttcgtaattttttaaatttaattttttgaatctgacaatataaccacgattttcaaatcagatggcaacctacatgactaaccaagccaattactcaaaattttcaaaattgactataatcctcgaaattgtaattttgacaaaatctattatttaattttattaactaattttcggcgcgcctcaaaaaagacaaaatgaaatgttttaacaaataaaaaggaaatcaaattaaaaaaatgaaaaagattcaaagcaaaaatatattataggaaaaaaaaagattttttaatgaggataaatatgaatgcctttgatttttaaaattttcttcaattttcaaaattattagctgaattggtaaagttttggcaatttgaaaaataaaataataattttaacagaatgtcatgtttttttaatttagattattgtgagaaatttgtgtaaaactaaaattttgaaaaaaatctcagtctaagcttacggaaaacttcgactctcgagaagccttataactagagttgagcgggaccgggaattttgggcaaccccgggaccgggaccttttcgggttgaaaacccgggaatttttggctgggaaaaccgggaaaaaaccgggacttaggtacgcagttgtccgtgtttaggtcccggtcccgctcaactctacttttaaccctacaaaatatgctgcgtctcctaacttggggactgttctggagattggtattcactacagaaa

SEQ ID NO: 44787 - DNA, 1486 bp, Heterodera glycines
ttacggggcagctgcctcacgagccatgcttttgcctccctcctacgttggagctgtggtataccgctcagtgctgtacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtgggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatg

SEQ ID NO: 44788 - DNA, 1034 bp, Heterodera glycines
  misc_feature (15)..(15): n is a, c, g, or t
gtccaaacggacacnttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcggaatagcttccctatagcctgtactttattctgccgtggattttgctcccataattgttgagtacccaaacggacacttgaaaaatcgattttttgttttcggggcagtccccc

SEQ ID NO: 44789 - DNA, 846 bp, Heterodera glycines
  misc_feature (54)..(54): n is a, c, g, or t
  misc_feature (101)..(101): n is a, c, g, or t
aatgccatttcgttttgtcgcacttgcctaaaagaaccttcactggccatctgntgttgtgtgctgtgttcggctttttttatgatgggactgattttggnattcttttcccattttggcacatttcattcacccgatttgacaccgtttcgtcccaaagttaggaaagtgacgctgttcttgagaatttatgcgaaatttcaagggttcgcgtgtcactttctgcgttgtttggttcgggtgggttggcgtttcgtcgctttgacgggaaaggggcgggggagggggacaaaggggcgggggagtacggccacgcttcggcttcttctcctcccaccgttccttgggctttttcccttctgctgctgtttcgctttcactttcgtccacgcgttgcagcagtcgcttttcctcctcttcctcctcctttgcccattagcagcaattagttaatgaggggggggggtggtgttaatgatgcttcttccccttcttctgctgcttcttcctctgattgatgttgttctgcttcttctgcttttgctcttctgtttttgtcctttgctgttccgttgtctccccttttgtgcttattattaattattattaatgttttgccttttctccttcgtcttcccctgcttcttctcccattagcattgtccgatggattggaaaggtgcgattgctgcgcacgtcttctgcctccgctgcttttcctactggttcctgttactttggctgaatcgtcggcgaattcgaggagaagaagctttcattgcttctagcgatcgacaataaaaaaaattgagcatggacacaatgtgagggggagaagggggactc

SEQ ID NO: 44790 - DNA, 811 bp, Heterodera glycines
aacccatggagccatgttttcacgacttaagaaaacaaaaaaaaattcgaaaaaggggggacaaaccaaagtattaccgcgaactcttcttcgagtgtcgccggctctaaaggatttacattttattagagtttttggctctactcctgtttacgtgtcctgtcctttctttgctgatttgtaaggattttttttttgaattatgacaacgaagaaaacgaatgatgagaagctactgtggtgattctatgtgattgatatgaaaaaatataaatttagagtgattgaaaatttgaaatattaagatttaaaacagaaaaaaagatagaatgatcttggcgcaaataatcggacaaattggctacagtttaaactgaagagttaagatgaagagtgaatattgtcttaaagtttcttaatttgtctatttaaatttcatttttgtaatatttttgggtttcccaattttcacctttttctttaattaatttgcattattttttgaatgaaccgtgagaattatttatgacagctgaattcaatttacagcattaaatttccgcttggtttggggtgtctatgatgacttttacaatccctatttttgcctattttcaggatttttgaataaacaataataaaaggaaacatacacccctaagaaatgacccgcgaaaattcaaaaatacacccctaagaattaaaaaattttctcaaaaattgatcgatataataattattgtttttttgtgaaaagtttttgatttaaaatttgtccgtattcgaactaaactcataaaatatttaaaaa

SEQ ID NO: 44791 - DNA, 584 bp, Heterodera glycines
ctattttttggggattattcgctccttgaaagtctgcatactgaaataatacgagaaaacaagaaaattctaacatttcaagaaagttacaaaggaaaataatcaacagttaattaataaatcaaatcttttttggaaattgcctgaatgttcgaacatgaacaaggtgattgtataaaaacccgggattgtcaattgattggactcataaagtgcattagagcccaaaaaaaacatcagattgcgtgaagaacggaaattcgcagtgaaagtgcaacggacgcgagaagaaagaaaacggaaggagaaaaggaatttaattgaggcgacgaagaaacaccggaaaggcatgaaaggacaattggaggaaatgctgaacaacaccaaaggggcgaaatgggaggacgacgaagagggggtgaaaaagggggggggagcatcaagaaacaaatgccaaccgaacattttagggcggaggacgaaaagccagctacaaacttggacgaaagggtgggaaaggttcagcaaccgatggcaggaaaatgagcagaaagggcagagacaaaaagttcggattcggggga

SEQ ID NO: 44792 - DNA, 1119 bp, Heterodera glycines
  misc_feature (102)..(103): n is a, c, g, or t
  misc_feature (1044)..(1044): n is a, c, g, or t
  misc_feature (1053)..(1053): n is a, c, g, or t
  misc_feature (1063)..(1063): n is a, c, g, or t
acattggtgcaatttatacaaaaaataatttaaaaaaaaaggatgacgtgtttttttaatttttttttgcattaaaaaaatgaattttcaaccttcgcccgnncttttgaatcgcgtgaatgaccgggtaacggtcggtgggccaatgcggagagataacacgccggaaaacggtatggaacctgaacaaaaaaagatttttatagcagcgtcgaaacaatattttgaaaaaaaaaatgggacataaattggttaccatgtgatcgcctcatctgaatgaaaattgcgctcctccttcagcgttttgaccaactgtttgggcgtgcttggatggatgagacaccatctgcaaaaactggggttaattcagtaataatgcaagaaaattttggagaatttaatttggattgaaaaggacaaaaaaattcggcgcgggattttggacgagaaaaatgccgagtttcgagtggcaacacttgatttgggacttcaacgaaggcaaaattaaatttgacaaatgttggtggaattttcataagctatgatgcccaaaaattttataaaaatataaattttcaactattttcaccaccttttttgtcccacaatcagtgcgttccacgcggatgtgcccagcgggtcaatgtgaattgcggtgcccgaccgggcaggtcccatcacaaaccaactgaaaaaaccaaatcaaaaaacgcgaaaattttaaattttccgtaaacttgtaccggtaggggggcctgcgtcgttcggtcgcgtaccggaacaagtcgtctttgaacatgggcggcacgctgtagtcagacaacagtttgcttgtttttgtgcgctttaaaagtgtgtgaaatttgcgtttgttccatcaaagaatttttacattttgatagaaattttcattttttggttcgaaatgtaatgcgtttggtagtaaaaatttgtaccaagggatgtaatacggattcaaagttccaaaaaattatttaggtgtcgaaattactaccaatccccttaaaattgtacacttaattnaagattttnggtcacattntttccaagggtcccccaaaaaattattatttttttttggtacaagaaatgcacaaa

SEQ ID NO: 44793 - DNA, 948 bp, Heterodera glycines
cccactccctccgccgttcatttcatttgtctcatccccacctaatctcggaaatcaccgcccgtcgtcatccatcgctcaatgaacttttattgcaatctctgacccattgctaaatgacgttcctccgatcaagacatttcattattctcttctcaaaaagaattatgcaatacttatgtacggcggagggagcatatggcgttgagaaaagcaaatttaaaattagtaaacgaacaaagggacaattgattaaggggaaaaggttgcatatttctctgatttttgagtcgaaggaaattattgcactttaaatatttatggtttggttaaaggtgaggaaaacccaagaaagaatttgaaagagataaattccggaaatagccaagaccaaaagcatgtataaaataaaataatatgcacatgtattgttactcagggaacgaggctgccggacgtcattatctttttcaaaaaagagaatttcgtgggaggattaccaactggtgaatccaataattataatttgtttgttaaactgcaattaaaagagcaataagcaaaaacgtgggcaaaaaatttgccaaagtcagttaattaatttaaggcaaaatatgtttagtattatttcatttaagtaaataatagaaattgtcaaaattaaattttatttgtttaaattaggtttaaatattttttttctcttactcacgctgcctttaattaatgccgcggccattttcctaatcacttggattaatgcgtggataatcggtaatggttggaaaaacagaaaggctgcttgtgccggaaatgtgtgccgacgacgcaccgttgcccaaggaacggtgcaaatgtcaacggaggtttatggcaggcgaaattgtggaagagagcgagcaaatggcgaggagagggaaggaaaaggaataaataattaattagcag

SEQ ID NO: 44794 - DNA, 811 bp, Heterodera glycines
agcagcagacaatgccgttgatgaaaatgagcagacggagagacccttgtttgagcagctacagtactatgtgcaccgggtggagcgtttcgcactacatcgacacgttacggaatttgtgctcaatggacaacatgatgagccggaagaggcacttctcaccgcatttgagcatatcatcggacaagcgatacggaacgcagaggccaaaacagagcaggatggcggtggaacttctggccctcggcgacgcgtccttaaactaggcgttttgctaaatggaaaaggtagtacaaaaagaggacctaattaattttacatccatccatgtaggacttaccgacccaattgtgttgccggttcgttctcctgaacaaaacactgctgaagttctgatggccgagcttgacaaattgggtcagtcggacggcgacgaggaagtccatggtggtgggatcagcaaacgatcgttgttgctcagtgagccgatcgaaattatcgtcacatgcatagcacctcctgttggcgcagcaccgcgcttccacccataccagcattggggatatgatgaatcgcatatgatacgaattttcaacaccggagacaatttttgcctcttccatgcgctgattgctacacgtgcctacactgacgctgagtttttgaagtcaaccgttcatctgcaagcagttgaatgggggccaaattcaaacagtagtgatgtaccagccgatattatacaacgtgtgatgaggcgagtggatttttgctctgaccacaaagcgctgaaccgactgatgtccaaccggga

SEQ ID NO: 44795 - DNA, 1022 bp, Heterodera glycines
aaaattttttggggaaaaaaaacttttcaaaataatacccctgggagaagggagtgggaaacatgattccaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaaaggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattattaaattttaaaactttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatct

SEQ ID NO: 44796 - DNA, 1070 bp, Heterodera glycines
tttatattattattcatcattttttcatgcacatttcaaaggcaataacatcagtgagttaaataatcaaggtaattaatttgtctaatcatttttaattagggagaagacaaaatgctaattacgtttgtgagaaatgatcataaaatgcaaattagtgaatattcaaagcagaaatatggggcatatcttggcattgtgtattttataagaaagaattggcaatgtgacaaaattagcgaggaacttgaagaatataaacggacagaatatcaaaaaaatcgcagatatttggacattttgtacgaatatttaagtagagaatatgctggatttccaacagtgaagccaatatttgtcattaaaaatcgaattgaaattgaagcaccaataatttatgcgatttattgtttggtccgaatttcgcaattttgttttaaatcaaaatggggtaatttttatgaatataaattaaataaattctttaataatgattatgaaccaaaaatgctgaatgaggagagattaaattatgcatttaaattggaaaatgaaccaaaaatgccaattaatgaaataattttgcaattggcaattgacacagcgaatgaatgtcaaacaaatgaacgtttagatggaataattagacaaaattttgacgaatttctgagaaaaatgtttaaaaaagcggagggaagggtaaaaaattacgatgatcggttgagagtcgcaaaaataaataatgacaaacacaaaataattgtgggttcgaaattcgatgataaatggacatgggtgagatttaacatttaattagaattagtaaattaaaaatttagaaagttaattagaattaataaattcaaaatttagaaatttaattagaattaataaattcaaaatttagaaatttaattagaattaataaattaaaaatttagaaatttaattagaattagtaaattaaaaatttagaaagttaattagaattagtaaattaaaaatttagaaatttaattagaattactaggaggaaatttagaaagttaattagaattaataaattcaaa

SEQ ID NO: 44797 - DNA, 1256 bp, Heterodera glycines
ctgattgaattttaaataagctcttttaattgtcaaaccccaccaaggcaattctttttcgatccattccagaaaagaagacttctctaaaccaaccagccaaattttgcaaaagttcttcctgaaactaatcatccatatttaatgtttttaaattcaaaattgataattataagggataagaaaaacccagaaatattaaaataaagcttacacaagaaaaggcataatatttgaaggttcgaatattagcaatttgaataaaaaggtaaaattaaaaatgttatttttcatattttaatgatcttgacgaaacatcattttctgtgtataaaaacatttttacatatttatttttcacataaaatattatgttttttttaattttctgtcaagaattttcaagttttttgaatattggaattgaaaattttgacccttcgtggtgtatttttatttttgtttttatttcattttttaaagaattttgaaaactcaaaattctgtatttacaaaatattgactcaatccctaaattatagagttaaattagcatttaaaaacaaatgtttttgtcatctcaattaattgccatttcaacttgcctaaatgttgtttttttgacaattttctcggacattttgcaattttcttggtaattttccgggtataaatgcgtctgaatgcttccgcctcgcctgtcaatgtcgtagaccaattgcatgcgaatgcgactttcgacaaactgacagaatttggcagctccaaatttgctctcggacacacaatttattaaaatgtaaaagtcatactgaaaaaattctttcaattgagcttttcatattaattaaaataagaatattggattttaatggtgaaaaaataacaaattaaaattatcaaaaaaacaaaaacaaaaaaaaaataagaaacaatgaaaaagtaaaaaacaattaaataattaaaatggttagttatttttttagataaagaaaatttccaaaatttaaaaaattaatttaatatacataattgattatcaccattttattgaaatgttctgctgaattgcttattaataatgaccagtcagtgtttccaattgtaatgttttgaatacgatccaatgcttaatatttattaatagatatttttaaaaatatttaattcaatttaacactatttttatataattttcaaaataatttttttatcaaaatttgtgaaccttcgtgcatatttttgatgataactct

SEQ ID NO: 44798 - DNA, 903 bp, Heterodera glycines
agttcacatgagcaccgcatcgacccccatatccacgccaacgactgtcctatcccagtccttcgtaatcccaaaatactcggcatcacatttgacccacaggtcacctttaatgctcatgtctccactctccgcaccaaacttcaaaaacgcaacaatatcctccgtgccctcgcaggaacaacctggggccaatgcaaagaagtcctctccaccacttacaaagccattggacgctcattactaaattatgcagctccaatttggtctccccagttggctgactcccactggtcaaccctccaacgctgccaaaactccgccctccggacaaccactggctgtgttactatgacatcctctgaacatctccattcagaaacatccatcctgcccgtcaaagatcacaatttccttcactcacaacaattccttcttgcctgatatttctccgatgcattttttcattcgttttcctttctttttcctgtaatgaaaaaacccttccgttttaattttcttttcgtccactaccaaatttgaggctgcgtcttccgttttttccggagacattttcccaatttcacggtcattcgtttggacaaaggatgcagcggcaagtgaagaaatgccctcagggattataacgcaaaaagcagtgccaacgagaagcccagcgccgaaaatgctcgctatccgaactttcctctagaaatgaattgttcatactaattcttcaccaaaaagcacctcattaagcgaaaagaataacggaataaatccagccaaataagagccgataaacattgtcagcgaaatcaccgcgaggattggctcgtccatcatttcttatttatcaattacaaatatttataataaaaatgattagagaatcgtgtcgaa

SEQ ID NO: 44799 - DNA, 1119 bp, Heterodera glycines
  misc_feature (76)..(76): n is a, c, g, or t
  misc_feature (93)..(93): n is a, c, g, or t
  misc_feature (132)..(132): n is a, c, g, or t
  misc_feature (141)..(141): n is a, c, g, or t
  misc_feature (152)..(152): n is a, c, g, or t
  misc_feature (158)..(158): n is a, c, g, or t
  misc_feature (163)..(163): n is a, c, g, or t
  misc_feature (169)..(169): n is a, c, g, or t
  misc_feature (186)..(186): n is a, c, g, or t
  misc_feature (236)..(236): n is a, c, g, or t
  misc_feature (278)..(278): n is a, c, g, or t
ttctcaaaattattaatgtcccaacaaggagaattgataggattatttagtgaggattttcccctggaattagagnattttatagttttgatnatttaaagaaaaatatagtagggagaaaagttggataanatttattanggatgtgaggnatgggntggangaaggnatagaaattttagaggngaaggagggaaagtggggtagatattgggttggagatattaaggaatggnaaggtgtttgaattaaatgtagaaatgtttgtttttattatngttattaatttaattaagttcatttctaaattatcagtccgacactgttcgtgccgagtttttgcatgcgcttgccctcagacatgagcaagaccgggacgatgccaacaaatacatcaaacggaatccaacaccacgaaatgttagcatgaattttatacataaaaaacactggcaattttacattaaaaatctggcataatttaatattttagcaaaaagagccggcgaaaacagaaaattacggctttccctatgattttcattcaattttgcattatgctgctgtgaaaacaagcgggtcagttattttaaaggtataaatgaaaagaaaataatttggcaatgaatcagctattacgacatgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgttgaaaacaaatgccaaaagggaggatatcccaacccaaagaattgcaaccaatgcctgtgcccggtgggatacggtggagaaaaatgcgaaatggtcgaaaatggtaaaaaaaaaattaaaatgataaaaattattaatatttcagatggaaattgccaaactgacagggcaaatggaattgaagcagattggcaaatcgaacgttgaagccaaaagtgagctgcacaaaaaggatgagtcatgtggatgccattggcaaataaggcaacatttatatgaaatataaaaaataaaattaaaaaacgaaaacaaaca

SEQ ID NO: 44800 - DNA, 980 bp, Heterodera glycines
  misc_feature (10)..(11): n is a, c, g, or t
ttcgatgtgnnccgaggaaatgatcacgcggaggtcgtcgcgaatggcgacgattttgcgcaggaagccgatgatcaggtccgtgttcaccgaccgttcgtgcgcctcgtcgacgatgaccacggagtacgcctgcagcaacgggtcgctcatcagctcacgcaacagaattccatcggtgacgaactgaagaagaggcaagaaatggcatggacagattgggaacaaacaatcggacccgttcaaaaattgccatggcatgccaaacacaccttaatgtgagtgcgtgccgaaatgcactcgtcaaatcggaccgaatagcccacagcgtctcccagccgacacatcatttcgtccgccacgcgactcgccagcgaaatggcggccacccgtcgcggctgagtgatgcaaattctgcgcccattttcggcccaaccaaactcagtcaaatactgaaaaaaacagtagacgaccactcaaaagtgatcagagaataggccatgtttctgtttgtttgttatttcttcaattacttgtggcaattgcgtgcttttgcctgatccggtttcacctgaaattgaaaggatttgtgggtttaaagaactacggaataaaaaccgaattgctaacggttttcacttttcaattctaagttatttggcatcggacaaacaaataaacgccatttggttagttcccaagaaatataatacatccattggcttaaattgctgctttgatgacttgtaattgctcgccaaacaacttttgcgtgttttagacattcttaaaagtagaggtgcgcaacggagaaatcccggaaaagaagtctcatttcgacttttccgcttggattggctcaccgacgacgaccaccgtttggaagtgttcgcaaaggtatagcaaatggttgcgacactttgcgatgggcagtcgttggcgctgctgctgtagggacatggccaagaaggggttgtggc

SEQ ID NO: 44801 - DNA, 368 bp, Heterodera glycines
ctctagagtcctcaggtagtttgacagggtaattgcctatgtattctcccaccagaattcggacgttaaaatgttgcttctatagaaccctttgtggtgatttgtcgcccgcttagccatgggaagggctgttcggagatcagtctcagccgagtgcccaatcgccagtcgcgtgggggccgaagggaactgattttctgcaatttagacacttttgtgacggctctaatgcatttataaggccataaaaatattgacaacttcttctttcacccaagcttcaaaaacttattgtcaaaatgcacagaaaataaattttgatttttatggtcatagcttttttgaaacataacgaaattcggtacttg

SEQ ID NO: 44802 - DNA, 1104 bp, Heterodera glycines
atatttagatttttcgaccctggtttttaaacaatgaaaaataatcatttcgtaaaaactagaataatttgtataaattttagaaaaacaaatattaattttttattaattcgtaaattttaaaatttttagaccctatttggggacccgacacttagggaacccgacatttacgggattttaataaaacaaaaaatatatttaaaaatttaattttaggcacaaaattagacaaatttatgtctgctttagccagcgttaattccattgcaagaaaagacaaaatttggttgaaggctttgatgccattgaaaacccaaacgatgatgatattcttacttaattcagatggcagggctggagcgcggacagaaaatcccgcggtcgcggatcgcggaaaaaaatgccgtcgcggtcgcgccccacccctgtcataaggtcttcgttgtagttttttgtcccaactttttttgccattttcctgctgtttgtgccggtgatacgacatttgcggcgcccagcaaaaaggacacttgcggcgaagaaatttgttttttaattgtttttgtttttaactgacagaaaacaaattttatttattaattaataaaatcctattttagttttaaattttatttctgattaacaaattattttaataaaaagctcattcccattcctcaaagcctttcatccctattcgaaatgaaagcagaaagttagaattgtacctttgtagttaattggccccttttctgaattttatcataacaaattgttaattaggtgaaataaaatttttttaattaaataaataaaattatcccattttttttgccgttttttctgctgtttgtgcccttctttttgggtcatcgtttgcccaacactcaaaggcaaataaaactgaataaatgaacgataaaaactctgaattatgagaacaaattcaaatatttattatcttttttttgacctgtctatttgacctccccctcctccaaggtcatcattttgccgaaaattagttaaaaatgaaggaatggtcatttatttttatttctctttttattctttgtcatttattcaacagaaaccattttt

SEQ ID NO: 44803 - DNA, 847 bp, Heterodera glycines
ctaattgcattattgagggggaggagggggggggggcctccacaggttctttgagttggaagggccaacgggcgacgacggacagcggcggagcgaagtgaagtggcacagacatcgacctgactgactgactgacagcaaaaccatgccattcggtcatacaaaacccccgggggcgaagcagcaaaacgaaaagcaataagcctcccgccttcttttcaattctttagtccattcgatgttcatttgctcattctcactccaattcagccgggtgttcctttaaaaaggatatgtccgaaatgccacaccctccgctgccggggaacctccaatccctccataatttatgcagaatggcatttttgcccttaaataacaatgcgctgtttgatttaatatttgccctctttttcattcagcttctccttgtccgtcctcgtcgctttccacgccagcggaagaaacgatcagtcgttttcattttgacagcagagaaattccgaccgcacaacggcaccaaaatgattgtccatcaatcgaaaatcagtgccgtaaattccctgtcggtgcgctaatcgccgcctccgacgcatcgaagcgaaaacaatgcaaaaatgaggacgacgaagaattgtttggagattgcgcaacaattggaggggacagagcagcaaaagcagaagagggggaagagaaggacaaattaatgacaaaaggaagacaaatggaggagagaatggaagaaaaatgggagaagagggaaacggaggaacggaagcgaaaggcgagggagagggaatgccctggggggagagagacggatgccaaacaactacaacaacaa

SEQ ID NO: 44804 - DNA, 1446 bp, Heterodera glycines
cacttcacattgtaaaaataaaagtcgaagccacatttcacgcaatgaacgtgttccggtcctttaaaatcaagtatcattaatttattcaccattttgattaacaggcgggctaatttatatttaattttaataaaaattttatgtaaaaacataggtttagttaaaattaaaactaaaaatcctaaacataatcatttggaaaataaaaataatggtttgttaaagagaagcacaaaaattgatcaaactgaaaaaacaggcccagctcggaatgattaccatgatttccggtgcactttaacgccttatcattttgcgcctgtatttctttttgtagattagaagtcgaagttggtttttttgttggggttttgtaaggcgcaatttggggtcgttttggcatgattaacacaagaaagtttaaaaaatattttaaataaagttgctaagaaaaaagatttatctgagatcgttatttaaaaatcagtattagcattttattgaaattttttatgcaattttttgttctaattccatttttaattataacaaaaattcctgcctgtttattactcaaaacacccaaacaattttcataaaattcttaaaaagtaggcaaaaattatttatttttgtcgttaaaaaacgaatcccagacgtccagcgccaattaaggcgcctagcctcatcgcgcgccaacaaaggcgcgcgaggctacgaaaaccgcatgcgaatttttggattgaaaaataaataataaataattattatacaaattaacttattattatgactttcaaaaataaatgattaatgagctaagaaaatgttgagttaacggcccaaaaaaacgtaaaaaattaacaaaaaaagaattaaataaatgagagaaaaaaaggcaccataaatcgtgaaacatggacataaaatagcaaaaaaaaagctataaactatggagaaataaccacgaaatcagcaaagaattgtgaataaaaaatatttcactttatagttaattaatggaaatcactttaaatgtgttagatttatttgaaaaaacattaaaatgactatttattttcaaaatatgtattatgattaatctaaatttaatttattttaatgagaaatagcccacaaaatttaggggatagaatattaaaataaaaacaaggtggagaaattgttgcatcggttgtggcgtatggtatgttgtgtgtgtgtgtgtgtgtgtgtgtggaaaagagctgaatatgcgaacaaaaaatgattcgattggtctaagaggaaggtcggctgccgcaacacaagagccgatgagaaaaaaagcacgtcgcttcgattgattgggggggggaaggtcggctggcgcaacatgagagacaatttggcgaaagagacaaaatgggagaaagggaaagaaatgaatttaagggggggggg

SEQ ID NO: 44805 - DNA, 1337 bp, Heterodera glycines
ggagggtgtatttgctgcgtcgaagagaaggaatttgttgtcgctactgatgccgaaagaaattggccattgcgcaccgggccctcttcccggttcgtaatcggcgtcctccatgacggctttttgcctgttttttttcaaccatgaactacagaaggctactctaaataaggtagcaataaaaaattaatgtataaaaatgattggttcaaacggacgcaattttgccagcatttatgcggtcagaaacgagcagcttgaagaagtgcagcacaacatctgaaacagtagtgttcgacaaagcgatacaaagtcctgtgttgttcccgggcgcagaaaatttcgaaaaataatgctggccgcaattttgccagcatttatgcggtcagaaacgagcagcttgaagaagtgcagcacaacatctgaaacagtagtgttcgacaaagcgatacaaagtcctgtgttgttcccgggcgcagaaaatttcgaaaaataatgctggccgcaattttgccagcatttatgcggtcagaaacgagcagcttgaagaaatgcagcacaacatctgaaacagtagtgttcgacaaagcgatacaaagctgtgtttttccccggcgcagaaaatttcgaaaaataatgctggcgaatggtcaaaagagcaaaacaaaataagaaaagcttttcggatgcccttcccgaattttttttttctggatacaaaacgaatggggacggaacaaaatatctccgccgaaatatcgccggtcgaaatatcgccgccgaacattaaattttttttaaacctagaaatttttcataaaaaaaattactaggaaatttcttactaagaaattcaagaaaaaattttttgaaaaacttatcagcgcttttttcgaaagtttatgaaaattgctgtttttttttgaaaaatttgccaaaaaatttttcaatgattttttcaggaaattttcttataaaaaatttcttaagatttttttcttggaaatttccaagtttggaaaaaaattttgaatttctgcggcgatattttggggtgtacccaaaacgaattccctcccccatgattcatttacttctactggtagtgtaactaatcattaccctccggtagatcgcagtctatcctaagcagcaacgagagaagcgctttcaactatgaaaaagtcatcctcactcctttaaaaggaaccaatttaatgaaaacccaaagtttgcgaaattttcagcccctccttttacgtacgtaaggaaaagatgtcaaacgtagatgaatcggaatacccgctgacgcattacgtttgaggcatatatggaca

SEQ ID NO: 44806 - DNA, 934 bp, Heterodera glycines
aatatgcgatggatcgggcgaactgtgcactcctcggcggatgcattcggcggaggcgtcgccaaaaggtgggaaaaagacaaacctcgggaaagggccatttctttaattatttactcatgaaaaattcattttaagcgcctttggagaggccaaaagatcattcgcctttttgggccatgtccgagcgttggcttattccctccttggcttcccaaacacactgactgcggatgacatgaacgaactgagccaaatgatcaaacatttgaggctgagacgaaattccgatgggagcgaaggagaggacagagacgaggaagagaagtgagagagagcatgaaaatggggtgggggaaagaagggagagaaagggagggagagagagaggggggggggagagacagacagcgaaagagaaaggaatttattagcttttaataggctaccgtaataaaataaaatgagtgatgggaaaaggataaatgttctccaattttcttttacaactttaggtctcctcctctgcccatgttccaatacaatcggtcgacttcgatcgtttgccgctttattaacacaaaaaacaatgttgaatcgggtgctgatgttttttgctcaccattattactaaatgattattcttattccaactaatgcccgacaaagccaaatttaaagtgtggtcggggagaccgaccgacccatcgttttggccaaaagcccctaaacatcgcggtttagtctttgcttctcaaccaacttgttaatggatactttcctaaaattcacatttggtgtttttaaagactgatttggcagcttggtccacatatcctcatctagtcacccaaaataaattctttttattggtaatgattaaaatgtataaatgcgactggttatgtgtgttcgtttttggtttccctcgtcg

SEQ ID NO: 44807 - DNA, 1145 bp, Heterodera glycines
  misc_feature (17)..(17): n is a, c, g, or t
  misc_feature (222)..(222): n is a, c, g, or t
  misc_feature (1068)..(1068): n is a, c, g, or t
cacttccatcgcctctncgccgtcgtcctttcgcgtctgttgcatacgctctccttctctcgctgcagtttgtcccggttctgcagcttgcgcaccaacatactcagcgtgtcctcccgcagtccttggatgtcgcgcaacgcgttcggatccgtcttctgcatgatgttggcctgtcacgagaaaggggcaatgaggaaataaagacaaaaaatttaaatntaaaaacgctaagataactaacaacaagattaggtggactttctattccaaaataatttttcttacttgaaaatctattgacattatggcagttttgtattgaataaaaggtccgtaggaacgtgttgtaccttcaaacgcaacagtccgtattcgtccgccagtttgagccgctcgcccaccaccatgtcagtctcggtcgcttgcagcaaacactgctcgcacatcgcagtcactgtcggaatgaaatacatgcgggcgagttcgagcagtccgcgcgtatttggcactagaagaaaagggaaataaataaattgcaatatactgaagctactttagaaattgaaaaacatttaaatcaggattgggtctccccctcctctaaaaccccgaaaataaattaaatgaatgaagacttaaaaaaagttcgttgggtggtgcatcccactccaattatcttggataaactgtataaatgatttttctaagaaaaataccatgcggacgcttgtgactcgggtaaatgatgtacaaaaactcgcggaacacgtccggcgacacggtcttcagctccacttcctgggtgcgctgctcgcgaaagccctcactgttgaacatgcgctcgaagccctcggaaaacattgaaagcaactgcaaaaaagagcatttaaaacgggatttaagtggaaattttttttgttgttgtttaaatttaaattcatttcccctccatttcccacaaaaaaagcatacttctttgttgacgtaaaatttgtgcttgccatcattgcccactttgacaatggcgttggacgatgccgaaggcttaccaaagtccaaaattgngaagaaactgaaacaaaaagacggtgctaataaacgccaattggaaaatatttttgcatgaaaaatggttttgcaag

SEQ ID NO: 44808 - DNA, 927 bp, Heterodera glycines
tcaaaccgcactgatcgtcgacatttgcatgctgttctccccacggtacggcgcctttgaagccgcacggaacgaaactctgcacaaatacgacgaattggcacaacacctccggcaacagggcctgaccgtgttcttggatgcgtttgttgttgggccgctcggtgggtgggatccccacaatgaattggttctcaacagaatgcacattggccaacactaccggcatttgatgcgcaaactgatggtgtccgacgcgatcaaatggagccgggacatttacgtggagcacatcaccggcaccaagcagtacaacgactggccaatggcagaaaatggagacggagacgaatagaggggccatttcctttttcaaattcttttgtgccaacagaagcgatccatttattttgatcagtcattttttgcctcacttccacatctattgctcacaatggatctctcattttatctgcccactctcgcaaatttctatgtgcactgatccggttgaccgacagttttccattcatctgatcatcaaatcatttatttgtcttttccaaacattctcttaaataaacttaaatctgttctttacggcttaatctccgtaacgacccctaccggggtcaaagagattaaccaatttttggaaaaaggtcgcagtagggggcttgccccctctcgaccgcgcgtcggcccggtattgcacttacctccgggagcggcgcatctcccccgcgggggagatcaaaagagcaaaagcattgggtgaagcaatgcaaatgccaggggattgattcttcacaattctgcctgacaattttcatttaaggggaaaacaaaatcccatcgatcgccaatcgtccatcccgtcaacttaaaagggaaaaccaaatcccatcgtccatccatccgtcgaaa

SEQ ID NO: 44809 - DNA, 625 bp, Heterodera glycines
ccagagtaaacagcactcccccgatccgggtaccagacccttaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatggataggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctcccgcttactgatatgcttaagttcagcgggtgttcac

SEQ ID NO: 44810 - DNA, 1342 bp, Heterodera glycines
ttttatgaggtttattgtggttttataatgttcaaacttaccaggttattccagaatttctggaaattttcgattttccctaaaaaaattcataactcggttctgaaaggtcatactgtaaaagtaaaatactacaaaaatccgcaattttttgctctattatataaattttatttggcatttttatcacttttttaagaattgttataaaaataaaagtgattttgagattcgggaccaaaggggggtgaccaggatttttgagtggaaaaattttttcaccaaaaatcttccaaaaacatgtctttaggggtattttatgacgctgatcacgaatacgtgatcagattttacttttgacatcgttcagacatcagaatccctgtgtgattggggattctgaggcatcattttgaggggggggggcaagttcgaatccgggcggtgtacattatttttgctatgcatttttggttatttttaatgtttttaattcatttaaaagagtgtttgttttttaattaattttttaatttaaattaaattatttttttgtgaaaaattttttaaaattaattttttgtttgattaaagaatttcatataggcgaagttcggacccgggcggtgtacattatttttctttgtatttttgggttatttttaatgttttaattaatttcaagatttttataaattatttaatttatttatttaatttcattatttattttttgaatttataaaaaatgaatttcatttcaaaataaatatttaattattaattttcaaaattatatttaatgaataaaaagagtatttattataaaaaaattttaaattaaaatgcaatcgatttttataaaaacttttcattatttatttaattttaaaccatgttgtacctcttctaatcacttttgtacctcttctaatcacttttgtacctcttctaatcacttttgtatcttttatcacttttgtacctctttaaatcacttttgtacctcttctaatcacttgtatcttttatcacttttgtacctctttaaatcacatttgcacctcttctaatcactgttgtacctcttttaattgctgttgtacctcttttaattgctgttgtacctcttctaatcactgttgtacctcttataatcacttttgtacctctttaaatcacatttgcacctcttctaatcactgttgtacctcttttaattgctgttgtacctcttttaattgctgttgtacctcttctaatcactgttgtacctcttataatcacttttgtacctctttaaatcacatttgcacctcttctaatcactgttgtacctctt

SEQ ID NO: 44811 - DNA, 1284 bp, Heterodera glycines
  misc_feature (626)..(626): n is a, c, g, or t
atttgaatcaatttttcacgaaaattgaatttgattgctacccttcaacaaattttcagtaagagaatttataaaaaatggctaaatacccttggaattaagactaaaccgaaccaatcatatccagtaacatatcttgaaaaatcacgtcagtttggacccttctgtacaaggccagagcccgtggtcacggatttgttattagtatttgaaattggcaaaacttttccattctttgggcagctggacaacaatgacaaagtacagtaaaataaaaaataatttttatgataccgtatttcttgaaatatagcccccgggggcttgatcttgggggctttgtttcaggggggctgtattcagggggtatctaattctggaagggggtctctatttctaaaatttttaaaagtgagtctttatttcatggggtgtctgatttagaggggggctttgtataggaaatgccgtatttatcgatttaatttttatataatcattagggttataatttgtatgattttgcatatttttctgcacagctatgaagaaaggggctcaaaaatagcatttctgcgttaaaattttttgatttggtgaaggtttttagtgcatataaaagcatnattttgggggtttttgagaataagtgcatatttggccattttaaactttgaaaaccaaaatgttttacaattgtctaaaaaactctccttaacctatgttttggagtttttaaagtcaatctgaatttttacacaattttggtatttttttgaaggtcaaaagccattttttggcagtttttaaggcatattttattgcatatttgggcatttttcgggttttttagggcatttttgggggatttttagtgcatattttatgcgcatatttggaattttttagtgcatacaacttataaccctaataatcattcactttgaaaagattgccttgtgcattcagtgtgagtgaattattattattaaacttaatattatttaatttaatatttttggaatttcagtgcatgccattcaaatgggtgacaaaatgatgcgttattccgtgcagccatttgcccgtttaaaactgatcaatgaagaatttgtttttgctcgggcgatcatttactcacacatgggtcaaaatgaccctccattttttaaatgttttattattttaagtgtcgccaaggcttagtgatcaggcacaaaaattgttgcgcagcgaagcggagaaatacgctgcattattaatgagtgttgtacaggtgcaatt

SEQ ID NO: 44812 - DNA, 1044 bp, Heterodera glycines
gatttttttgttttcggggcagtccctccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatattttttacagaaagtgctctaaagcgcaccaaattttatttacaactgaattttagcactctgatgctgtttctatctataagggagatgaataaaattaaaaaaagagtgaagtcctggctaaacaggacaaaaattttaaggttgtgtggaaagagtgaagaactgggttcctccagacaaaaaattctaagaaaatatatgaagcattagaagggatctcagcagggtccctgcaaaaataggagagcttctgatcagtctagaacggtgggtgaacaaatgcaaaaaataattaaagaaaaataatgctggtgtgggaagagagaagaacggcgttcctccaggcaaaaaattctaagaaaat

SEQ ID NO: 44813 - DNA, 461 bp, Heterodera glycines
acacacctccttgaaactgttgagccaagctatgtttccttcgccgtccaattcttcgcaaaacaatcgcttcggtttcccgtcttttctcggagtgttcaaccattcggacaacacttgttcaacggaaatcccattcagcccatcatcatcagcaatcacatcatcaagcatcagcagatcgcaattgattgaaaccaattgatcaagatcagtgagaattgtgggcgaaatgcgctgacacaattcgtcaaattgttcgtcatcgaaaaagcccaagtggcgaatgcttggtgcaaaaattggccaaatttcgcgcgccaaaacatcccaaatcggatgttcatcatcatcattatcgcttgaacacagagtcaattccaaattggtgccacttttgtcccaaatttgcttattggcacggagaaattcaatgacggaatgatcaatgtaactgaaaa

SEQ ID NO: 44814 - DNA, 978 bp, Heterodera glycines
cgatttatttttgttttcggggcagtccccccgaactccccccagagatttatggtggagaccgaatccttcgggaatagcttccctatagcctgtactttaattctgcgttggatttttgctccccataattgtttgagtaccccaaacggacacttgaaaaaatcgatttttttgggttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccacgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttcccagaaagtcatgcgcacccgtccgatctggggagttaagcaacgattgctgactagccaatacgtatcggtgccgtgatgaaacgaaccagcactgcttaccccgcggcacccggcacggtcccc

SEQ ID NO: 44815 - DNA, 1059 bp, Heterodera glycines
aaaaaaaaaaacccccgggggggagaggaggggggaacacatatttttaaaatttttcaatttttttgtggttaatttttcccaaaccgggttggaaatcaaaaaaaaaaaacattccccggtgggaaaaaaaggggtttttaaaaaattttttggggaaaaaaagactttcaaaaatatacccctgggagaaaggggggggaaaaatgagtttaaaattttcaatttttttttattttattttattcaaaacggttcaaaatccaataaaaataccattccgggtgcgaaaaatggggtttgacaagttttttggggaaaaaaaagctttacaaaataatacccctgggagaagggagtgggaaacatgatttcaaaattttcaattttttttagtctaatctactcaaaccggttcagaattcaataaaaataccattccacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcaga

SEQ ID NO: 44816 - DNA, 902 bp, Heterodera glycines
gaacggattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcaactcttacggtaatggaaaaaattttgaagaggctctgcggaacggattagcatcggggttacgagatagaaaattgtcctaaaaagagatagccatttttctgagaattaattcacaatttccgcagctcttagggtaatggaaaaaattttgaagaggctctgcggaacagattagcatcggggttacgagatagaaaattgtcctaaaaagagatagccatttttctgagaattaattcacaatttccgcagctcttgcggtaatggaaaaattttgaagagtctctgcggaacggattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcat

SEQ ID NO: 44817 - DNA, 612 bp, Heterodera glycines
ataccgaaaattttttttttattaataatttccattctttaaattttcctttttttacaatttatgtcacccagcattcattgtttgtttctgtctcttcctaggtaagaagaattaacccacagattggtgaccaaactggtgccaccggcggggtcggcgacggcactttcattgagcgtggcatttgcgcccgactgtccgaaaatgacacggtccatcggaacaccgcgctgatttctgtacggcgccgaaaggagctgatgatcacccgcgtggtggacctggtggccgcgcacggtttgatttccaagtaaaaaaataaataaaaaaaacggatcggcaaaaaatgggggaaaaatatttaggattggggctcatatccttgtagtttttgccgaaaaaaaattccgattttcctaattcatacctcctcaaagacctatcacaccaaaatttcccaaataattttgctaaatttttacaaaaattcaattttacacatagaatatttccttttttaattttttttgtgttttctaaaaatatacgacattgagagttgataaaaacttggagatacatttttaaaatccctatctcctcactttt

SEQ ID NO: 44818 - DNA, 957 bp, Heterodera glycines
  misc_feature (881)..(881): n is a, c, g, or t
  misc_feature (902)..(902): n is a, c, g, or t
agtcttgaatttatttgacaaatccaagacttaaaaccccccccgcaaggggctgtggctgggggcctaaaatttgggcctcattggagaattaattctgatttctgaaaaagtcccagaaatgactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtncagtccagaaaggaatatttntaaacgatttcgttttgttttggcattatgataccgaataactttcggaaattat

SEQ ID NO: 44819 - DNA, 1012 bp, Heterodera glycines
  misc_feature (949)..(949): n is a, c, g, or t
taagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcaaaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaataattctcagaaaatggctatctctttttaggacaattntctatctcgtaaccccgatgctaatccgttccggagagcctcttcaaaattttttccattacc

SEQ ID NO: 44820 - DNA, 1008 bp, Heterodera glycines
gaaaaaattttgaagaggctttgcggaccggattagcatcggggatacgagatagaaaattgtcctaaaaagagatagccatttttctgagatttatttcacaatttagctaactctgacggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttagggtaaggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattaacaaaggggttacgagatagaaaattgtcctaaaaagagatataaagaatcgagaattaattcacaatttccacaactcttgcgg

SEQ ID NO: 44821 - DNA, 1031 bp, Heterodera glycines
agggggggggggtaaagcggtgtgacaattgaccgctaattgggtcatttgctttgccttttgaatttctaaatgttcgacccctccagggaggtgcccagatggtggacatcaccggcactttggacggttcccaacagcacgcggccgcgttgcatgcgcagcaactgctgatgctttccgcaatagtgcagcagcaacagcagccgcagcagcatccccaacagtacattttcgccctgctaaattccttcgcggcgggaaacggactgaacggaggtgggaaaattgggatggcatcggcacaaccaccgcactcttatcagcggattatcaggggattaccgtaacttagtcgagaatggatgggagatttggcgctacactgctgcatttccccttccttctctagctttctccctttctctcccttttctctctacctctctctttctcttttcccctctttatttctcttgccgccctctctttctctctctcctgcccaattttattgttgcgttgtgcgaatgagtgacagatcgccacatttcactcgcaacaaatggggctggcgatttatttttaagaacaccagcgcagaaatgcacggggttagggcgggtggcaacactccgcggccggcgaccggccccccgggcaatggacggaccatcgccgtcgtttcgtcaaggccacccaaaaaaatccttccgatcgttcccgcaacctctccccccccccaattgcacacttttattgtctttcctatcggacactctctccttgaaggacgaacggatccattgcgcagattaatgatctcaggacgaaaaaattggggtggcggatttgtgatttgtctgctggcaattgggggggggggggaggtggtgtcgtcgcgtcgcccgccgttccctccgtcgctgcgccggtgctgccgattcgctgctgattatccattcgctcctcctcctccgtctgtgttcctttttgtgctgttcgtcgcccgttgcttctcccctcccctt

SEQ ID NO: 44822 - DNA, 964 bp, Heterodera glycines
cagtgaggaatccttggaattcattacggattggacccccccctaaaaaattacaacgaattgatacatcggaacacagtcttcatcatgcatttggctcgaactcgggcagaactttacgccaatttgagcatcgctcacattttccacagtaatgccaccgtagtagcgtatcggttgctgtgtattttgctcgattatcagtcatttttaaaggaattgaccatggcaccgggcaaacaatggtcgaccgtgtaccgttgttttcaaaaaagtccatgcgaaaatttggaggttcaccgcgaaagtgtgtacctataccatttcaaatttttaaaaaatgttttgttggacaaaaaaagtacccatggcaatgaattggcgcaaaaattgcgcgaagaagtgggagtatttggaaggcttgaatcactgttgggaaatgatttttttaaatacttatggagcagagatgaaatcaaagacaagttattcaacccaaattgtaagatcttatgaaaataattgtttaaaaaaagtaaaatgcccggatagggccaaaagtcacgcaggcccggtaggggtcaactccgtctggccaactccgtctcagcaatgttcaaaaagctataacttttttctttgaaaaaatatgtaaaaatttaatgatgctcgaaaaaaaacttaaaaaccaaaaaaaaattaaatgattcattattttagtagagtttttatatgaattttttgaaatcatgaaaataattaatttaaaaaaataaatttcttagaataattcttttttgcattaagttttccgcaacgaaaagcgtcttctgaccaattatcatcaaacaatttcgagtgccaatgagttgaagccgacacaggcgcgattgttggctggattgacagtgctttacaatcattttggtcaattggcactcacatttagcgacacgaaattgaa

SEQ ID NO: 44823 - DNA, 621 bp, Heterodera glycines
attacataccggaattttgaaatggccgggaccgggacttggaaaatgggatcgggacgggatcccgggactcccgtttttccgggactcccggtcccggtcccagtttttgggccgggatcccgccgggaccgggactttttcaaaatttgtgcaactttgattataaatttaaaaaatattggtaatcttctattttagcttgggaataggccaagcaatgcaacgaccttttttgtctgtttttaaagcactttttagggcgcgctttttcaaaaaaattttgggcaattaagggtgagggtccggcggtgccgataggcgccgccggggaaaatttttgtaatttttaatgagttttattaatagattttttccaaaaagaccaaattttgggattctgcgtcatttttttaagataataaggattttagggatcggtggggaagttttgcagattttacatccattttaagagattttcaacaaaaattgcaattttgaatatggattttgtgatctttttaacaattgaaattgtacaaatttccaaaaatcccttaagttgtatcttcgaactttgaaataaaaacatttttccaaaataattattaaattttt

SEQ ID NO: 44824 - DNA, 739 bp, Heterodera glycines
agtaataggaattccacccgcattctcagaataattacgccgatactaattgttctggaatttgtttctctgcgcgtttgttggggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgttagatgggaaaaattggaaaatgctatctctttttct

SEQ ID NO: 44825 - DNA, 465 bp, Heterodera glycines
  misc_feature (413)..(413): n is a, c, g, or t
tgatggtcagaaaataaatgttattttatatttttaaataattttttaggcttttggacaattatgttgggcgtcctcgtccccatggaacatggtcgcaaccattgttccgcccggaccagtggaacatctaccaacgaacattggatggagatgcgaggacgaacaataacgcagaagcggaataccaccgtttgcagggcgcgttcaattgtcgtcatccatcgttgtggaatttcattgatgttcttcgacatgaacagaaaattgcataccacaaatacaattctgcgatcgctggattgtcacctgagaaaaagcgaggaaaatatttggcagcagaccaacgaattctgaatatggttcgcaattacattccattgaatgcagtgaatgaacatgattctcttccncccattccccagcccaatcaattaagagtattttggaatttcttcgaggtat

SEQ ID NO: 44826 - DNA, 1199 bp, Heterodera glycines
cagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcaggaatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttggagaaatttcaaaaaactttaaaaattcatagaaaatttaaa

SEQ ID NO: 44827 - DNA, 668 bp, Heterodera glycines
cactccgttgtttgtttgtgtcactaccgttccttggctcgctatttggtcattagctgatgatccgtccggcacaatgctaaaagcgtactttcccggcacggactgtgccgggacggggcaacggacgagcgaaggactgacccaacggcctttgctgagcgaagtgccgaacagacaaccgtaacgggcacgaggccccctgagggaaagtgaggcaaatgcgaagaaagtgccatttattcacttgggaaaagcattgcccaaaacggagacaaaggcaaccgatggcaaaggaaagggcggcgaaagcgaagaatttcccgacgcattcgaaagtgcgacggacgaagcctgcggaaggatcagtgacagcgaaggcaattgctggggacagatcagtccaagcggacaaaggtcgcaatcggcacccatccaaccgggcgagcagacgcacgccctgccaattggggggggggggtgggaaagaggctaattaacccatcaattagcaatgctaattgttgtccattgatcagccagtcccccattaattaaactgaaagtgccttgtttgacgatcacagcggccgtggatacattcaaagtcgcaatgttttatggcagagatttgatcctcggcatatgaaaaatgggagcccgaaaca

SEQ ID NO: 44828 - DNA, 1003 bp, Heterodera glycines
  misc_feature (941)..(941): n is a, c, g, or t
  misc_feature (968)..(969): n is a, c, g, or t
gagtgcttaaaaacaaaaatataaaaaatagtaaatcataaagctaatgcaaaagtaaagtccgaaaaataatgcaagaacaatcattaattatattcgcttggtcgagaaaaaaattatctgggccaacttcaaaataaataaatattaataaacctaaagaaaaattggcatgaccataaagtccatatttagtaatttttgcaattaattaaatattaatttaatgcacaatttataaaaaaagaaaaaactaagtcacaaagatatgcatttatattgcaaatcggtcaaatataaaattgaattaacaagaaaaaattaatacaggaaagtttatcgaatatgttgacaaagaacccaacgagaattcaaattgaatcaacctaacaagagagggaataaccaggataaatttttaaataagtaaacttggaatttaatcgaataaacaattaaattgaataaataaaacgaagtttttaaatgaaaatcattatttatctatatttataaacaaacaaatcaaaaaagtgaatttacaacaattttaataaaaataataatgaaaaaacagttattagagaaaataaatattttaagcccaaaataaattattttgattcaactaattaaaattttaaaaacacaaacatttttaaaattaaactaataaaaatgaaaaaatacttattaaatttcatatatttcaacacaaaatcaattacggaataaggacatggacagtaatttattataaaaaccaaagaacatataacatataatggggcggttacgaattttgtatttattcaaaaacataacaaataattactacaatattttatgcgaccatttcgataatttaattcaaatattcaaagaaaatttgagacaaagaaaggataaaaacaatctacaaatttatatttatttacaantaatcgaatgctttaaggacctaatannacaaaacctataaattataaaaaatatacaaact

SEQ ID NO: 44829 - DNA, 1181 bp, Heterodera glycines
  misc_feature (996)..(996): n is a, c, g, or t
tagtcattctcgattggtgttgacgatccagcattcagtgtacaattgttttaaacctctcaacatggtaaatcaaaatcctaataaaaatttcgttgaatttcttcgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttgaaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccaaagaaagaagtgcagtggggaagaatgacgcccaaaatgaaggaaatattcgatgctgtgcgaactctttgtgacccctctctgactctgccaatgcagcagtttacaatttttaccactatttttctctcactcatcgtctgctcgtctctcctttattataagctattttccaaagccaacgcccttcttctgttagtcatttctcattggtgttgacgatccaacattcagtgtacaaatttgttaaacctctcaacattttaaatcaaaatcctaataaaaatttagttgaatttctccgcctcttatttgtgcaaaattttcgaaaaagtaattttctatttaaaattaaaaaattcagaagcaaattcaagaattttttttatttataaatgcattttttaccacatgaattatgtttaaatttttgcgtttcgaattcattttggaattatgaaaaataaaaattgataatcatttgatcatttttagcgcactttaagcaccgccgttaggcagcgcagttccaaaatttattccatgccacagatattatgggcaggacacgccaagtacctcaaacttgngtaaataaccgaaagaaagagtgcagtggggaagaatgacgccccaaatgaaggaaatattcgatgctgtgccaactctttgggacccctctctgactctgccaatgcagaagttgaccatttttaccactattttttctctccctcatcggctgctcggctctcccttaatataaagctatttt

SEQ ID NO: 44830 - DNA, 1024 bp, Heterodera glycines
  misc_feature (34)..(34): n is a, c, g, or t
  misc_feature (114)..(114): n is a, c, g, or t
  misc_feature (125)..(125): n is a, c, g, or t
  misc_feature (172)..(172): n is a, c, g, or t
cagacttttggaaaaatatatttgcaattatcanccaattttgagaagtgagatagaaatgataacttcacgattcaaaccaattttcggtgctctaattaaccgcgataaaanacatccgaatncaattaaatagcttctgagataataaggtttatcataaaatttcatntaaaaataaaccctcaattattggtatgaacgatactttccaaacatgcacgcgttttgcgctcgagctatttatcatcgggcttgtcaattcaaagcgaaacaacaaagatagtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacattcgaatcaattaaatagcttctgagataataaggtttatcataaaatttcatttaaaaataaacactcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctccaattattggtatgaa

SEQ ID NO: 44831 - DNA, 595 bp, Heterodera glycines
aacttttgggtaatgaattattttttgaagtgagtctttttcctattggtgctttgctgtgccgagaaccggtatgcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggataggtttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttactgtgccgagaaccggcaggcaatggatgtctttatatctgcaagaaattacattggcaataagtgggtgtaaaaacttgtggaaagaattatttttggagtgaatccacacccctattatgttttactgtgccaagaaccgg

SEQ ID NO: 44832 - DNA, 981 bp, Heterodera glycines
  misc_feature (929)..(929): n is a, c, g, or t
agaaaagagcacgaaaaactgggagaaaggacaaaaagaaatggcaaataattccaatggcatggcattgtttgctcccttcccatggtgccctcttcaccatcagtatggcattattttctcacctgcccctggcatgtcaatttgtgccgctccgaggccctcattggcccaaaattcggcccttcgctgttctgtgtcggcccaatggacacagcgaattgcccccgcggtatcttccgtttcttttcgcttcgatacgcaatcactgcccgaaatgcccctctgatgttggcgttgtgtttacaaatgaatatcacaccaaaaagtggggcaccccacaaagtgtccaagccacgaaatgtccaaaagagtaaaaacccacgaaatgtccaaaatttttcaaaatttataaaaacaaaataagtctaatttaggatttttagggttttcggggtcgctgaatacgaatatacccttaatattaccccttgcctaaccttaggcccatctgaataataaaaaactcaaattcgagacttggacatttcgtgggctggacattttgtgggtcagcgaaaagtggcacgcacttacgattattttcactccgccaaattgggctccctgcagcaaaatccattcgttgaacggcaaagtgaacaaagtgacgcccacggcgaccaatttgagcatggcggacaaagtcaaacaccaaaagctgagctgatcaatcggctgcactgagtcaatggacacaatgtcatccattccaacagaagaaagaaaaagaaagtaattggattcactgaaaaaagaattaattaaggtgagtcattaaattgaaaaatgaaattaatggagggaaacgagtgacaacgaacaacagcagcaacaataatcagcaacagtttgttgtatttgaaggngaagaagtcaagagataaggcaaacaagtgaatggagaagatcatcgattgg

SEQ ID NO: 44833 - DNA, 1216 bp, Heterodera glycines
gcctaagctgaagcctaggctgaagcctaagctgaagcctaggttgaagcctaagctgaagcctaggttgaagcctaagctgaagcctaggcctaagctgaagcctaagcctaggcctaagcaagctgaagcctaagcttaagcctaagcctaatgtgcgccgctcgcttcgctcagttcgccccactatttgtcctcctttctccgcgtgttggccattgcgaacgctccgcggcttttaaaaaaataatattaaatgccaaatgtggtcaaaattaacataaatgtggaagggaaggccccaatcgtcacttttattttgcttccaattttacctttatttcctaaacccaaaatggattattacaattatgaccgattaatggccgaatgtcccaatgaagttgcgacagttaaatttctccaaacaaaaggcctactacataaagaacgccattgcgattgtggttcgcaaatgcgcgagagtacacgcacacaacgggacactgtaattcccgtgtggcggtgtacttcaaaattctgcaagcaactaagggcttaagaccggctacttggttcgacagctccaccctttcgttccgctcaattcttaaatttatttattggtggtcgactgagcaaacgtctgttaatttttgtcgccatgaaattggaatggcacacgaagcagtagttgactggtaattagctatttgtaagtgccggaggcattttataatggctcaggtccatgtacatgcgcgaggcatgcgctgactccctgttaaagaacaatgggcgtgtgggaggcgtaggcttaactgtggaagtggatgaagcgcttttttctaagcgcaaaaacaacattggcagggttctccccgaacaatgggtgttgggggggggggggggggtatgcaaatgaaccggatagggcagatgggcataaacattcattgccacaagatcgaatttaattgcctatttttttaaataatttattttataattaactataacaggtggcgatattgtgcatccaaaatctcaggacggagtagtgcagagtaatttcttaactcatgatttataattataattaatagagctaattaagttatataatgaatatgaatctattaactcatattaatatttggaattgttgtatgtttaagttttaaaatgatatattctatcaaatattttttatata

SEQ ID NO: 44834 - DNA, 1039 bp, Heterodera glycines
  misc_feature (32)..(32): n is a, c, g, or t
  misc_feature (89)..(89): n is a, c, g, or t
  misc_feature (171)..(171): n is a, c, g, or t
  misc_feature (846)..(847): n is a, c, g, or t
  misc_feature (850)..(851): n is a, c, g, or t
  misc_feature (857)..(857): n is a, c, g, or t
  misc_feature (861)..(862): n is a, c, g, or t
  misc_feature (866)..(867): n is a, c, g, or t
  misc_feature (875)..(875): n is a, c, g, or t
  misc_feature (881)..(881): n is a, c, g, or t
  misc_feature (895)..(897): n is a, c, g, or t
  misc_feature (900)..(901): n is a, c, g, or t
  misc_feature (903)..(903): n is a, c, g, or t
  misc_feature (905)..(905): n is a, c, g, or t
  misc_feature (909)..(911): n is a, c, g, or t
  misc_feature (915)..(915): n is a, c, g, or t
  misc_feature (917)..(923): n is a, c, g, or t
  misc_feature (926)..(928): n is a, c, g, or t
  misc_feature (935)..(939): n is a, c, g, or t
  misc_feature (941)..(942): n is a, c, g, or t
  misc_feature (962)..(962): n is a, c, g, or t
  misc_feature (970)..(972): n is a, c, g, or t
  misc_feature (974)..(974): n is a, c, g, or t
  misc_feature (977)..(977): n is a, c, g, or t
  misc_feature (980)..(982): n is a, c, g, or t
  misc_feature (986)..(987): n is a, c, g, or t
  misc_feature (989)..(989): n is a, c, g, or t
aggaagagagttcattatttatttgtttttgncataataattcataaatattttttcagaaagggttctgaaacgcaccaaatttattnacatgttagtttaggcactcagatgctttcactatcaaaaaagggagatgaataaaaaatctaaaaattttaattgcttttnaaacaggccaaaaagtttaggcttaacttttttttcagaaactgatcagaagcgaaccagattttgcgagagcatcaaaaagacaaggaaaagcactgctatgatgctaacaccagtaattctgaatttaaaattttttattaatttttaaagcttcactattttatttttttagcaaaattaattcataaatattttttcagaaactgctctgaaacgcatcaaattttaattacaagttattttaggcactcagatgctttcaatatcaaaaagggagatgaataaaaaatctaaaaatttttaattgctttttaaatatgcgaaaaattttaggcttaacttttttttataaacttatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcatcaaattttatttacaagttattttaggcactcagatgctttcaatatcaaaaagggagatgaataaaaaatctaaaaatttttaatactttaattctgcgttggatttttgctccccataattgtttgagtacccccnnctnncccttnaaannatcnntttttttnttttcnaaacaatccccccnnnccnntncncccnnntttntnnnnnnnccnnntccttcnnnnntnncttccctttttagcaagatnttttcccnnntntcntcnnncctnncncacccaagtaaatatatctctcctaattttgcaggcattctcccattgta

SEQ ID NO: 44835 - DNA, 1077 bp, Heterodera glycines
  misc_feature (1051)..(1051): n is a, c, g, or t
aacggcggcacttgcatccgatgcagctttccccgggctatcgaaccctactatttttttttttatctcttttctgaaaggagttataacaatttttcacaacagttttgcatttaacagacacattttaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaatagctgatacggtagcccaacatccattgccccaactcagaagggcggtttgccaancgggagctaacaattgatgagtttgt

SEQ ID NO: 44836 - DNA, 1096 bp, Heterodera glycines
taaatttaagaattatatatttatttttaataaataccccaccccaggctgataaaactctttttggcttttcgacaattcttaaaaaatatttaaatttattattttaataattcttaatttgcattcaaaaattgcatctaaattttagaattaaaacaataatataataataataataattcattaaattctaataccgtattggtcttgtccggcctccattcaattttctgtccaatgtgtggaatccacttctggatgaaccatatgatatctaatagagctcttttagcagggtcgggggcctggtacagaaatttttcggcccccggcaactataaccctatggttttcggggaaaacagggttgacaacggttaaaagcggtcgaccgggtctccggaaccaagactggacggaattacgggtcactcactggctacggattacgtaattacggcattttttgacccccccccccgtaattatggattgctggtgtccgtaattgaaaaatctctccttaattactgttacgactttccgaaattttctcttgttaataattgaacaatttttatgagagaatttttttattgccttataatatttttattaaagaaaaattttgcgtttaaattttcaagggaattttcttctctttttttcagctgagtcgtcctcagtttctcctcatagcagtacaaatccagcagaaaattaatgtttcaattattaatttaaataattagagttgctcccgattttcgtggaaaaaaaaatcgtggaggaattcccagaaaattttagttttatctgggatggctgggacaaatttatgggagcttcttttcacaattccccgaaccaggtcgggaagcaaccctaatattaattaaaacaaaatttcactaattagtcgattgatttttaaaattaaattaaaactaaactcacttccaaataataattttacacctaattcacgcgcgctttcattgaaaacatttctcttatgttttgctggtaaattgttgaccatttgcccaaactctgttaagcattgttgagcctgaaattcatttattaaatg

SEQ ID NO: 44837 - DNA, 601 bp, Heterodera glycines
catttcccccccccccccttctcccctctcctccgacttcgtttgtggcagctgtttccacaaatgtttctcttggcttttctgtctgtgtccttttttcgccctctttctgccaacttatgtgagcagcagacgaccacgaggtcttttacaacacattaattttgaatgacgatgaatgatgaaaataatggtggagggagagaagaaaagcattggagagaagggaggagagaaagttaggggaagagaaagaagggagcgataggagggggaggggaaaagaaaaaggaggagggagagaaggggaggagagaatgggggagaaaaaggagaacagcagggagaggaaggggaaggaaggccgtgtcggactgactttgactgccaaatggtgttaatttgcggaatgactctttgtgggtttgttgcattaaataccaaagacgacacacggaattagtcgatattttgaaaattagtgccaaaagtgaaagaaaattgaaaacaaaacgattgaaaagaaagtgcggaagagaatatttgaaattaatcatctgttatttgagtgcatgactttaatttcacttgtcaacttaaa

SEQ ID NO: 44838 - DNA, 854 bp, Heterodera glycines
  misc_feature (8)..(9): n is a, c, g, or t
gcctgcannggtctattggggagtaaaaaaaagtttttttgtgactatttaccatataaatttatgcagcatttctaaaaaggatttaaaaataatttcttgcgtaatattttttacattatgttgttgaagaatttgaggctgcttctgatgcgattgaaaatttttcagcttttcttgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagctttttctgaaaagttttttc

SEQ ID NO: 44839 - DNA, 1113 bp, Heterodera glycines
agtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcattatttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaacttttttttcagaaacttatcagaagcgcaccaaactttgcagggatactgaaaggaagagaaataacctattttaaatattatctagtcagttcatttaaataatttattcaataaaaaatttttttttgggttttcggggcagtccccctgaaccgatgttaggcttaactttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgacccgatgcgcccagatttatggggagaccgaatccttccggagtatcttccctatagcctgtactttaattctgcgttggatttttgctccccataaatgtttgagtaccccaaacggacactt

SEQ ID NO: 44840 - DNA, 240 bp, Heterodera glycines
gtcatctatgttactagatcggggatcgatccccgtttttttcgctcgagcaggacctgcagaagctagcttgatggggatcagattgtcgtttcccgccttcagtttaaactatcaagagagggaggtaggtggcggaagaagaaaagggtggggggagtatgagtatgatggtcaatatggagaaaaagaaagagtaattaccaattttttttcaattcaaaaatgtagatgtccgca

SEQ ID NO: 44841 - DNA, 567 bp, Heterodera glycines
tttttttcgatttttaaatattttattattttaaactaagatatagaatgcttaacttgcaacatatgctttttatactaatatattacagtgcgattgctgatgacactattccgtcctcgtttcagattcaaattatatattaattatttcatttaaattgataaaaagtttaattttagaactgaaatttgtcattaattatttctattatctatttattttttactttttatttgtcactagattttgccatattaattttataattgacaaatttaaattctttcttgtcgataatccaagacttctaacgcattctttcattacagctttttatattaaatattgctttcagaaaaataatgaaaaaagttaaatattacatttatattttttaatctttaaaagcatagacaatagaataaatattcattgcctcattatgcctccatatttttttagatttacatagattttttaaatgttgacaaaagccaataaaagtggttgcttaatttcaaataaatgatgataaaaaatgcatttggtattgttaatcatttt

SEQ ID NO: 44842 - DNA, 817 bp, Heterodera glycines
aaaaaatgagaaaaagagatagctatttttggtcaagaatttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagtaattttttttgtttgcgt

SEQ ID NO: 44843 - DNA, 1318 bp, Heterodera glycines
ttaaattaattatttaggaattttcacaaagaaataacaaatatttatcaaaaaaaaacttctttgggggtagtcaaacttacaaaatgccaaaattttatccaaaaattttggcggaaaatccaaatttattttttggtcgcaattttctttaccgcacaaatgaaaaaatatgaaaaattgtgttttttaggtgaaaatgataatttcatctatccaaattgcttggagtgggtaattttttgtttgggatatttttttttaccaaaacgacggagaagtaacggaaatgggtggcattccgtcccgtttgtccgtccgtccgttccgccaatttttgctgctccaacaaataataaagaaccaacagaacagtcagcagcagaaaatgtgaggggggggggggggacaagcaaatgacgatgaaaatgacatttttgtttataataaataaataagtgaatggtcttttgctgcaacgagagctattaaatttcttaaaattcttccccgatcacttttcagtttttaatttctgatcactattcatttgatacatttcttaactctaattaggatttctgttcgcttcaattgatcgtttaaagctctccccaaaattagctcttatcattttaatcagaaaacattgaatgtaaaaatgaacatctgctgttgatcacttaattactgaactttcatcaattgatctgccggatatggcaatttcgataattgagccatggctttaatcagttttactcccaaatcacatcagtctgttattatactaatcagcaaacagctgtagcaattaataaaataatgctgacatcaaatacaaaaatttttattgcttggattcctactatattatgcacttaaagtacttcactcactcactcaccatccttaaacgtatcaccccccaaacgtttcaatctcggcaaattgtccaattttcgaatattattgtcagtcaaatcaatgacatcaaattgatcctattaattaaactttatatataacaacagcatttctgtcttaccctgataactccgagattttcaatggtaggaatttgcagattccgaagggaaatttcacgctgcttacacggatttataaactgaaaatttaaattgccattttcagttctgcgccattttcgcaaaaaatagttaacaagatgcccacctggtacgcatcattgacaacatcaacggaaatacggaccatagtaactaagaaaacaagtcaaaaaaaattaattacataaaaacggatttattatagaaaaatatcactgtaaatgaat

SEQ ID NO: 44844 - DNA, 871 bp, Heterodera glycines
ttttgcctttttattccatatttcggctatttttggcaaattttcacaagaaaaatgcaaaaaaagaagcgatttttgacgtttttagtccatatttcgggcatttttagtccatgttttatgtccatatttgacgttttttagtccatataatttcgagccctattaatatgggacgggtccgggtttttgactttggtttttggcaaggcttaaattggatggagagatgaattaattatgccatttgagttccttcgtcccgacgaaaacccaaagtttgtcgccaactccgaatgggaaatggtgccgccaattccggcaaattgtcccattaacgtttcggatgagaaaggaaaattggtggtgaaaagtgccgagcaaatggaatatgaacgcgacgatcaaagacagagcggcggtcagccggcggtcaaagtcagcggcaaattattgcgcgtggcatttcgagtgaaccaaatgccaaaaaacattaccattcaattggaggacaaacagaaaaagcccattctcacactgttcatcggcgcaaaacatattatactcaactcggagcaggtcaatggtgcacgacggcacggcacgagaagggatgggaagggataagcaataaaatgccaaggtggtgccgagcagggataccattccgaggccccaaaagttgacggaaatcggaattccgaggcccacaaactgtcggaattccgatgcccaaaaattttcggcagttgtaaatcggattccgacccccaaaaatgtaggaaatcggaattctgtgccatccctggcgcctaggtttaaaattgagaaaaaatggatataaaggtgtggcataaaatacgctttcaaa

SEQ ID NO: 44845 - DNA, 1040 bp, Heterodera glycines
  misc_feature (7)..(7): n is a, c, g, or t
  misc_feature (988)..(988): n is a, c, g, or t
  misc_feature (1031)..(1031): n is a, c, g, or t
aaatccntttttagaaatgctacataaatttttattgtactttttcacaaaaaaacttttttttactcccaatatctaccagttatcatacaaaaaggcaatagttaagctttgagatataaaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttagatcctttttagaaatgctgcataaatttttattgtaaatagtcacaaacaaactttttttcactcccaatatctaccagttatcatacaaaaaaggcaatagttaagcactgagatataaaaaaatcgtctagaataattttctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtnaatagtcacaaaaaaacttttttttactcccaatatctaccangtatcatac

SEQ ID NO: 44846 - DNA, 1233 bp, Heterodera glycines
  misc_feature (1148)..(1149): n is a, c, g, or t
  misc_feature (1162)..(1163): n is a, c, g, or t
  misc_feature (1197)..(1197): n is a, c, g, or t
aggggtacatttcaaaaaaaaatttaattttaacaagaaatttttttaatcctcgaaaatcctctaaatatgttaaaaaatggaaatttgtacgaaaaaaatgcaaaattatatacgaagtccaaaatatgtataaaaatattacataaaaaggaagccctgctaattattattaattaagaaagttaaaaaaaagattttttgtaaatatgttataatttatttattcttataatttgatgctgaacggttctctttccggtaaatttaccttgtcttcgtgggcattatttccaaaatagccatccggattagcagtgggataaccagtgatcaccaatccacccggcggtggcggcgcgagtgccccttcagtcgccggcggtggcggcgcgagtgctccttcagtcgccggcggtgacggcaaaaacatcggaggcggcggtggtggtgaataaatcggaacagcaggaggcggattagtttcacaatcacacaacactgaggaatttgcttgacgattcatttgcattggccctggtggtggtgcctaaattgaaaaaagaattagagaattaacggattctattagtaatttataagaaaagccaggacacggtactgttcctgactctacagtacacaattaattctgttgattatttattgtaaaatactggaaccagtactgtttctgactctacagtaatcttaagaaacaggatacggttccttaatctacagtacacaactaattgtaattgcctttttaaaatgaaatattttcgaccatgatttataccattattgttccaagtggtcgtccagcttcaacacttggtactgctccaagtgtcaaagccgcaactccaagcgcactcattgtccgttttaaggtgggcccatcttaaaataaaaaatgttaaaaatgccgtacaaatatttttttttaaattgagttttgccacaaattattagaaaagcgaataaaattttcttgaaattgatcaaactaattaaaaaattaaccaccaccaccaccattggcgttgctgttcattatttggctttcgatgacgaactgttgtgtgtgccgtggttcttagggctcatttgaaaatcaactgtagaggaagaagaagaattgnnggtgtcatttttnngcacagtggctgctttaagaaaaatatttagaanactcatttagcaaattaattaattttcatatatttt

SEQ ID NO: 44847 - DNA, 713 bp, Heterodera glycines
ctatgggtacgcgccagtgtcagacaaaattgctcataacgccaaatagcgcatttggcgtaaatttttgcgcgttaattcaaaatttacactggaaaatgccttttttgtattttttattttgatctgccataactcgcttcattcccaactaagctgaacaaatttggtatctaaaaaaagattttgaaaaggagaatctttttctaagcgaatgctaagcaatttgacatcccagaaaaaagttgtgatactttcaaatttttatcacgttataactcaagtcctaaactgctgttttcagcaaaaatgctaaaactattaatttctttattgattctaaatgtccaaagtgattttgtatccttataaccaaaattgttagcatttacgaatttgatgttttttgtgtgctagagatgtgaaaatagtacgccaaaaagagagaaaaagaaattcacaaattttctcaccaaataacttttgagtgagccttatttttgtattaaatttccttattaatcgattcagaatttttttctctatcgatatgcaaaatttggtgtaggtttaacgtatagaaaaaaagttagacggagaaaaagtaatgttgttttctacattgttaaaaataaagagatagtgcgccaaagtgatagaaattataaagaaaaagagatacgacgatatagtactaagcttttctctgcaca

SEQ ID NO: 44848 - DNA, 736 bp, Heterodera glycines
acacaaatgaaattctcacgttcgaatggtgggaaaaaattcttaaaatttaagcaaatttattatattaaggccattgaaccctgataataataacgaaggagcgggaagatcaaacggcatttatataaaaataaaggtcatttgttaattggacttaagtatatatttgggaatacaatatttaattcttgagagattttattttaggaaatccttggccaagcaaaaagtgccgacgcaagtaagcgattggccggcatccgacgagcccaatcactgctgtccacaagcaatgggccaaatgagttgctaattgatgcgtttattttggccgggtgtttgcccatctttttggactgtttgaaagacaataacaggtgaaacaacaatcagaatgggctcgtgctgggacgtttgttttataaatccttcatccccgagaaatgtattttaaattatgtaattttttaagagaattcgaatttttcatatatatttttaatgttttatatgaaattcaaatttttcgtaaatattcttcctccaaatttccttaaaaatttctaaattttcgaattaaatttctccggggagatggatgtatttttaaattcatgagaaagttttgattaaatttacccatgcccttgtccttttagcaaaagaaatgaatccataaaaaaaagtttaggtcttagttcgaaaatatggtccaaaaaattcagaatgttag

SEQ ID NO: 44849 - DNA, 970 bp, Heterodera glycines
catgaatgttatttttattgaattctgaaccggtttgagtagattagactacaaaaaatttaaaatttcgaaatcatgtttcccactcccttctcccaggggtcatgtctttcactcccttctcacaggggtattattttgtaaagtctttttttccccaataaacttttcataccccatttttcgcaccgtgaatgttatttttattgaattctgaaccggtttgagtagattagacaacaaaaaattgaaaatttcgaaatcatgtttcccactcccttctcccaggggtattattttgtaaagtctttttttccccaataaacttttcataccccattttcgcaccgtgaatgttatttttattgaattctgaaccggtttgagtagcttagagtacaaaaaatttaaaatttcgaaatcatgtttcccactcccttctcccaggggtattattttgtaaagtctttttttccccaataaactttttataccccattttcgcaccgtgaatgttatttttattgaattctgaaccggtttgagtagattagagtacaaaaaattgaaaattttgaaatcatgtttcccactcccttctcccaggggtcatgtttcctcccgggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtctttttttccccaataaacttttcataccccattttcgcaccgtgaatgttatttttattgaattctgaaccggtttgagtagattagactacaaaaaattgaaaatttcgaaatcatgtttcccactcccttctcccaggggtcatgtttcccactcccttctcc

SEQ ID NO: 44850 - DNA, 919 bp, Heterodera glycines
aaagtggaattacagaattgcgacggcaaatcctatatctccacgacgctttcattataaagctttaagggaggaaaagcaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctaaattacagatgcttttcaaattttgggtgtatacgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggacacattatggatgaattaagtatagaaggcgtcgcagaaat

SEQ ID NO: 44851 - DNA, 441 bp, Heterodera glycines
tactaatttttagcgaaaaatcgacctaaaaagcgaaattttcgctttttgcttatttttgacataaatttaaggttaaaatttattcattattatcgggaaattttaatcattcataatctgatttcgttaacatgaaaaatattcgtaatctaatcgggaaaaagcaatggatttgggcagtagggaattggcattaattggaattattagccaaattttccaattagcttaaaataaaaagcagcgaaatcgaattaaggaaacaccggccgatgcatgggcaatttacggtaagaataacttcccgccagactatggtgcggaccaaaaggggtgcagctgttggccaaagatgggccgcgatttggccaaaatttggaaggtgccgccccgttcagagcaaccggcgactgtcacgcttggccaaatgccggtaaa

SEQ ID NO: 44852 - DNA, 888 bp, Heterodera glycines
gagtccttttcctcttcatcctccgacctttctttcttcctactttttttcctcaccgcacgccgcccacacagcggggggtcccctcttctttctcttccctcccattcttcttccggtcttcctcctcccactcttcttccactttcctcttctttctcttcccaccccattcttcttccgctcttcctcctcccactcttcttccgctttcctcttctttctcttcccaccccattcttcttccgctcttcctcctcccactcttcttccgctttcctcttctttctcttcccaccccattcttcttccgctcttcctcctcccactcttcttccgctttcctcttctttctcttccctcccattcttcttccgttcttcctcctcccactcttcttccgctttcctcttctttctcttcccaccccattcttcttccgctcttcctcctcccactcttcttccgctttcctcttctttctcttcccaccccattcttcttccgctcttcctcctcccactcttcttccactttcctcttctttctctttccaccccattcttcttccgctcttcctcctcccactcttcttccgctttcctcttctttctcttcccaccccattcttcttccgctcttcctcctcccaccttcctttcttcctactcttcttcctctcctctctgctcccactcttcttcctctttcctcttctttctcttccctcccattcttcttcctctcttccttcctcctcctccatctctaatcatcccggtccgtctctgcgtctgcgtccacattttgctgctcgttgtcctctgtgtcgtcccatccttcaaacactttcatgcgccggtcgatgatcggatacaaagtccgatc

SEQ ID NO: 44853 - DNA, 1140 bp, Heterodera glycines
  misc_feature (66)..(66): n is a, c, g, or t
  misc_feature (1066)..(1066): n is a, c, g, or t
  misc_feature (1085)..(1085): n is a, c, g, or t
ttatataaaattgtgaaataaaaattttatataattaagatttgctggatttttcttttttttttnaaaaggttaattaatgcaaaaatctaaaaaagcgcttaaaaaattttaagctaaaaaagaaaatatctaaataaactttcagaacaaataaatgttgaaagtttatttgatagacgacaagaataaattcttagcattcgtcgtttttcaaggtctgtctgttctaaattttttaagtgcaattttctcattattttttttgattattttttttttttgcaacaaattaaataactcgccaaatttttcaccaattagcggcttgctttatgctgctgctgctcccacctataattaaattatgtaattaatttcgtttggtcaaaacatttctgcccaataaaaatgatggaaggcgagtggaaatggtacgaaagtgcgccaaggttacccgcgctctgctgttggcggtgtgtggcgccaattcaaaatttattttgtgtatccgtttaaccgtaaattttcgcttcattttcacccaaggtcatttttgatcggaaattaaacgatttttgaagagtttggcggcccaaaacctgtgtctatttaaatggtcattaatttgttgttaatacaaactacatcagcagtccatttattttttatgctcacattttgattattttgtcataaataaaattatttttatttttaaattttaaatgaaaaatataaattttctaaaaattatttttaataatatttacatttgaaacttgaaatttggcaggaataaacacaaatttctccaaaaagaatatatttttttaattcttagcaaattcattttattaaatttttaatcaaaaatttttaggtaaaaatgaaaatcgttgtatttttgatttttctcgcaaattcgctaattgatggccgctgtttactggactcaaaagacatttttgaatataagctaaggcaagagaattttctgacaaacgaagctgttaacaacaatgcacaaccactgcctatttattacgatggcattccaatagtnaattaattcgagaaacttncatttaattggattaattagctaattaggcacccgaattttgatgatgacgtacg

SEQ ID NO: 44854 - DNA, 1490 bp, Heterodera glycines
ttttaaatcattgccatcctttacgaatgcttttgcatttttcctcagcttaatgaacaacgataaatcccttatcatcgtcgcttatatcagtgcgaatcttggccaatttgttacacacgttttcttgaaatgaaaatttgtctttaatatcattccaaatttccaacagatcattttcaataataagagtattgaaatcggtgtgtatttcttcaatccatttttgaatgtgatgacttttattggcaccttccccaatatttccaaaaaaaatattggcattatccaatgaattgaaaaatgtcatataatttgaattttctcctgctttttgaaacaactgctttatttcatttgctacatttaataaagcattgaagtttgctgtcaatttgtctttcgaatcttaaaaaattcatcaattccgacaaaaatttctatgaaattcctgtttttttttgttgttgttagaaatgaatacaaaaacgaaattaatttttttcttttcatataaattaaaaaaatatatatttaaatatttttaaacacccaaaaaataatagaagtttcatcataaaatttatacaaattatttaggtaaaaagacaatgaaaatggttggcaattgatgaaaaggcccccgtttcccggttttcgtaacgggtgttggacttgacttttcaaaagccggtaaccaataccggagtcatttcgaaaatcggaattccgaggcccaaaaaagcaaaaagaaatcgtaaatccgatgctaatgatacattgatgaaattttggaaaaattcgaacgaagattctattaaaaaattattttgattcattatagttgaaaaagtcaaatattagaaaatgaatagattttttaaattcatatcttagtttgacgatgaattgtttcactttgtgaagtgaattttcttgaagtgttttcgggcttaaataccaatcattcacaaaaaatttcaatctgtgccttgtatttcgtactggtcattaggcaatttcataatactgcacaaactatggaaattattcttttttaatatttttatgaatttccattcttctgatctttgtgatttgacattttgtactttgtattttaaatttttattaaatatttttatgattttgattcttctgatcagtattttttgcctgatttttatagttactgatctgtagttagtttgctcgtactggtgaattaattatatttatggcacacttcataaaaaaaactgaaacaattccctgccaaacccaaatcttactcaccaaaaaatgattgtctcaccgattatcctttttctaagcgacattctgtgcttaccgtatattgtggaaacggtaaaaaataatcaagagaaaacaataaataaaatttaaaaaattctgtagtatggaaacgatcctaaggctgtgttcgaagcgtacatcgtcaaagctgtatttttgaaaaaatccgcaaa

SEQ ID NO: 44855 - DNA, 664 bp, Heterodera glycines
  misc_feature (656)..(656): n is a, c, g, or t
cagccaaaatgacacttgcgccgccgacatttgcgccgccctctccccccaattttaattatttaaagcataattttctcaatttattttaatgtttaaacacaccgtttcaattttggcctcccagttcaaaaaagatttgcatgtgtggctcagtggtttttgtaagatagtaaagggacaaagggtggtggttcgagcccgttgtgcaacatgaatattttcatttatttttgtccaaaatattaaaaaatcacgatatttggtaattatttttgaaggtttttaccaaccaaattggataatcttggtatcattcgaaagctcttgatgaggagaagcgttttctaagcaaatgctaagcaatttgacatctcagaaaagagtagtgagagtttcaaattttcataatggtttcatgcaaaaacgggatgtttaactcaaaaaagtatttgatacgttctatgcagaatttttttctctatcgatatacaaaatttgaagcggatttaacgtcagggaaaaaagttaaacgtcacgaagtgaattcagtttttctctattaacagagataaagaaatagtacgccaaaaagagagatgtttttttctctgcgctctctctttattggttcatcggaggttttttgaaacggntgtgtaaa

SEQ ID NO: 44856 - DNA, 1233 bp, Heterodera glycines
agactttttttcaacatttttgacctgtccattgtcagtccaacagcagctccaaacttcactgatgttctaagaaaatgtaaagctaaagggcgattatctgtttattgttgctgattttaccgttattccaccgaattgagatgaatgggcacgccattgaaaatcgggtggatgaaaaccatccaaagcaaaacggaggacaaaaagctaaaaagacagaaataataaatgtataatatttacaatattttataaaaacctttttttcataggaaaatttctcaaatttttttggatctttagaaaggattcaggcatcaaaagtttaaagataaataaataattttatacattgcccaaattgtcagaacatagcagtcgcccatccgaattcactgcacaatctaacatcattccaccggataaagtcgtggaaaaaggcagaaatgtagccgaatcatcggcaatctagaataaaaaatcataaaaaaatagtggtccactcaccgaatcaaagtggtcagtcgtaaaaagagcaagtcgtccatcggtaagtgtagcaactgctgctgaattatctaaatatttttttcacattaaattgtataccatactgtacataaacgttaacggttaccattaacttcactcgtaagaagaggagtaattgcatttgttggcacttttacaagccgaaaaacgccactgggaaggcgaatgtaccgctcaatgggtaacaaatccgttgggtcgataatgcaaatgccaccacacctaacataacgaacaaaggccgacaataaatttagacactcaaggtcatcaaccccacaaaaacccgagtttaagaaatttttattgtactttggattatgcacctttcacttccactcttcttatcgccaattggcgcttcatccgtcgccaattcgtaagtaccaattactaatcgttgtctttgttctcttttgctgttttgtctaaggcaacagctaaggacagaagccgctttcatgggcaacttttttgtataagtttgccttacacaatatttcattgttggtgaaaaagagagtgaatatctatatatttttgtttgtttatttagattttttcaaaaatattctttatgaattatttgaagtgttttttggcacttccaaaagattttttcgactttaattttgctattttttcctatttttctcgtcgcatacgaactaaaaatga

SEQ ID NO: 44857 - DNA, 1562 bp, Heterodera glycines
ttggtcaaattggcacttatttcgacgaacgcgatataaacttggccatagtgaaggaaaaattgcactttttgagggatccgctcaaacagctcactgccattctcatcggagtggtcggtcacttttcagtcttttttttatcggtgttatgttcttcacttttagattgattttaccgaatcaataagtgaaaatcgtttggtcatctgcagaggtgtcgatcccgagctggacaaaagtattaccatttttgtatattcttaagaccgtgacgccccaaaaaatgcacaaattattccattcgattttaataagcctggtacagtggaaatggtctttcattttacacagaaaaacaattgtacgaaaaattgccggaagatttaacatcggtggcacttttggaggcggaggacatttccatcgaaagttgttccgttgcttacgttccgatcatcggatatttgcttatggtggcggaaagtacgcaaattccaacggacacaaaagcgctcgtggaaattgtaaaaaagcgcaaataaaaatgtttggagtatagaaatttaaaatccatcccttcacagattttttcttccgagggaatgtcctattacaaaacgaatcgaatgcgtttgttggatgagaacattggtgacattaaaatgcaaattgtggacgcggaaacgaacattgtgcttaagtgggtcaattaaaatgcaaaattgtctaaattcttcttcgttttcagtttacaaaaacgtattttggacagcaaagaggcggtgctcagtgccgtcgaattggccgccactttggactgtctaatctcactgttcgttttctcgcatttcttttttaaatttcaatttcagttccgttgttgcccggaaatacaattggacacggcccaaatttgtggaggagtcaattgtggccattgagcaggcccggcatccaattgctgaacacatttgcaaggatggaaaatatgtgcccaacccagtgcagtgagtgatgcactttttcaccaattcgcttcaattttttatttcttcagtagttccaccgaagtcggcaaagtcaaagtgctttcggggccaaatgcatcgggcaaaagcatttacttgaaaatggtgccatttcgtctgcttttgtctccactttttttgttttgcttaggtcggctccatcgtctatttggcttgttgcggttcctttgtacccgcccaacgtgccaccattggtccgatcagccgcattttgtcccgtctttacaccattgactcggtgttggacggaatgtcttcgtttgccaacgatcttaaacaagtactgtaaactgtttcattttctcgcaccttttgctatcgcttttttgctcttttttcgatgtcacgtgccatcgccaaaagtgacgaagattcgttgctgatcatcgacgagttcggcaaggtgacaatgacggtatttttacatccattcaaatgccgtttgactacatgcccttttcctcttttgtaggaggttggtctcgctctgttggcctcctgtttgaacta

SEQ ID NO: 44858 - DNA, 1727 bp, Heterodera glycines
taggaagtgaaagcagttcaaaattttaaacaatgatgactatagggagggaacccacttgcaaaacagaacccccaactaaagatattctgctgaattcaagaaacaacgtacccaaatgcaattgcagccaaactggctatctgaaggccagcgatacacatccatttagagccaatcacatgcatctgaattttgttttcaattagtaaaatggcaaaaaaatcaaaaaaaaatgtttacgtatttgccaagaagaggtgcagaaatgaacatcaccaattggaacaaaccgaagaccaacccgatttgagcctctgacattctgaagccccgtaattgttagctttttgcatgtgaattcaaaagtgaccctcttcgtttagcttcgcccgggtaaattggtcctatgcaactgaccaccacagtgctgcacagattcgaaattgccaacataacaatggcgaccaattgtcggttggtcagttccttgaacatggtcattttaatgctttatgaaaatattaattggaaaattaggatggcttttcattttgtattaattggaaaattaggatggcttttcattttgtattaattggaaaattaggatggcttttcattttgtctgttttgcttttctggtgttgtatattttaaactaatttaagctatgtaactggggttggggtaatattattaaccgcaaatgtgatttatttctaatggttttcggagtcgctgaacataaatctgatattttttgtaccaatttcgaatcccgggacatgaatttaggtattttcttgttttttctaaaataaaaaaccgacccgaccaacgtaaatcaaacaaatgctgaaacaatttattcacttatgttcaattcatattttgattaataccataaattggcaacacatgatgaacaatgattaagatgaggcacacaatgggaaaagtagaaaaatacataatttgtgggacagatgggggaaaagaacgaaaagtgtttgtttgacccactgacgacggacagaacgtaaatattaaaggcacaaccatcaaaaaataatcgaaaattgtagagaaaattgggaacactaagaaatggcacaaccgtttgttgaatttggctaaatttgtaagaaaggatttgctataattcgtgcccaatttgcatccaccaaaaatgcccaatttttacaattccgtcctttcaattgcttttcctatataatcttattgcttttttcccgttattctaactcttccgattttgagctgataagcttcagaatggctgccattcgttctgagggtgacaaatcctttctgctggagaatttctgcgccaatttggacgcttccgtttgtccacaattttccatttcattttcactttcactcgtcgaaaggtattcgaacggcgccggaggcaaatgttttttcgtcatcggtaaaaatctgaaaaaaatgttggaaattttgctttgaaaataacaatttcttggtccgttatattgagtgccaaaaatttaaatttggttgcattttttcaaaaatctttccaaatttattggcctgcccccccccccctcggtccctgtgggactgtgccgtccgttggtctcgacattggtcaaacaaaatcccgatttgcttttccttttcaaactcacattagaaggcttcgctcggtttgctccgtttcccctccctttcgg

SEQ ID NO: 44859 - DNA, 895 bp, Heterodera glycines
cgaatccttcgggagtagcttccctatagcctgtacttttttctgcgttggatttttgctccccataattgtttgagtaccccaaacggacacttgaaaaaatcgatttttttgttttcggggcagtccccctgaaccgatgcgcccagatttatggggagaccgaatccttcgggagtagcttccctatagcctgtacttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggaggtcccccccgaaaccgatgcgcccagatttatggggagaccgaatcctttcgggaatagctttccctatagtctgtactttaattctggggtgggatttttgctccccctaaat

SEQ ID NO: 44860 - DNA, 1354 bp, Heterodera glycines
aacattttacataaaagcattttacccaaattctctcgtcaaatgtccgccgctttgaacatcgctttattgtccgatcgtttggactgcgttagcatcgaaagggacgcctttgaaggcgccgctgccgctgcaagcgactcggacgtggagaaaagtgacgagggcattgaggaggagcggtgcacgaagcagcagcgacgcacactcgtgttggacggaaactcactgcaggcgcaagacttggtggactgcatgcatgacaaatgcaagctgcaggtcagaagcaggacaaaaaagaaataattaggcaattaaagtttcaaatggcaattaaaataggaaaataaaataaataaagataattattagaaacaaatgaatattaattaaataaattaaaggaactaaagaaaaaatggtttaatgaaaataggtaagtgtagaatttaattaattcaattttcttatttaattagttggctgagtcttcgcgccagcgtatccgtgaagcgcgtatatttctcgagaaagttgctgccgagcaccgaggtcagctgattaactcgttaatgtttaccaattacctttttccttttaaagttgtctatggcataaccaccggtttcggcacattttcaaacgttgtaattccgccagaagagttaaagtaaaagcggagaaagaatgaatgtatttttgttaaaagaaattcatttttattattatgtgttcaaaattcaaatgtaaatgaatgccatttatccgtctccccctaaggcaattgcaactgaatctgatccgatcccacgccactggccatggctcgccgttggagccggccaaagctcgaatgcttctcgcgttgcgcataaatgtgttggccaaagggtacagcggaatttcgctgggaaatgtggacaaattggtgaacgcatttaatggtaatgagagaaaacaattggaaaaatgtttaagcgactcttttttaattatctttttcagaattttcctcacacaaaaaaaaacctttttttaattgctttaattatttttttgaaatgcctctgtctgtctgtccatttgctcaattgcccccattagccttctgtgtgtcctatgtgcccgagcagggcaccgtcggctgcagcggcgatttgtgtccgttggcccatttggcgctgggtctgatcggcgagggccaaatgtggtcaccgcgtaccggctggaccgatgccagcgatgtgttggcagtgaacgggttggaaccgatggcactcggctacaaggagggattggcactgatcaacggcactcagttggtctccgccttgggggcattgggtaattataa

SEQ ID NO: 44861 - DNA, 842 bp, Heterodera glycines
aacaccgtattagtgctttgctgtgccgagaccctccccaagggatagctttaaatctgcaagaaattagattgccttaagtggttgtaaaaaacttttgggtaatgaattattttttgaagtgagtcaaacaccctattagtgctttgctgtgccgagaaccggtaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggctttatatctgccagaaattaaatagacaataagtgggtgtaaaaaacttgtgtatggaattattttttgtagtgagtcagacaccctattagtgctttgctgtgccgagaaccggcaggcaatggatagctttaaatc

SEQ ID NO: 44862 - DNA, 963 bp, Heterodera glycines
caccccaccaaaagcaaaacgatataaccaaaatataagggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaataaaatagtgaagctttaaaattaataaaaattttaattcagaatactggagtagcatcatagcagtgctttccctgtcttttgatgcctcgcaaaatctgttcgcttctgatcagttataaaaaaaa

SEQ ID NO: 44863 - DNA, 592 bp, Heterodera glycines
  misc_feature (567)..(567): n is a, c, g, or t
tttttgagctttttagtcatatttcgtgcttttttcgtccatattttatgttctatttgacgctttttagtccatataatttacaaccctagttatcataaattctctaacaattttgaatattcaatgactaattaaatagctcatcttgagtattattaataaagcattaaattactattttcgcttttagagattattttaatttcataaatttgttttatttttttttgttataaatgccttaaaaatcatttttatagtgatttgctgacttttttaaataaaaaataatcgcaaaaatatgaaaaaaaaatttgtacgttgatttgtacaacaattaaaattttattctatagctaattgtcggaattaaaaattcttttaattatttccttttcagttgctcgcccgtcgtcggcatttgatggatcggatggcacagcgccgggagcgtctcaaggagtcctaccgcctgcacagctttgaccgcgactgtgacgaaatgctaggatggatccaggtgaagctgaagacagctaaagaccaggtcaaaaaatttattanaaaatgatcaaaattttctggtcac

SEQ ID NO: 44864 - DNA, 1144 bp, Heterodera glycines
  misc_feature (6)..(7): n is a, c, g, or t
  misc_feature (65)..(65): n is a, c, g, or t
  misc_feature (87)..(87): n is a, c, g, or t
ctgcannggtcatccgcaaaaaaataataaattttaaaaaaattgctataaaaaaaatttatttntggaagtaaacttgggacacantttttgttgcctaaaacaagtattcggtagagaattatttgaaaatatttaaatcctagcctaaataaaataaatagaaaattctcttttttctcaccctccaaacgggaatttttttcagcttatgttcccccgttttatgcgcaacagtgttttgaagaacagttggagtagaatttgttgcagacgcttcaaaatgaataatttccattaattaatagttaattacaataattaattaattgccttttttcgctggtgtcgacatttttcctgtatgcaaattggccattttgttgcttgaacgctgaagttcactttgaattttcgctatttccttgtcaagttcagcaacatgtttcacgcagctgaaaaatttaaacaaaccaattaaaatagcgaaaaatttaaataaattttaattttttgggcctttcatacgattcaatgattcaaattaatgaaaatatttatcgctaaaaattttttaatttagagaggggtcaatttcaaatttcgcacggggcctaatttcgtaaaaattttcgtgaaaaaactgaaaaagcactggtaaagagagggaaaattttttaattaaaaaaacataacgtcatttaaaaaaaaattataaaattgaattgcattcggaaaaaatttacgaaatgataattaaaaattgaaaaaaacccactcatttactgccatctgtttctgcttcttctttttgttcctctcctcctcctcctctttctccttcttcttcttttccatttcttccaattcttctttttgcttttggtgcttccgtttctcatcgaccaatgctttgattacggtattacgtttttccttctgtaatgaggggaaaaacaaaaaattgatcaaaattgcaaaaattggtcatttttaatgaaaatctgtaataaatcagaacgaatttcaaaaaaagaaaaattctcagcgacttttggaaaatttttttttgaaaaaaatactgaaaaaagtttcagggaggaacgacgggagcgatgtgctccgccgattctttgcatagaat

SEQ ID NO: 44865 - DNA, 929 bp, Heterodera glycines
  misc_feature (839)..(839): n is a, c, g, or t
tttttattagattttatctttaatgctttaaaatgcgcactacggaggtacgccacagaaatttaacaaattttgaaatgttcagttccattcggtgtgctaacaatggaagaagagtacggcatttaccaatacaattctcagccacatttgtatcttcgtgtgcccgacgagctgttgtactcgttgaaattcccgagccatggacgaatttttgattggaacacggccaagggcaaccgaagggggacacttgcgttggaaattgaaaaattgtcggaatttgccggggaaaaagtggggagtcgccgattaagtgatgcagtgcatataaatggagtttcatggcaaattgaagcacaaataaaacagaacagtgaaggcagtacaaactatttgggcttttacctttggtatgatgcttcaaacgaaggtacaaaagttaaatgctcattaatagggcttcttctcaaatatatgcactttttcctggatgggaacagcctaaaacgctgaaaagcatctttttagcttgttttgaagtcgctgtatcatatttcatattgatatatttgtgcatataaaattttaccctcagtttggaaaatttatgcgcatattttgcgaaattttgatgcatatttttagaagccctccctattcattaaaatagagttgtacgggaccggggcgggaattcccgtcttctgaggtcccggattttcaaaatctatttcatggtcccgatcccgatagggcaaacgggaaccgggaaaacaagcataaaacttccagttctgcaaatgtcctagtggctaattatttaatattttcacttngaataaattattttttaaattttttgtttttttttgaaatttcccgtttggtactggttccccggtcccggacaaaaaccgaggtcccgg

SEQ ID NO: 44866 - DNA, 943 bp, Heterodera glycines
cagattatttaatgttatttttagttattaagtggaaaactgttaacaaattagccaaaaaaaaagatttgatttgtgaacaattattttgacaaaaaagtataagtttccaaggtgtgaaagggttcgacttccaattcccaatttctttgcaatatttcgtcgctaattggtggatttttttttcgttactaaatttttcttcgtttgtcctagttggaattttatttgtgctaaaaatttaaaaattgcgcatttcagaattttcattttgttgaattttcatattcatcaaaacgatcgtattttgccgaattcattttataagcagtcaaaattaaatattaaaattcatttttgcaattttataaaaaaaagattaaaataaaaacatttttttccaaattggccatggccataaaaatgttttgcggtctcttattaattcacctgctgaccattcaatgatcggagcgctgaaaatggagtttaactaaaatcgaaatatgactaggcttttgatcagaccaacatccaaaatcccgctcatttgattgaaaatttccgagaatcgagaagcaacatagccataaattttcccaatctgagtctggagactttcgcaaattcctattgagattcaggaaaaccctgaaagtaattactagatgaaagtatcaaggatgctttaatttcaaaaaaaaaatcatgacaaaaattgcgcgaaattaaagtctataacaattacataaactgcgttaaaattttttatttaaaattataatttaaaaaaattctaaatttgctaaaatatttagaaaatattgaaaactattaaaatattaaaacaaatatttcatcaaaaattcaaaaaaaaattttttaattgacaaatactgacgaaaaaaattctcttttttgtaagtgtatttttaaaaattgc

SEQ ID NO: 44867 - DNA, 1157 bp, Heterodera glycines
ggggggggggggggggaaaaatgttttcaaaatttttttttttttttttttttttttttttttttccaaacccgtttccaaaatcaaaaaaaaaaaaccttcccgggggaaaaaaatggggtttgaaagtttttttgggaaaaaaaacctttaaaaaaaaatcccccgggggagaggggaggggggacccatgttttaaaattttcatttttttttattttattttcctcaaacgggttcagaatcaaataaaatacctttccggggggaaaaaggggttagaaaagttatggggaaaaaaagctttacaaaataaccccctgggagaggggaggggaaacatgatttcaaaatttcaattttttttagtttattctactcaaaacggctcagaatcaaataaaaataccattcacggtggaaaaaaggggtttggaaaattttttggggaaaaaaaactttacaaaataatacccctgggagaagggagtgggaaacatgatttcaaaattttcaattttttttagttttattttctcaaaacggttcagaattcaataaaaattacattcccggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattgggaaaaaaagactttacaaaataatacccctgggagaagggagtgggaaacatgatttaaaaattttcaattt

SEQ ID NO: 44868 - DNA, 1405 bp, Heterodera glycines
  misc_feature (12)..(12): n is a, c, g, or t
tgtccgtgtttntatgtccatattttgggtttcccataaacctctattagaatggcccccatcagttaaattgcgcttctgactactcctgatgatcagaaattttccgaaaaatcattttgaaaatttttagtttaaaataaacttacttaaaaataggtaaatttgtttgaaaaatatgcaaaaaaaaaagagaggaaaatttcggctttttgatccttttcagagctttttttccttataaacgacttttatacggtattcagccattttacatgaatttgaaggaattttggaaaatttacctctcaattcggaaaatttatgttcaatttttgcaatattatgtctatatttcgcgatttttggtcctaaccaacataattcccaaccctaaatagcatacttaaaaacgcataaaaatacttaatattgatattaaaattaataatttaattttcagtaatgcgaaatttgcgtgttccaattttacttgtgctattgagcccagtgattattttcatattaaaatttttattgcatgaaaatatgccgacaaaaataacaattaaccctgttgcgggaaattttatgcaacgaaggattttgttttttgatagtgacgtaaacaccccaaagttgctgcttggaatgaacacccaagtaaaaatctgaatatttgagtcgaatcataacacatatttcttggcacaaaaaattataaaattaagccattgccaacaaaaagtcactttggcatatttaatgaggattgggacagaatttgtggaagtgatggccagcagcaatgtgtgagaaagtttgatggcaaattccagcgcaatgttgtgtgtttttgttataaaaaataattatgcattgttaaattataacttaaattaaattaattaaatatattttatattcacttttagtttattccgtcgcttaaattggccggctgtttaattgcaaaaaattcaaatgttttcttggagtcgttgttttgctacttaacaaacatgaacaaaattaacacgacaaatatcgattacgaacttttcaatttgtttgtttttaactatttataattaaacgtgacttagagagaatggcattatttttttttaattttagaccgagaattagaatgatgttttgttatgttgagtcaccgtattatgctgaattgccaatggaagaggtattttgatttgaatttgttcttttggcgttgtgtctgtctctgtcgtttccccttcagattgtgaacaatgtttcaatgacaaaagacctgaccaatgaattacagctttggaaaatggtcgcattagtgcgtgaccccaattgagcgatttatttctggttttcttaaaagagtttccagtaatcttttggaccattt

SEQ ID NO: 44869 - DNA, 973 bp, Heterodera glycines
agcacgccgtgattcagcgaagcccaactcggacaagaggcaccgcaatcggcgcaaacagtgccagaaaattccatgggaaaggcactttaagaagagggatggaaaacatcagtacaatttttacgaataaaatcccgggtctcttcaatgtcacgaacgatatttatattttgaacgctgaacccacatcaaaaaattaaagcgagaaaagacgggaccagagaccgacactttgggtggtccattcatttgtttagtttgaccattcataacgacaagataaattgatattttttccgcgttaattcaaaaaaaaaaaatcgcttctttccaaccaaactgaacgtaactcgtgaaattgctaaataatttgacctataggaaacaaaagccttgtaaagggaaagatgaaatgtgttcagttttgcactttaattcataaatacagtacataagtttggttgcttttccaatacaccaaaatgtgttaactattatgcctccgcctcgggtgggcatcgaacccacgcctttcacaaacagagcaaaaatgttataatatgcgtataaaatggcaaatggctcttatcactaacgaatttgggtgataatctgttcgataactttctttttgctgtctcttccgccgctgattactttcgcttgcttttcttttgtcatttgctttattaattcacaatgtactcattccatgcttattttcccattttattatttctgctggtttttcttgccacttttgcgctgccaattggcgcgtacaaagtgctgatattcagccaaactttcaccagaagtcacgtgatgctcaatgcgcgagtggcacagactttggcggtggatgggcacaacgtggtaaaagagaagcgcaccacggcacagagccactggcagaagcggaaacgttcagaccatcgtcgaggtgtagttcattgagccgttggccaac

SEQ ID NO: 44870 - DNA, 1130 bp, Heterodera glycines
  misc_feature (1102)..(1102): n is a, c, g, or t
tgattttatttaccatttttcaaatttttctatcaccacatcctaatccaaaattattttataaaaaattagaaaatgaaaaatagaatattctttttttatttcttggtacctttttcttcactagcctctgtgttctattgaaatcataaaactttaaatatataaattatatatttcgtgccaatttaagattatcaggcttatgtccttgaaaccgcgttcatctgtccttggagagaatacatttatttctctaatccgtggcccttggccactaaattatgtcccatccaatccgatcatttgtccggtggacatttgctaatcagctcaatttcactttgcttggcccacccgccttgtccactaaaccaactcctgctgatcactgcgtttgttgttcagtacttcagtgagatccgtcgacagctgtctcgatcagtgatcggccaatgggtggccaattggccagcaggcggactgatcaaaaattggccatcattgcctcgggcacacaaactctgtccgcccgtcaattcccctggggggtcatcggtgcttttggggggatttttccggcgactcttttgagaagccaaaaaagcaattcaatttgttcaatttcgttaacaaagtatagcctgctgctgtggccatatcattaatcttttactaaaataatattttttataataaatgaattaaaatttcgaaattatttccgtaaaatattcaggggattttctttcgttgctagcagatgccaattgcaatgtaccagcctttttggattaattttggctcaatttattttatatgtgccgctcgggctgcgaccgaataaatgcatactaatcctatcccaatgaaattgatccccggccaaatcctcgccggtcccattaaaattgattctcttccctgtgaagactaaatcatttggccaatggctaagtgattccaacaaaacatttaaccaaataaaatgggttaatatgtggccaatgttctgtccgtcttagacaaaaccatttgaagcgtcaaaaggaactcagcaaaattcaattctctcctggtactgacaggttttagagcccgntttgctttttccctgaccccatgatgtt

SEQ ID NO: 44871 - DNA, 989 bp, Heterodera glycines
tttggagcgtaattacgattttacttacaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttctaggcttagatcacatgcgattttcggcactctgataattttagcgttcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgttcataatgggatgtataaaggcgattgtagaaggaattggaagcgctaaaattgtttgaggagctttttgagcgtaattacgattttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccattttttctaggcttagatcacatgcgattttcggcactctgata

SEQ ID NO: 44872 - DNA, 903 bp, Heterodera glycines
tttcctaaatctgccattaaaaaatataggactaatttattatttattccaatcatgtgcataatatggtttttaactttcaaaaaagttaaattgtaaattataataatctattattttaaaagattacagttgatcgttgcacctagaagaacagtgaaggaattaaacatttgctttttaaatataatttcataaaattggaattaataaataaattagtcccatatttacatctcataagcatacctacctgctgatggcagatttaggaaacggtcataggtggcgcactttaggaaatgtcctaacacccataatatataatagtggtaacagaagtattttgaaaaaatgcatcagctaaaaggcacaaaatggacttaaaaattgaaaatcattttttaaagttctccgcgaacattgtcttgaacttgtgccaactgcaaccgaacaaagcatggaaaatggacaccacaaaaattcagcggccattttgaagagaggcggccaacagaaaaacaaacgcatcccatgggaattggtcgcggctgccgaagtgccgcctcattctgagcaacgatcggcaggtgggagccataattaggcccaggtccttgggggaagcgtcaacggacgaaacgcctgttttttggttttccctctgccaaaaatgctttttttcatccagtttattttcaaaatttaagtgaggtgaaataaaaataacattttttagcagattttcattaaaaaaatcatttttattaaaaattttaatattcaaaggttaagacaattgaaaaatttttttaaattgcactattccgcggggttagaagggttgttggtgtacgggtgcaaaacattatttgacctatccattttgtttatacatcaaaa

SEQ ID NO: 44873 - DNA, 1351 bp, Heterodera glycines
tgcggaattggccgccgcgggcgttgtgttcgacggaagcattcccgctggagtggcgccaatgccatcggaggcggcgtcgccgatggaatcggcgactgctcgccgccgacgcactcttttgggaatggcgggtagcagacgcgggaaaggttcactggccagcaacggcagcagaggcggcgcgggggacgcggcggtgtttagcatcggcgaaggacaaacaacggagggtggcggaagcgtacaacaatttgtgcaacagcactacccgaagacggcaccgaaagttgcccattctgtggcattgctgtgcagcagcactgacaaggccgagttgggcacggcactgcaggaactgatggacaaaacaccgttggcatcttatttgatcgtccgggaggtgatcaaaaagaggagaagaagtgccgatggggaatgttaagaaagtgattagtgataaaagaatacaaaatatgtaacgggtaattagtaatgtaattagggaatttcagggaaaaagcaattaaaattgcccgattcatttcgtcaatttcttttttttttgcagattttgttccgtttgaaaaatctttgctttgaagggcctaaaaatgacccactgaatcagcagttgctgcgcaatatgcgagcttatgaaattctgctcgagtttctctcaattccttttgataaggtcacatttctttctgctcattttctttgaataatttttttcgtttttttacagaaaaatgattttgaaatgccccgactgatcagagtatgccacaaataaatcattcaaatgatcatttcattttttcatgtttttttttctaaattagttaagccacgaatttctgcgcagtttttgtcgtaacaaccgggaaaatcaggcgcgactggcggcgcgaattgcgacggcggagggcggcgcaacggacgccgcgggggcggtgaaagagggcggcaaaatgttgggcatagacacggtgagaagcaacaaatgtgtaggaaatggggcatttatgtaccaaatttgaggcggaagactgtgccacaattgtggcaatttaccgaaacaatgccgaactgtgcgaaaatgtgccggaacagctgatcgcgcacattgtcagtctgattgagcagaagcagcgtaatgcggttttcctggaactgctgcaagtgatcgtcagctcgtgcgagaagggactgaacgagtgccaagtcaaagtggtggaagaggtgggccgaccgagagaaaagccgactgatcagcccatactgatcagcagaccattcgagactgatcaactatagttcgaaaccgatagttgatcattcgaga

SEQ ID NO: 44874 - DNA, 1087 bp, Heterodera glycines
tttcaaaatttttgttgaaatatttgtcgtgctctgaagggcgtgggagggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctattctttgctatcatgatatttttgatattcattatctagtcctatttaagaccaactgttggcccgaggatagatatttaatcaaaatttagatggacaacacggaaaatttatttaatttaaagaattatttttggttttttcggccattgatcacaaaaaaattgaaaaaacactgcgatgcctctcccagctctgatcagtgttgatcagcttaatccgacacaaataaatcagcaaaaggagcagccaagtccaccatcatcaaccggcactgttacaacactgtgcagccaccggcaagattacggaataaaattttcaagaattagacttttcgactttttggtatggctctcgaacttggataatagcctaatttggatgtccctcctccctttgccctgtgggattttagatcgagaattgagtcgggagaaccgagaactggctccggtaggacagacggagacaacaaaaaatacgagaatttgccggctcgagaatttaagttgagaattgggccccggcaaccgatacatattttccctaacccccgagaaatttctcgagtttaaaacttcggccggtataatttgatcccgtgacaggatatattctctcaaaacccccccgaacttt

SEQ ID NO: 44875 - DNA, 679 bp, Heterodera glycines
aatgtttctttgatcattttttcaacttctcagcaagcggttccctggtcatgccaagccaaatgagcagcacttccatgaggcttttattgccgaatcgctaaattcattcaaaaaagtggaaaaattggcttcttctgtctctttctccctctctctccctccccctctctctctttccctttctctctctcgctccttttcactctttttgtctccctctttcctccccactctctctctttcctttctctctctaactccccccccccccccatcctcctcctcctctctctctctcctttctctctttcactcccttctctccctccccctctctcctcatttattattacttacatttgatggttttttgccataaaagggtgtttccaacattccggccaattttcggtaaagcctcgtgaagaaaaagcatgccattgcatagttttctgattttttctgttcttgaaatttgactttgttttctgtttggtcatgttgttgctgttgttgttgttgttcaccagcagcatgagaaatgttgtcggtgctgaaaaatgaaattttaggggaaattactgtggaatctccaaaagtttcagaatttacgtcttttgttaaggcctcttgagaaaagttgaaatatttttcttgggaagagaataatttaaaa

SEQ ID NO: 44876 - DNA, 1253 bp, Heterodera glycines
  misc_feature (1046)..(1046): n is a, c, g, or t
  misc_feature (1079)..(1079): n is a, c, g, or t
ttcaaatttttttttttttttaaaaaattttcgggttgaggttgttcaacaaacgttggggtaatggcaccagaaatcttttaatttttaccacaaaaaaaacttgatttttcccaaaaaaccaatcaattttaaccaaaaatgtcaaaatttacaaaaaagttttttcaaaattccgaaatggtgtttatttctaaaggttcccctaaaaaattggaccattttaaaaaaaagctcgattttttcaaaatttttttttataaaaattccggttgatgttgttcaactaaatcttggataatgggtccagcaaaaccttattattagcaaaaaactattttttaaaaattttgaattaatttgcttaaattaggcacaggtggtcgactggtaccagtcccacccggctacggctgctggctgagcggcattgacgtgaacacgtagtccatcaaccagcaattccaggttaggagttcacacacaaaaagacgcgtcgaccagcagcactttgtaggtttcctcaatttcggaaaccaaaaatttttttaaaaatttctattatatttttgaattattaaaaattctgtattacgttttcgggttatttattgtgcaaaagtatattttgtgggcgttttcaaaccaaaaatacaactttgggtgttttcaaaaatgcttagttggattatgagcctctaaaaccaaaaaaaaaaaagaaatttttttcttttaaaatatgactaattattggaacgttaaacacaaaataactttttaacatcgggattttccaaaaattatagtcaaaactgtgaaaagataaaaaaaaattttggtacaactctggtccccataaaattgaatttttttttttaaattatgaaaaaatttttgttattgtgaccaaaatgtcaaaaaaaactaaaaatgctttttggtccaattctgggccccaaaaaccgaagacattttctttacatctgatcaaaatggacatattcagtagaagggcctggcttgaaaaatttaaaacctatttttanatgtttaatgacaaattggcttaatttcttctntaaaaattttaaaaaataactgaaaatttttcagcaaatattcaaaaaacagtttaaatggctatgatttttttcatttttagtcacaactttttcttacttgaattattttttttgttccaaatttaaaattggctttttttagccggaacagatgggacagaaagcgtccct

SEQ ID NO: 44877 - DNA, 1173 bp, Heterodera glycines
attaatgactttttgatcagcatcaaaattagcacaaaggaagtttcggatttttctttctttactaaaattaagattttggttgattgaaccttttgggccattacttttgcataattaaaaatctggttaataatttgggtagccccagtaatctttttttaagtgaggggtaattaagcctctttttattatttattgtcaaatcttatttttacttgataaacatatttagcagaaagttcctttaaaattatttgtctgctaacgttcatccaaatcatttgtgcttctcggtgggaaatttcttgctgaaccaataatttagaattacttaataaaaataacgtgaaaattaatgaattattttttatatataaatgaataaccattttttagggccagggtttttactaattaataaaagttaaaattttcgttagcgattaaaccatttttattcattttccttaagaaaaattattaaaattttggtcactattttcatcatttttgccatttttcgtcactggttaatatcttaggatttttcataattattaatataagcctaattaataagttaatgattttttctataaaccttgtttgagatttgaaataaagtattgcgaccaataaacggtgcctctaataaggaagataattttgtgaaaagtcgtgaataaaagaacagcaaagcgccacgcttttttgcattgtaatgttcgggtgttatgccaaacacgcacaaatcattgttgtcagttttccttaatatttcatttgttttaaaggtgtgaatattattcataattatttgaaaagatgtttgcaatttttcaaaaattttaaaagaaaataaaaattatttaaaccataaattggttaaaatttgttgtaaaaatcgacctgaatgggtccaagccccacacatttgtcatttgagtctcaatttgaccaagaaaataggcaaaaattggactttcttttgtgattttgtctccaaacaatcggtcatttaattgttttaacactttattaacgtcaatttgttcttagaacttttccaattttgccgtgttgagttcttttgaattttggaaaatattttcattaattcgagatcaaatgaattcaagtgctaacaaactccactcaagcatttgaaaa

SEQ ID NO: 44878 - DNA, 455 bp, Heterodera glycines
gcagctgaagattttgcagttggttcatattggtaaagtgggggacaatcaactgattttgctgtcaatcacaaaacaaattttgaggaaagcgactaaacattattaaagttggggctcacagaagtgctgctttctcagaattttgttgttttgcaaaggatcaatgtttaatttttcgtttttttgaaaccttgttttactgagttttctgtgaaatttgctttttttttttggaattaagcggattttttgaggcttttcgaaaatttttttaaaagcttttagcaaagaaaacgtttttaaatttatgacgaaatgttgttgttcatcactagggatcggattcttagttttttaactattttttctgcggctttaactcgacgagaaatgcacgaaaaacacattctttttcgaaaatttttcgtttttagtgccactattcatcacta

SEQ ID NO: 44879 - DNA, 981 bp, Heterodera glycines
  misc_feature (893)..(893): n is a, c, g, or t
aaattaaatataattttttatttattaactcaacaaaatattttaaattaattaaaatcattgaaaataacgtaaaaatgcacaaaaaaataatgttacaccgtccggattcgaacctgcccccccccctcaaaatgatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaaccatgtgcacccccctttggtcccgaatcccaaaatcacttttatttttgtatctttttttaaaaatgtgatagaaatgccaaataaaatttatataatagagcaaaaaattgcggatttttgtagtattttacttttctcaaatagcttttcagaagcgagttctgaatttttttctgaaaaatctaaaatttccagaatttctggaataacttttttcatattgatgttagaaaacctaaataaatcccataaaattctcctgatttttctctatttttaaagctttatttgctcaaaattggtaagcccttaggctagatatgaattttccaatattcgcccaaattgccgagggccaaaaaattgccaaaaaataaagaatttttaaaaaattccaaaaattatgaaacttaaaatagacatcatattcgtgctcagcacctcaaaatagcccagaaaaatatttttcacaccctttttcgaccccaaaaaaattttttgaaatttctagggggcctagctcgaaaatttttgaaaatttacatcatgtagtaaaccattcgatagcatttaaaatgctctacaaaaatggtctaagacanatttttcgctaaaatcaaaccccctgacgagttatgggcccaggactcaaatgtcccgctcaagccaaaatttttttctatttccggg

SEQ ID NO: 44880 - DNA, 1240 bp, Heterodera glycines
ttaattattttttcttgtgaagatttttggtttaaaattgtccttattcgaaaaaactttaaaacaattgaaatataagcaaaattatgttttttgattaagttttacgtgttttgtttcctaaaagctttaataaaaaattttatttgcctatttttgtgcctattcgaggatttttgcgcatatttaatgcctatcatttaaatttccatggaaattcaaaaattaaagtcgtaaatggcaattcaatccaacaaaacataggcgaagtgaccccgaccggtgacccgcccccccccccgtcatggtcatccttaaacagtgtaaaaatttctcggtttccgagactacaaatccgagaccgagaagcgaaaaacccaagaaatttctcgagtccagtaccgagactctcgcacatccctagtccgtaatggctttttatattattaaatttgaaaatttccctgccactggaatttttatgtaaagttcaattaaaatgggaattggtcctttttacccagtgtttgttgagcacattttcagcgcgaacacaaattttggtacatatttttctcgaaattcttgtccatcaattagaaggcacaaacggattgccaatgagaaaagcaacttggacaatttcacattgaccccagccgaaattgacttttgccgcttttcagccactaattcttcgttattcgaggcaactgctcgaattgtttgcacaaaatccatgtcatcactgactttgaaattctctttgaaatttctaaaataaaaaatttaggcggcttatattcgagggggggggggcttctaatcgagggaacacggtaggccaagaaaactcaaatttacaaaccgttcgacaaattcaaacagccgcccaagcaaatgtttggcaaatgatagcgtaaaagttaacaattgtttgttttcatcatattccatattttttgccaaattttttttcattgtttcgtataaaatttgtccaaatcgtaacatttcttttctgtaatttgtcaacagaattcctccatttttgcttgcttctctttggctggcttttgtgtaatccgtgtggatgttcttcaatatttccaacagatgtccacttaatgactcttttaactcttttaacttttccaagtattttttgtcaagtttttcaaaaaaaattttcaatttattcattggtctttcgttaaaatcgtcaaaatttttgtacaaa

SEQ ID NO: 44881 - DNA, 1330 bp, Heterodera glycines
  misc_feature (1287)..(1287): n is a, c, g, or t
  misc_feature (1313)..(1314): n is a, c, g, or t
ttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttccagggatactgaaaggaaaagaattaacctgttttatcacattagcttgtcatcagtttttataaaaaattttcaaaattctgcgtctcctnattattttatttttttttcaagaccnntgcaggcccatgcaag

SEQ ID NO: 44882 - DNA, 807 bp, Heterodera glycines
tatttgttgacacatggtatcgagtcttggcaagaggaatgtgttcgagagtctcgactcggcagaaatctcagccttcttgggtctcggctgaaatctcggcgttttttgggtctcgagtctcgggtcatgaataatatgaacttgtagctgttttttcgtcaaaaagtgactaatttttttttgccattttggggtcaaaatagctaaaatatgggaccggcgattcctttttgaaatcttaatccattgtgtcaagaaaattgattaaaatggccagccatccttatctatctcggctgacacattttgtgcttcttctttggtttcagccgcccctaaatacttttttttcattgaattacggtcccgaccctccgggccaatttttcttcggcagaaataaaccaaaagcataattcgcacgggaattcctattttcagttaactaattttaatttaattattttattcatttgtgatttgtgcatttgttcagtacttcttggatcgtttctacttgaatcggatttccatacgaatgttgcaaaaccaacactgtaataatattattaccaaattattaaattttaattgttttaaaaaacatttaatttcctccctttgtaagtggcaattttcgccgccgcctgcgacaccaatggcactaacaatcagtcgcgcaagacagtcgtggtggacccggccggccatgttggacacattgacccgcagtgcaatgtgcgcgacattctgctggacgcctacgaaaacgcgagataattaatttattatttatctaattaa

SEQ ID NO: 44883 - DNA, 1243 bp, Heterodera glycines
attgagctggatcatcggaagcgctattttcggacacattaacacacaatagcaaccagtctgccggattgagtctgccatacagcgccaattaaatacatatattttgttaaatattaaattcgaatttggaattaaatttttaaagtttaataatttaaatgaatcgacaacagttctgctaaactctaatgggaatacaaattctcgaagtatttaattagaaattataagaaattaatttatttgctcaagagtgagaaattctgaaaatttttggataggtttaataaatatattttattaaaaatttaaaaatattattacccgatttcttggatttgattttaatgtcctgtaaatgcggaatttttttccattttttgaaatttcttgattcagccgatcctactattttgactatttatcagttcaacaatttcacaaattttgtttgatcgatgaatgaaagcaataagcagaacatttgcttgccatctactggagatttaatgaaagcagcagctgttgaaaaaatacgtataaagtcaaaggaacatttattttcagtttcatctgtttattaattattttaattttgaacaatggataaatatacatattatttttatatgtttttccacatatttttgtatgagaatgcacaaaattcatttttgaccgaaatattttgtgtaaaaacaattttaaattaaaaaaaaattgtactccgtggtaaataaatattaattcacaatatttattattattatttgtttccctgttttgtattctaatacaggaatcattaattttcgattacagataatattttaaggtatttttattaaaaaaaacaattaattttttgtgtaaaatgcgtctttgggccgcttcacttggcttttacgtttccattgtcatattttgtgaaattttgcgcggatttgcatacagattcgagctgcacacacagattggtggtgaacatcatcaacagtttacatctttgatttatgaggtgggtaagttgaaattaaaacttttttttaaagcctttgttaaattgagaattgaaaaagctcaagttttagccgcttcaaacacttctgatcaacttctttcattctctagatcgatttgtctcatttgagagaattgtccttgatcggggcctcaaagaaaaatctcccttactttacaatagccgccgggaattcgcgcgaatccctaccgggaccga

SEQ ID NO: 44884 - DNA, 1190 bp, Heterodera glycines
  misc_feature (1178)..(1178): n is a, c, g, or t
ggattttttttgaaaatttatgattaattaagtaagtttttttggaaaaattttccaaaaaatcccttaaaaaattttttcaaaaaatttttcattggaatttccatataaaaaaaattctaaggaatttttttctttgaaaaatttccaaaatttattaaaaaaaattttttggcgaaattatgtcccggcgaaatttcgaccggcgaaattccgtccggcgaaatttcggcggcgtaatttcggcggcgaaatttcggcggcgaaattttggggtgcaccctgttttttcgcctcatttcctcccgtttttcagtgacactccgttggattccctgctgaagacccatctcttctgcaactctctgaacattgctcaaattcccctcgtttctgatttgaatatgctcaacgaatgcttttccaattccgtcgcttttgatgagaatggctgcaaagacaataagaaagtggagttaccacaacggtttttggcatttaactttgactgtttctttaggactctgatgatcagtccagcacaacttcagcagctactccgtccatttcctcaacgttttcttcaaattcagagagtatttcctcctcaaacggactgaaacggaagggaaatgggacggcatatttcattggcaaaatgcgaaaattggaaaggataagaaaagtacattttgcaatatttgaacttaatttcacaattattgttcatacgttaggtcaattattctgcagaacggataacaccacattatttggagaggttaaaatgctatttcgacaaattgaagtcggaggaacaacgaatgggtcatttcaaccgaattttcccaaggaaatggacttggcacttatacaggtgaacggatgggtctatctttttcattatttagttttaatatagagcgattctcgaggactgcggccaggagaaatgggacgaagcattgcacaaccgaatggacgctgaatattactcgaaatatgagtacgaattgacactgaaggacgttgacttggtccatgagcagctaatggacgcaaaaatagtgatttttgtccttttttgcaaaaaatggtccaattttggtttagttcaggcgaagggaacaattggcaccgatggctcgcgacgtccttttggctgaagctttttgcgngaccgaacgttt

SEQ ID NO: 44885 - DNA, 281 bp, Heterodera glycines
tgcggacatctacatttttgaattgaaaaaaattggtaattactctttctttttctccatattgaccatcatactcatactccccccacccttttcttcttccgccaccctttctcctccttcatttttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtacatagatga

SEQ ID NO: 44886 - DNA, 906 bp, Heterodera glycines
  misc_feature (841)..(841): n is a, c, g, or t
acttatttccaatctaatttcttgcagatttacatctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaatcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagaactaatacggtgtttgactcacttcaaaaaataattcattacccaaaaattttttacaaccacttattgccaatctaatttcttgcagatttaaagacatccattgcctgccggttctcggcacagcaaagcactaatagggtgtttgactcacttcaaaaaataattccttacacaaaagttttttacaaccacttatttccaatctaatttcttgcagatttaaagctatccattgcctgccggttctcggcacagcaaagcactaaatagggtgtttgactcacttcaaaaaataattccatacccaaaagttttttacaaccacatattgccaatctaatttcttgcagattgaaagccatctattgccntgccggttctcggcacagcaatcactaataagggtgtttgactcacttcaaaaaataattcatta

SEQ ID NO: 44887 - DNA, 1129 bp, Heterodera glycines
cttcttttttacgctttatgtacaatttattttctgtatgttttgctttactttttttgattggacatttgttttcattatttttttactttctatggataaagcattattcattaatcgtctcaaaaattaaaaattatccaccgccacctatcggcaccgtcggactctcagtttgttatgtttatcattgttgaacgcctaaaactagagctcagtatattaaaaaagcctggacctagagaactgaattctatgtttgatctgggcatggatttcctggacaaaagtccatgaaaatccaggcttgaaaaaaccaaaaaagtcccaaaaatcattttatagtcatttttaaatttatttaatcatttttaataaattggaataaaattgatcactttaaaaaatcagatatatatccaagaaatccatggtcttttttcatgtcaaatctgtcctagattttcttcatatttgacttattcctggcttttctggaattaatccaggaaaatccaggtccatgctgagctccaattaaaatctaaatttgtttatctttttttaaaataaattttgaatatgctaaaattattattgaaaaatttaaattatttaaatcttccaattttaaaaatccaaatccgcgcccgatcatgtttcaaagctagtttttcggtttggtaccagatatttttggctgtcctgttgggcacagaaacatgggttgtacgtatgtgtgtgtatgtcagtggccttattgtttgctcagctttttctcccgccgcttttgcgcggctaatcactcgcggctttatccctccatttatccgtccagcgcctctttgactgtgtcacagtgggctcccaccagcaccaagcaaaagcaaacatccgctccgtccagtccggtgagcagagggataaatgggaccgacaatggtggtgagggttggctgatccggtgatccagaaatgcgcaagagcggcttcatctccctctccctctcgcgcccctctccaattcccccctttgtttgcgtacacaaatgaatccccccaaattcttcccgccctcttattcagcagcatatccccggcttttccctccccctccacctcccccctt

SEQ ID NO: 44888 - DNA, 1656 bp, Heterodera glycines
ccatttataccgagggttaggtaaaaaattattggattatgaagaattattgacttatcttatccaaatagaaaggatagtcaatgaaaggccaattacatacattgagaatgatgaaattatggagcccttgtgcccaatacatattatcaatgcatcagaaggggaaccatttgagtatcagagtggcactaatgaaacagaggatacagacgatctagatgctcaaatcaaccaaacaaaacgggatgaactcctcgaagttcacaagaaaacaatgtataagagtaccaaattttgggaagtctttagggatgactatttattggcattaagggaaaaggaaaaggccaaaaatgtggatgaacaaaggtttccaaaaataggacaagtggtactaatcaatgatcaaaaaccgtgtcctcggaataaatggaaattaggtaaaatagaaagtataatcaataacagaactgccaaattaaaaatgcccgacggaaaaataatggaaagggcgacgattttattatacccactggaaatagagaccctcgagtctgaccctaatcccattaatgaaatttcagcgttaacaatggaagacacagttagtttggcaagcatggaggaagagtggtacgaaattttggtttctcaaaaccttcagaaagaattggaaaaagaatggagcggatttttggacatgcaatttaatacccgcccgtatcccgaatttggatgctaaagtttcaactcaaaggggatctctcaagatccaggttggagttggaaacattttgaatggttccggttatttaaacacattcggttggtctctcatggctatgcattatgttgagggaagaattaaattaaaggggattttagagcagaagcaaaatcagttcctcgaggctgaattaagtcaacttggtaaacccgttaaagatcaagtttctgtttttcggggagtgtccgaaacacaccccttttcggaccaatttactcaccatttcccaaaccaggagaagtcggacatcggaacaagtctcaacttggcggagcgaagcgagcaacgaatttgcgacaaggcggtcaacgagagcggcacaattggacgggacggcgcaattgaacgagtgaagaaaggaacgaaggaggatggcgcaaatggagagaaaggagacaacgacgaaattggtgaacggcggacaaatttgacaatttttcaaaatgctcaatatctttaatttttacttttttatttattttgtcataatcactttattgtttttcactaatttcactttgtcactttgccccgcattttctcatctctttatctccgacgaacatctcttgtaaattgcagcggtctcatccgccatatttaagccatgcatccttgctcattctctctcttcacttcacttcgacaaacacaatttaaaatgccttaaaacatttttattgctcttcgcatttccatcaaattgctcaataaaaattcctcgaattttgagaacaacggaaggcaagggattggaggttttaagtgattttccgcctcaaaactaaatcacaaactttttgaaaagaggcggaaaaccatttaccaatttattggcatttggattttcactcatttcgtcaaat

SEQ ID NO: 44889 - DNA, 1005 bp, Heterodera glycines
  misc_feature (67)..(67): n is a, c, g, or t
aaaaaaaaatttaaaatcatttttagtacgtaaatgaaaaatgtaaataaaatgagaagtagacatntatcattattaaatgatgggacaatttttttgagaatgaaggaattttaaagtgcatttgctcagccaatgtttgccgagcgcctttgaaaatgacgggagaattttaacagacattttgttactaactaaacaataaaacaaaaatcataaaaaaaatttttgttaaaaatttggaaaaacgtaatgcaaattttggttcaattggaaatttttttaaataaataaaaaattattttaaaaatggaaaattatttaaataaaatttgagaaagcgtgaaatttgttttacctgccagtattttcaaaagcctaagcatcaatattaatagcttattacatatatttttaaaaaataggcttttcaaaaaaaaattctgaaaagtaaaacgaaatttttttgaaaatttacaaatagttttagaatgtgttggagtgtttatcttaagccttctaaaatttcatagtgccaaaattattattttttttctgatgacatcactcggtgtttgaccattaaaaagtcacaaaaattccttttttgatttccatatttaaagaaacatttctttggaatgttcaatttatgggatagaatcacaaatgaaaattctgcggaagctcaacaaaattgtatggaatttcaaaaattattaaatttaaggggaaaaatagctttgcttaatttaatgcatttgatttctatattaatcaaaataaaattgtaaaaattgaaatttcttaaatcatataaattcaaggattttaaggatttatcccaaaaaactttttaatatttaatccttcaagaattttttaaaaggataaatgtcataagattttggcttgagcaacactttccccccccccccccccccctcgccgtgtgaatgccatgcgattttcttttattgggtaagaagaaaatgttcattggtg

SEQ ID NO: 44890 - DNA, 823 bp, Heterodera glycines
aaatggggtatgaaaagtttattggggaaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgaaaagtttattttgaaaaaaagactttacaaaataatacccctaggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaactttaaattttttgtagtctaatctactcaaaccggttcagaattcaataaaaataacattcacggtgcgaaaaatggggtatgaaaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggg

SEQ ID NO: 44891 - DNA, 1388 bp, Heterodera glycines
aacattacaccatactttaaaaaaaaataaattttaatacatattcactgtttttgtaactgggagaaggccaaaatggaaacgctatgtaaaaacgcaaagttctcatcatttgagcagtttgaattttcatcattttcgcatccgttccgtcggcaaaaagcaaattagcagtcataattctccatttgtcaaattatggtggctgtgtttctactagccctatttcttttggcctgcgctttaactcatcctatagaatggcaaggctttatcattgacaaattcggacacagaatttggttagttcggaaagacattgttggtctgcgaacgtaccgcgcccctcacctccccccctccccctccctccacctccactcgatcccttccactcctcatctacattcattttcaagaccttattttcaattcaaccaatttgtttttgcgataaaagcaaaaagtggttttgattaaattataatggcggccgaaattgacaacgaatccgacgcagaacaggatcatggtttgtaggggaatttgaaatgattgggaaatgaaaatatcagcaatttgaagaaagcgtttacattttaaatggtttaaaatgcaaaaaatgggtttttccttaaaatgaacaaaaatgcaaattgttctttttcagtgggtaccaatgccttccagcgaacagtttggcagcaccggtaaccaattcatttacttttcaagtcggatttccatttaagtcttctgccgtatttcactgagcttgaggaagaagcgaactcgcatttctgccaaatcaaaaggttttggatgcgtttggttgggcaattgtttctcattatctccacaaaaaaatgaaaagatcacttgaaaccaaggggcactttggtaagatgattgtatattcgaactcttcatgggttttatttaaaaattaatgtcaaaaattttgctttaaaaatatttttaaataattataatttttacatacatatgaccacgtggtgagtcgttccacaaaaaagctcggtgtgggcgatccacaaaaaagctcagtgattgattggtcattttccggaagcctatcgcaccactttcgggcaccaaaagtgcctgatccggaacccggaccggcccggttaagaacaattttttgttcagtatttcaagggctgtctcccaggccgggtccggttcttgatccattcacttggagcccgtcatgggtcggggtaaaagtgtctcaattatggtgcttttcctttccagtggcattgcccattccgtgctttgccgtgaccttcgctattctttggcggtgtggggccaggaactgacggggttcctcaattacaactcacttagattttccgtaa

SEQ ID NO: 44892 - DNA, 1073 bp, Heterodera glycines
ccgtcgttttcctttcgttcgttttttcatccaaatctaaaaatgggccattttctcaatctttctaaaattaattaaataaatttaattttttttgctcttttgcctcggcttccgcaaattgtccatcgctttaagccattgactttcctccccgaaacttcgttctgccagtgcccttcgctcttttgatccaattagcacagtcgcctccgccgttgtttctccgttaagcgttcgtttgttcccatccagcaaatcggacaaacgaatgccccggggcggtagagcggcatcttaaaaggaaacggacgaatggtactattgggaaatgaacgaaaaatgaaaaacgggggaaagggggccaaacgtaccgaaaaagtcggggtcggcaaagatctgtcgagtcgcgggcagaaacatataactgagggaatgagtggtgagcaaagcgagcgaaaggacgaacagcaaaagcagagaagaggacgagcagagggaaagggggggacgacgagagacggggaaaagcatttgggagacggagaaacgaagcggaagaagatgaagcggaaagggacgaggcggaaaagcggaggagagaatgccaacggaagagggcaaacacagacgggcaacaactctgaatggcactttcagtcaaagtacgaccagaaattttgaatggctgtaatgggcgaataaatatgcaaaaatgcggttttgatgtgaaaaatgtaaattctattttaaaattgagaaaatttgaagaatgagaaaagaacatgggaaaaacccaaaaaagaagagaataaatgtaaaataataaaataaatgaaaaaggaagggcacggcaaattatacaaaaagaggggggggggggggactcatttgccaatgccttttcaaagtcaatacggtaattgcaccggaaaggatcccgaacctaaacattttcagggacaatgcgaatttacgtgaccttggcagtaaattaatctaatttttcacgattttatgaatttttctcttttgccatttcgacgaaaaagatgtaaaaattgtgagagggg

SEQ ID NO: 44893 - DNA, 1131 bp, Heterodera glycines
ccctcacggttcggccctcacggttcgcccctcacggttcggccctcacggttcggccgtcacggttcggccctcacggttcggccctcacggttcgccctcacggttcggccgtcacggttcggccctcacggttcggccgtcacggttcggccctcacggttcggccctcacgtttcggccgtcacggttcggccctcacggttcggccgtcacggttcggccctcacggttcggcctcacggttgggcctcacggttcggccctcacggttcggccctcacggttcggcccccacggttcggccctcacggttcggccctccggttcggccctcacggttcggcccccacggttcagccctcacggttcggccctcacggttcggccgtcacggttcggccctcacggttcggccctcacggttcggcccccacggttcggccgtcacggtttggccctcacgattcggccgtcacggtttggccctcacggttcggccctcacgattcggccgtcgcggttcggccctcacggttcggccctcacggttcggccctcacggttcggccccacggttcggccctcacggttcggccctccggttcggccctcacgagtcaggccgcacgggtgggaccaaagtggtcgacgaggacgaggagcgctgcctgtactgtcaccgctcgtttaaggaggtgtcaaggtacaaggaccacgtgcagtactgcagcaaagcgagccgtaaacaaatgaaaacggcataacgcatgaaacattctggtggatcgttggaggacggattgaacagctcgactggaatggttggcgacgagtcgagaagcggataagccatgactaattccaggatttttgtggaattgttgtctgggatttggggattgccacattgtaaattctcaaatcagccaattttcaatttccattaaatagtgccccaaattcagagttgtttcggcgacaccgacccatcgtcgttccgatccgtcgtcctccagtgactcatttgggcaacagcaacaatcgacttgccacttaccagcccgctgggttcggcgttttcgcaatgcaacccaaatgttgagcaaacgttcgtttgccggtggacca

SEQ ID NO: 44894 - DNA, 1572 bp, Heterodera glycines
  misc_feature (1309)..(1309): n is a, c, g, or t
  misc_feature (1465)..(1465): n is a, c, g, or t
  misc_feature (1487)..(1487): n is a, c, g, or t
aaattggggcagctacatttaacatttgaataaagtaaaacctggacaaattttatttttagtacctaagaaaacctagaaattttttatgcaatttcgagtctggatctcagaatgatattttcccattatccttccgaatgctgactatatttattcatcttaaaaaaaatcacaacccccaaaatacactaaaaaacggaaaattttcaaaaaaaaatcgtatggggtagcacctcagattacccctatattttcctgaaattaaaaaaaggattcatcgggattaatcctagaatctcgcaaatcccgcagcggaatctttgaaacttcgaataaatttaaaaatttgaaaaaaaccttcaaaaatatagcagattttataaagatttttgatgaaataatgtaaaaaggagaaaatgtaagagaagttaaaatttctcctgggataaaattcttttctttttcacttaatgtttgcaatacgtacatttgttcatgttacattatttctttccaatttttcgttttttagtattattattgttacatattgcacttgattgattcttcatatggaattggacacagtgcctcaacatcattcggtaaaattgactttttaattttacgcgtcccatggcaaaaaataaagggaaaaaattgaaatagaaaacttaaaaaaacaagctagaatcttctttttataatttttcttaatgatgtcaacagaaagttactaatataaaaaaattttacaaaaaaagcctaagcctaggtttaagccaaaagcttaggcctagtctaagccattgttcgagttgcctgtgtatgagttgttattatactttatgtttaacaatgaaattttagttaaaaaattactgaataccggacaaaaaaaaggtttcatcatagtattaggacggctaaaataccatagaccagggatagcacttaattccggtttccaaaaaaaatcatttgacttaaattccaagccccattaaattttaagggcaattgtgaaaatggaaattgagtgcgatgaaagcgaatgttccattgacatttgggtctttgatcagagctaacttttccatttttaatcgttggagaataatttattcgtctttacgatattccgataaatgaacaaatttcatcaattgatcatcggttgatgtgaaaaagaacagacgaaatatttaagaaagcgttcaaatttcgaatagagtggaaggcacaatgggaaaacggagagtggacagacagacagacagacaatggaaaaagaattgtgacttgngaatgagcatcaagacaatgagtggaaagtgccgcaggcgaaagtggtctcatttcccaatgtcgcgactcacgtcacgagaaataaaatggaaatgataaattttataagcatgatgcaatttcatttaaaatgggaaaaccttaatttaattgnaaatgttccccctcttcgtcgntctattcaaaaaatatttgtttgtttacatttcatttctattcatttctcacacaaaaatgtattaatcagcgaatgacacccta

SEQ ID NO: 44895 - DNA, 1552 bp, Heterodera glycines
  misc_feature (1395)..(1395): n is a, c, g, or t
  misc_feature (1513)..(1513): n is a, c, g, or t
caaatcgaaatttccagagtttatggaaaaacttttttcatctttatgttagaaaacaaataaaatacataaaatactcccggtttaattggataatggggggggattaatggatatgggggataaaaagagcaaatacggtaactttatatttgttgttaatggccgttttacgaaacgcactagcagcaccttttatatgttgaaaaactcaatttttcaataaaatataaaaaaaattcgcgtaattttcaattttggattaaaaaatcgatatttttaatatttttgaaaacattttaaataattaattcagttaaatgaaaatattcggacgggccgacaattggcaccaaattttttgtgccattttattgccgtttttctttcatttattgtgtcaatgaatcttcaattcggaattataacaaatgttgaaaatatattgttattttaccaagctttgtttcttgtacatgctttcaatgactttgttcttcccattgcaatgctttggtcagtttccatttttaatggttcctaattactctatctgtgataattaattaggcgtgaatttgataagtttgtcattaataaataatatatactttttaagaaaaatttttatgatttttttaaaataaaatgaaaatttttacgattcttttaattcattaagttatcatccattgctgaacagaaaagccatagcgtcattagcgatcattaaaaaattgtttcgaaattcgtccgccgttttgccatttgtagaaacggcacaaccattggacaccgacggacggccaattagtgaaagaattcagcaagaaaaccgggacaaagaagcgtactttaagcaattggcctcagcttggggggacaaaacagatcatgaaaaggaaatttgaactttattgaaaaaaatccgagaaaatttcataaaattttattgaaaaaataattagcggtgataattacacagaaaatctcgcgcatgaaacttgaattataaagaaaatcagtaaaattttaaataggataaaattttcaagaatgaaatcttgatttttgaaaataatattcgttagaaactgtgaaaaattataatgacgcaaataatttatatcgttttcaaattatgaaattatcggattaataaaatttatagaaagctttcaatctttttgatttttcgatagaagagaataaaagttaattctaattttttaagatttttttgaaaatttttaattaaaattttctaagatttttttttgttttttctaaatatgagcgaaaatccatgctaaaaattgggaaaatccaatatctttatgcataaaaatccaaagaaatattttattctttattatttttttttcgcccacaaanatttagggggtgttttttcaattttcttgtatttttctacatgtttttctcaaaaatgccaaaatatctgccaaaccccgaaatatgtggttttatgtgccaaaacgccaaaatatgntgttgtttatgtttttataagtcgctctaaatcgaaaat

SEQ ID NO: 44896 - DNA, 1193 bp, Heterodera glycines
gtttttgagccagttaaaacttgaaaaattgagtgaaaaggggggccactgaccctttaaaacggtcaaattcggacaaatttggttatcattcgaaaggtcttgaccaaaacaaggtataaactcgaaccgatgtcatctaggcactgggacaactgagtcccagtgaaaatggacactttagtaccaaaagaaataaccatttaaaagcaaaaatttcgcaaaagggagcatgcgaagacggagaaactagtggggcgagacggagggcgtacgaaggcagtctgacgagcgccacaggcggttgactgcggggggcccccgccaaccagtcaaccgcatgcggatcatgcgcggactttttctgtagcccgtgtcttgccccacctactggccaccgtccgtagtcgaaatgggtcggcattccgaactctttggtaaaaggtaaaattttcggaattttttttttttttttgcctgctgatgtatttcattttaatatttttgtgaatatgttcgtatttcatataatctcttaaaacagcagttcatctcttctttccgcctcgcgtctctgctgctcccttcgctcgatcatttcagcccatctttccgagtctctagccgcactagaagcaatacaagcaatgaaaatcataaacggaactccaaaaatgacggtgatggcacttatagcaatggctgcataaatcattgcatcgaatacgggacgccaaaagggatcagtgggcagccaaaagggcggcttagtgacagcaaaagaattgttggaagaaatctgttgaaaaataaataaaccccaaaaaaccgccccaaaaaaccaaacgaacagtgtctgttgttgtgctggtttgagtttggttggaggcacagcagcacaacaccaaaaatgaaaggagcaagaaaaccaagcaaaaggacagcttaaaaaaaagaatttacctccttttagttacggaaatgataatggaataataatatgtccggccaatcatttgtgaaagactaattgaaagtgtctttgtttttatttgtaaaatgacacaaaaatcgtttctttttgcttaaaatgccgttgcgtacaagtaaaagttgtttaatttgagtgagcaaaaaaaacaacaacagctaaaatgatgaataatttagagggcacatacctgaacccatgg

SEQ ID NO: 44897 - DNA, 1327 bp, Heterodera glycines
  misc_feature (1234)..(1234): n is a, c, g, or t
  misc_feature (1292)..(1292): n is a, c, g, or t
ataataaataataaaagttgcagagaaataaaaaataaatttttatttattctaagaataacatcgatctcattggtaattatataaaataacatattctaaatatttgaaataatgcgaacagataaattattaatatgcaaatattctcgttgaatccaaaaattaaaataacaaatgaagatgactgtgataccgaaaggaaatatccttgaatgcagtttcatgtggttcccgagaaaaagctataaaatgaacttcatgaaaaataaccaaaaaaagagaaattaaaatatattaaataattaaaactctaaaatttgaaataatgcgaacagataaatttttgtatgcaaatatatcgatgaatccataaaattaaaataacaatttaaaaaaatattataagaaaatatcactcatattttattttcaaaaaacccatttgtttaaaaataaattaaatattaattattagtttttattcgtcattctaaaaaataatttcattttaagcttttaatctctaatcaaccaagtaccatacctaagacttgtcttcagggcaaagagaaaaaaacataaaaaattaattgctaattattagacaactacaaaaacagaaagaagtgtcaaccaagtcatgaagcttgtattaaactaaattgctttgtattttttgctgatgccattccaaattttttttcagatcttgctctgcatatcatgaagcattttgatcaggcattaaatagaaaatgtttgctttattacctcactaaatttaaattttactctcaaaactttttctacatgttacgtacataattaaaaacaaaaatttatggagcaattcccacagcatttaattattagtttatttaaatttatttgattaaatatagtaagtaaattagttttatatcaggagtagtataggggcaaaaatctggcccccccctgggcagagagatgcgcattcactataggagagaggagagagttagagaaaaagagtaattgcaaaagcaaagaaaagcaattaaaatgtaaagaaaccccggccactattttaatggcaaaaaccccagcctaatggtattcccgggtacatttcacaccgatgcgcgcgtcgcttctttttttgcgtgtcccaaaatagtgataataaaaagttaaaattttgattcatctaaattttattattcgtttttggcgcacaaaaggccatganagaaatttctttcacaaatcgcatataatttcctggtttcttgagaatctttcgtganaaggaatgtatttatttttaaattacttttctgac

SEQ ID NO: 44898 - DNA, 901 bp, Heterodera glycines
tcctttctgtccacaaccaaagcattgaacatccacaggataacggcagttcttaagcaaatgagcacgcccgcagcctctacatttctgctgctcaacttttttatcctgtggtttaacaaatttattttgaaaaccattatttcttccataattgttgttgcccgaaaatttttgaaattgaattggttttgatggccaatttttggctctgtcactcaaatctttggcttactcggaatagcatgaacttgaccaggatttgcgagggccgcagctgagtgttgcaatgattgaattgaacggcattcctccaacaatagctccaatttgatgtcacgtggtggtgtcgtcttccgcgcattctccatttgccgaaggcattcggggcggaggtcccgatgcatttcacccaaacctgtgacaaagatgaggcatttgatttccgcctttgacaaattcatgtcggcacgctcgcatttggcattcagtgttgctccaaagtcgagaatgtcctgtcctggtgaacacgtccgctggaaacacacaaaacgtcgaacaaacactgactttgtgtctgaaaacagagccttaagattggtgattatttcctgaaaacttaattcggcagtttttttggggagcacttgttgctcattacgaatgaattcagtcgccggaagtttacccaaaactaaccggatcttcatatcgtcggaaggggcttgaccatccttttccacaaactgaccgtatcgttcataccacaatgaaaatgttgagtcattttccggatcatactgaaaatatggaatttgcgaattcaatttagaaaataagtcagaatgggctggggcctcgtttttggacatgagttatcattagctccataaaattgttt

SEQ ID NO: 44899 - DNA, 1130 bp, Heterodera glycines
aggtcaaatcgggcgagcgcaatttgcgtcgtgcggtcgcttcaaacagtgccaagtacccagtggccgccgctgcagttggcggtgcggtgatgggcggaccggtgggaatcgcggccggctcattggtggcagggattgcggcagccgtagggggcgcttttgcaggttttttggaatttcctcaattttattactatttaataaattcactatcaataataataataataatcgaatttgtgccggactgacaatttgaaaaaccctttttttcaggcctttacggagggcgtgtgctgcaacggaaagtgaagcaaagtacagcagtcgactcgcagcaatcagttgttgtcggcaacggcgcagcacagaatgccaacggtcgctaaaaatggacttgcgcaggatttgggtaaacaaacagaacggggaaaagattcgtcaagccgatgactctgtcgatgtttgtctgactcgcttttcactcatttcgccgggtttttcttattttggcttatttctatttcttacgacccttcaaaatgtataaatttatcagacataaaggacttatcataaattttctttaatactagtaaaaacaagtttaaaattgtttgctgttcacacctttcgaaagagagagatgaaccaataaatagagagcgcagagaaaaaacatcccttatttaggcgtactattttcctatctctgctaatagagaaaattcggtacttttctgttttgtgaccccccctgaaattttcaaataaaaagtcatttctagggtaatttggggcgctgatcacgaatatggcatttatttttcaaaattccgaatcccgaacccgaattcgaacataaatttgaaattcataaattacaaggaaaacatatttttatgggttttcgaggtcgctgaatacgtactgggcctatgcctaagcctaagctgaagcctaagcctaggcctaagctgaaccctaagcctaagctgaagcctaagcctaagctgaagcctaaggctaggcctaggcaagctgaagcctaagcctagatacatgccaccaaattagcgcaagttttattacgcatttctcggcagcttgggcaacatgttgatgat

SEQ ID NO: 44900 - DNA, 930 bp, Heterodera glycines
cagcgggacatgcttctgtacaaccttggtgcgaagttgaagtggtaaatcctgggacgtttcagcatcaaaaaaacaaagcctgactgccttttttgactcgtttgcgtcatcatcatcttcctgctcctcctcctccacttcattaccatcatcatcatcatggcctctatcgttaacactattatcagcatcatcattattattattatcaatatgatgatttggttgtcgcattcttctctcacttcttcttccgctcgaagtttcatctttcagaggttgtataaaacatgggtatccaatcggatgtggcccagaacatcgtggacaacgcatccatcccgtttgactaattagggctggacacttatgcggatagttcgcataagtaatggatccacattgactgcatggtgaatgaagatgcagccgactaacgcataaattaccaactaattattgtctgtcatgctgtgaagattaggccgcctttctggaaacaatagttaatctgacagaacatgtcaagtctgcctggatgtcattgggtgaggattttgcctaggaagcgcttgcacatttgaaacgccttgtcatcccgcattgattcaacaaattaatgaactccgaataatgtgccaccaattattaaacaatttaaaaaattgacatggctttttgactgtaatggattattatttggtgaatcaaacaccacaaaaattaatactatcagaatatccaagaacaaaaaaaaaattattgttaaaataagtaatacttatttattcataaaaatcatctattacatatgctgttattcaaaatattaagagataaaatctacgataaattgcttatactcactttttccgtaatcagtagaaattttttattataatctaattagcattcatgcttaatgtt

SEQ ID NO: 44901 - DNA, 1141 bp, Heterodera glycines
ttatataaattaattaattcaaattatattacttaacttcaattactataaattccattttttgcataatttcctgattaacatatgatatgacgtcagaaatagttgcaaaatcaaatagaaatttgaaaaatatgacgtcagatcagtgatatgacggaaattgaaattggttccggacaatctattaaatttattaaattggtttaattacccaagtttgaggtccatattcactaaattttctctataaatcgattatcgacaatgaaacgaagcaacacgacaaaagacactcctcctcaaccaaaacgctcaatggcatctgcaccggactcgggcccaaacactgcggcactcgctgagcaagaacgccaacgcacattggtgctcattggcctcccggaaagcaatgctgttcgcccatcgcagcgtgttaaagaagacagggaagccgtgactaaaatcttggaccatcttgatgttgaggctgaaccaaccgccgtctttcgactcggccggttcaacccacagcgaacaacacctcgcccgctcaaggttgtcatgccaacacccacacatcaacacatggcacttggaggatggaagcgcgagcgtgctcaactccgttctcaacaaaacctggcccgcttgttcgtccgcccagcactgaccaaagaacaactcaaggaggaaaacgaagcgcgcgtccgaaaacgtcaacaaatcccagctcccatggcgccggcagcgcagctcccacagacaaatgttccgactcccgtcaatgaaaatgggtcagaacagaaggaggcggcaaatggatacatttccaaaccgcagaaccccgttgaagaagaaatcctcttagacaaagcaatcagccaaatgcaatccttccgaaaacaattccctcaattatttaataaatagttctgctatgacctccaacaatttctataaaaacttcaaatcttctcaacaaaactctccacaaaaattttttctctccaattccaaaaaaaacgatttacctttgttggaggtctgacctccacttcaactcaaattcaattatcgtttgttacaacttttataatatcccgatttcttatttccaagatgacatttaacttcttca

SEQ ID NO: 44902 - DNA, 1161 bp, Heterodera glycines
  misc_feature (24)..(24): n is a, c, g, or t
tgaaagtgaattttcgtccaattntgtcaaccaacactcacccggtgggccgccgaccaagaaaaagtcaccacatgcgtagccaccaaatttccatttccgtcaaaacgtggaatcttacgaattgacccaattgcaccaatgaccaactgtgaggggcagtaacaaaggactcatgtaagtaccaccgatctgtggggaaaaaggggaggaaagtacagcaaagtaaagaaaaagaggggaggagggagcagagaaagaaagagggcgaaagacggaccgatccaacattggacagggcaaatgttccgccggaaaggtcttccagcgaaagtcgtccctcccgagcccgcgagcacaacttctcgaaatcggatgcaatttcccaaatggtcttcttttgacagtttttgatgttcggaaccgcgagaccgtcgggcgtatcaatggccagcgaaatgttgtggaaacgcttaaattggatttggcaatattttagcaatttcccataatatttactttcaaaatgagttgctcgtgtgacgggtcaaaggacgcattaagacgggggaatttggtcaatgccagcgaagtggccttgacaaagatgggcataaaactgagtttagaaaggcccttttgagcagcgatcggcgacaaatgtttctttaattccaccaaatgatcagcaacgatctgaaattaaacagagacttcggatagttaataatagagatcggaccggttcggtttttttcggtttcggtttttgaccgaaaaaacccgaatcaaattggagcgatataacctgttaataataataaatttattgcttttttgtgctctttttcattttgaagaattttttgtaaaatattttctgctgttttgaaaaaaattattaacaaaaatgcaataaaaacgaaaaatacacccctgagaaatggaaaattttatcaaaaattcatattcaaaatttatttacttgactacatttttgatttttaaaatattttatctcatttccatttttagcacctattttgggggtttataatagggttgctccccgaccccaagccccctacctccgattttttatcccccgaccccacgacaatagctcggggaattggggactcttgaaaatttttaaatttg

SEQ ID NO: 44903 - DNA, 1171 bp, Heterodera glycines
tttttaaaaaacatttgactcagggccccatgaatttcctttaatccaatggaaaaaattgggataaggggcaaacttttaattgggataaagggctttttgagtaataggccttttcgtgttaaaattggggatgatttatcctccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcggaatgggcaaataaatggcagatcagaatctcaattaaaaacacttttgtacttcatttggggaataaaaaccccaaagaaatatataaaattggtggaaatataataaatgtcgtggatacaattagggatttgggcataaatattgataataaattgcaattttccaatcatgtcacacaaataataaagaatgcatattacgaatgcgttctttatttcggattattaagtcaaagtcttctaggatttggattattttgtacaaaacttatgttagaccgttattggaatatgctcctgaggtttggaatctatctattcaaaaaaatattaaaaaaattgaaaaatgtcaaaaatatttcaccaaaaaaatcatacaactttgaaccctagttataatcatttttatgagattttattttttcgacttaattattttattccttttaaattcacaaaaattctaagattcaatttttctcattttattttttctgaatttccagtggaggggggggggggggggggtggccccgggcgttgccgatagagcgcagtcgggaaaaaaaactttcattgcaatttttaacagaatttgttaaaaattgctaatttttgaaaaattcaaaaaaatcgactctttatcaaaaattttggaaatcggaattccgacgtccaaaaacgtctgaaattggaattccgtaccatcccctggtaagcatactataataaagttctttatgtttctttccatgccaaatcagggggttttaaatactgatgatcgatcattaattacctaattgcatgaaataaaattact

SEQ ID NO: 44904 - DNA, 954 bp, Heterodera glycines
  misc_feature (403)..(403): n is a, c, g, or t
gaaattagccaaattttttagaaatttcccttttttagatgaaaataaggtactaccccaaaaccagaacatttcttagaaataacaacatagaaaaaccctgtattatttggaaaaataaataaaatcaaaagaaaacgtcaaccggtgtcgaactcataacaaaaggtattgttaatgttgaagcactaagcactaaaccacaaatattctataaaactgcaagcaaatttactttatttcataaaaatttgtaaaaggttaaaaaattcaaaattgtataaatttctgcctttaatttcacgaatatgccattcttaggggtgtgtttttcacccccgtgcccccgcggggcgaaggtcgcgggggcgggggttgcgggggtctgagtcgcgggggcggnggtgaggccaaaaaacctgtcccgtccccgggggcgggggcgggggcggggtgggtccgaaccctatttaaataatatctattctattaaataaaaataaaaataattattttgcttttaattttatcatttgcatttttcttatttcgtctcagcatgagataattattagtataaaattttcctttttacaaaaatatatttttttaattattcgctttaattcatttaattttaaaacacttgcttttaaactattttgtgttaatttgtaaacaagagactgttattgataatgactgactttttatgcctcgagagttaaatatttatttttctttcttttccttgcctggggcacgcagcgcaacgtgtacgcgtcctgcaccttgccgcagtgccggtgcgattcggcaatctcggatcggttcaagtccgagtggagcaaagctcgcagccgaccggcaaccaaattttgcccatggtggggccgaacgcgatgaacatctttggggaatgatcaattccagaaaatatctaattttattttt

SEQ ID NO: 44905 - DNA, 1625 bp, Heterodera glycines
tcggcgaacaaaaaccagaggaaaatggcaccccaatgaaaaaaagagaaatcaattcaaatgggcgcaatttttttttcctaaataggcagaggggagcgaaaagcgacggaggaaagccaacgaaggcggggcgcagaaaaagggacaaaggacggacaaattagcaaaaaggtaggacaaaagaacgaaaatgacggacaaatgagctaaaaggtataggacaaaagagagaaaaggacggacaaaagagcgaaaagaacggacaaattagcaaaaaggtaggataaaagagggaaaagtacggaaaagaacacaaaacaaaaagcaaaagaacacttagtcaaactcagtttaaaaagggtgcacttttacggaacagaaactattttggtgctttttggtctcgggttgacccacgcttaaaactcaaaatttttaggtcatctgaaagtttgaacttgaccaaagcttttgaacttgtcgaattttgagacaaaaatgctaatttttacaaacatgcagaatttaaaaaatacaaaatttcaacgggaagtcaaacattttgctaaatatttctgtgcaaatttccaaaatgatggaactcttgctggtcctcattccccgccggggtgttcaacaaccgcagagagtttaaactttaaaatttgcaaaataaacggagcgaactcagacggacggacaaataaatgacagagcaaatcgaccggcggcggtcggtgtaaaatacgcaatttgaaaaaagaaaataaaattaaaacaaataacatgcaaaatgagtgatcagatcatcagatatcaggcctcactgatcaaaagaaaattcaattgttaaattatgggagacattttaaaattggataaaataaaataaaaatgccataacattctaaacgaaagtgccgattatttttgtgaatttgcaacaaacattcgtatgtatgtacttaaaaagagatgttcgaatttttcccctttattagcactgacgacattcgctcgctttgaggaagaagcatttcgcttgaggggatttctgaaattgggccattcatttgcatattttgcccaaaggcgccgattgtctgtgccgtggcaatgtttttccggtaaaacaattccgcgttgattatcaacagcgaatattcaggacaaaaaaaagaaaaaaatgacgaatttaagcatccaaaaaaatggcaacgcattttaacttcctaatttctaatttaatattttgttttgtcctacgaaaaaatgtgaaaatttaattaaattaatctatgggaataacgcttggtaaattgttcgtttgatcttttagattttaattgtctttttattgatattttaaagttgaaaatcgtaaaattaattcccacgagggcaaattcaatgcatttgtgcagcttacaaagccttaaaattatcattcaatacttttaaaaaaatgcgaatctttaaaattaatacaattcaaaaaagctgtaggaaatgtcagttttgtaatatgataccatgccaatcatttagccaaaattaattattgatttgcacccaatcaatctctctctctctcagtcctcctctaatctctcccccccccc

SEQ ID NO: 44906 - DNA, 1469 bp, Heterodera glycines
  misc_feature (1397)..(1397): n is a, c, g, or t
agggcggagtttggcatttggtaacaattagcatgcaattaattaattgttcccaaattacatagtgaagttaaattacacacctttttaattgacacagatcactgcgacaaatttcctgttgccatatgccagataaacatcgagtttgttttttacgcaaaaaatatttggcaaaaaattcgtgaagttcatgatttttttggcaccctgactttttactgtgactggatttacctgaatttttgtatacaaaattcgggtgcaggctttaaaattagaagtcaacgagggtcattgatcccgtcctgggttttacggaccatagttcaggaatttttttcatcctgggtattcctgggccttggttttcctgagtttttgtttacgaaatacgggtagagcctttttaaaatacatgttttctattaaaaccaatataaattattttacttattggattcttaatataaaattatttatacattccaaattggcacattaaaatattaattctaattatcatttatacctaattaaaataatgtagattaaaaaataaaaataaaaatggcacaattcagaaagccaaaaggaatgaaaatgtagtttttggaaacattttttgcaaataattataaataaatagttaacaaattgtggtacgttaagcacgtcattagcagttttgggtaattaaaacggattgtttactagaaatggaaaatccatttctgcgaattcatttggttattttttgtaataatatttccattattttacaagatattaattatttttgtcattcatttaaattattaattctcatttaacggagcattcatttccttttacccacgaattaattaaagtgcttcagcgttggcaccaaaattgaaaaaaaaatgggaaacacgcaatgggatatgccgtgccataaaacaaaaaacggattaattcacttgaatcattagtggaaagtgaaatttaattgaaattgagtaaaattcaaaaactaaataacattctccaataagtggaatttatacttttatagcaattaattatttaaatttatttatattatgaagccaatgatttcataaatcgaccaataaataaaactaatagcgaaaatttttcatcttggtttcatctagggttgaaggggaggggcccatgtggttgggcaaaaaccgagtccagcaggtattttggctcgatactttagggattctcgaccgcaattagtgctcacatttatcttttccccaaaaattgactggctgtcccgtgtccgtttcaccaccaatcgcagcagcctgcacaaaagtgccgcgaaatttggcacgtcaaatttgcattgatttcagctgccggatcaccaatgatcagancgcactgatgacgaaatatttttattcgattaaattttgtaaaaaaataacatattaaaaagatactaattt

SEQ ID NO: 44907 - DNA, 945 bp, Heterodera glycines
ttcggtggcgggagaaggcaaaagggcatatcgacaacagcagcagaaaaacatcaaacttttggaggcattcaccacagcggtgctgacaaacacaaaacaaatgaaaagcgattccaattttgcttaaggtaatgccattttatttggttgccgattacaaagacaacgaattactcgtcaaatggcaaaaaggtggtggaatgttggaaatgtttttatgtttctatttttaagcggcggttgaactgttcgaacggccacagtactcgcgacttttaaaggtactgtagtttgtggatttgtcagtgcacattttgtgaatgaatatgcaatttcaaatagactgggatgacaggcgacaatatggtcacggcagaagtgcgtcggatgggcctcgaaacggcgccgcttctgctcgggtcggtggtggcaatgattgtgagtgaaatgccaagtcaaatcaaatgccgaccaatcggccgttgtgccatccaaccaatgcttctttcctctcaaggtgttcgtcctttgcactctggtccgcgtccgaaaagccgagaatcgattctgggaagcgtttgtcggctgtttggtccctctgatggcaatggcaattttcggcattttctgctggttcatttgccttccctcttcagtcctcctccatcggtctgatgtctttggccgggtggcgtttccaatccataattgtcgcagcgctttttctcgtgctgtccgttggtgttgatgacatctttattttggttggtcatgaacatttttgtgtgttttttgtgcttttccttttcagatgcgtgcttggcaacggagcaacgaattgtttaccatttctgaacggatggctcagtgcctggaggacgcggggccctccatcacaattaggttgatcagctgattgattcggttgattgattgacagct

SEQ ID NO: 44908 - DNA, 803 bp, Heterodera glycines
agcttgtgagttgtggatcatacggggattaacaggcggcttaaaaaaccccaaaaaataattttaaaaattttttacaggcaagtggatttgaacccacgcgcccaaaaccatttttaaccatccgagcaattcgtctcccttccttacgttaagtcgagaatgggcccgcagcaccaaaatttccgatttttgaggccctgtaacttttgaactaggcgcttgacaccgctaaaattaaaatttacaatagaagtcgatcctgctctatccaatgggatataacacatgtgcattttcagacttacagctcggaatgttcccttgtgaagtgaaagacgagtggactgttcggtggtctatcgctttgaaaaaatgttcgtagccaccaaaaattgaccaccttttacccatagaagctaactaattgaccgtattttttttgcttttaaatcgcttttgttttaacaatcaaagaaaaataatttttaaagatagaaagaaggcgtaaccactaggccagatatacacaccgtttcaaaaaacgagacatgaaccaataaatagagagtgcagagaaaaaaacatctctcattttggcatactatttttttatctctgttaatagagaaaaactgaattcatctgtttaactttttttctgcttattaaatccacttcaaattttgcatattgaaagagaaaaattttctgcaccagtgaattcattattgtctatagtctaatacaaaaattataagaaaatccaaatttcaaacgctcatattgtttttctaaatcat

SEQ ID NO: 44909 - DNA, 1666 bp, Heterodera glycines
ttttcaaaattttttcgagctaggccccctagaaattttcggaaatttttttttcggacgaaaatgggggtgaaaaatatttttctggggtaaaataaggtgctgagtacgaatatgatgtctattttaagtttcataatttttggaattttttaaaaattctttattttttggcaattttttggccctcggcaatttgggcgaatattggaaaattcatatctagcctaagggcttaccaattttgagcaaataaagcattaaaaatagagaaaaatcaggagaattttatgggatttatttgggatttctatcttaaaaagaaaacaagttattccagaatttctgaaaactttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattagggaccaaaggggtgagcataggatttttgagttgaaaaattttttcaccaaaatattccaaaaatatgattttaggggttatttgggccgctgatcacgaatacgtgatcagattttacttttgacatcgttaaggcctcagaatccctgtgtgattggggattctgaggcatcattttgagggggggggggggggcgaagttcgaagccgggcggtgtacattatttttctaccatttttttcgtgtttttcaatttttattcatttaaaatattttttgagttaataaataaaaaattatatttaaattaatttttttttaatgaataaattttataagtttaaatgaattatttttttaattgatagaatttcatgtattttttaaattaaatttgttaaaaaatattttcattttaatttaatgaatttactaatcactgttgtacctcttctaatcattgttgtacctcttctaatcactgttgtacctcttccaatcacagttgtacctcttctgatctctggtgtacctcttctaatcattgttgtacctcttctaatcacagttgtacctcttctatcactgttgtacctctttttatcactattgtacctcttctaatcattgttgtacctcttctaatcactgttgtacctcttccaatcacagttgtacctcttctgatctctggtgtacctcttctaatcactgttgtacctcttctgatctctgttgtacctcttctaatcactgttgtacctcttctaatcactattgtacctcttctaatcacagttatacctcttctatcactgttgtacctcttctaatcactgttgaatctcttctaatcactgttttacctttcttaatctctgttgtacctcttctaatcactgttgtatctcttctaatcactgttttacctttcttaatctctgttgtacctctttttatcactattgtacctcttctaatcattgttgtacctcttctaatcactgttgtacctcttctaatcattattgtacctcttctaatcacagttatacctcttctatcactgttgtacctcttctaatcactgttgtatctcttctaatcactgttttacctttcttaatcaagttgcacctcttct

SEQ ID NO: 44910 - DNA, 928 bp, Heterodera glycines
  misc_feature (12)..(12): n is a, c, g, or t
taaattaaattntggatatattcaaattataatgaaaataaaatcataacttaatgaaaactttgttttcaagacattaatgaaaaaggttaaaaaaacgcctattattttgttgtatttctctgtggtgcggaagtgtaaaaaagctcaacccatggtggactcgaactcacgacacctcccataacgcgggatgttagttttaaaaatttttatggcatagttaaattgtatgatgaaagaaattgaatgctagtcgtattttctatttcaattatttagagtggaatcaattgacatagttaaaataattttgctttcttgtatttacttagagaagaattatttgtattaaaacgtataattaaatacatttcttaatttttatatttttgtaagtcttgtaaataaattatatttaaatatgaagtatgaaatattcctagccaatctacgtaaataatttggcgatgctgtcctttatttcggtacgttgtcgccaaccaaaattgctcgattttatagcttcttgtttaatattttttcttcgatttttttgaattattatttttatcatgattccatttattagaatattcctcaaagaatctaattttagatgtatgtaaacatcaacaatcattaatagaaaaaagataaaaattatttaagcgtgcacctacattaacagtattgtcttgaaaatagtccagcaccaggcgacgggtttcgtagttgatccggttgaaataaagccatcaataaataatttattatacaaattttttaatgcttttataaggttttatttttctaagtatgtatttgacttaattcggtttaattaatagcatgttgtaattaaattaatttgatattccttttttattcaaatacgtatgatataccatattaacaattaagtgct

SEQ ID NO: 44911 - DNA, 871 bp, Heterodera glycines
tatgtattatagttgcaactttttcattattaggagcttctcgtcagaccccagcatgattaccttggtagaaatcacatttatttatatttttactaatttgagcgtaagaaattataacttagttcttcgaaaatcagtatatttgtttattttatttttactttgagtttgtagcttttgtttaattcggtgaaatttttgaatcagatttgtagttttggattcatgttagaaaaataaccgaccaattttcactcaggatcgttttttacaattttaaaatttttgtactcgatcggttatctcaaggattgttcagtctcatacattttccttatctaaaatttcttatccgcttccgtcaacagagctgaatttaaatacaattttttttcccagcatttgtttttcacttctcaaattattcacttgtacatctttttgccttttgccgttggaaaaaatcctatcaaaattgtgcacaggagagagtcaaggccagtgataaactgtaattaattattatatatggccttaatgtaaaaattaataaaaatgcataaatgaaaaaatatttgttttaaagaggagaaagttcgtaagaaaaattattaaatccttgatgtctttcgcttcaagaagctaaaaataaatctaatgggatttatgaaattttaactaattaataataaattgtatcctttttttataagcctttttccttataaactatgttaaaattttatcaagattgaattttattttgctcagtgataatttacttttgattatattggaaatttgaaaagtaagaaaaggatctaaacaaatttttataaaatattaatttgttgacttgttaaaaagg

SEQ ID NO: 44912 - DNA, 1404 bp, Heterodera glycines
ttcctttaattatttttttgtatatttttgatttcgaataaattttggtcaattccaaacagccaaaataattctgatcatggccaattttgctgatcaatagaagctttttcttgtataaattgaacatcttttgttaaatgcgataataaggcacatataaaaatataacaaatttaaaattaaaattaaaaaacaaaaaaaatgatgggcacatttaaaaattgggattttggtgatgtggtgaaggggggggggggataaattggagacaatgctaatcggcacttaaaagctgaatagacttttgtgtgggtgggtgttctgtttatgcttttcaaaaaaaaatgggcttccaattgatcagccgatgtgtgcgagtgccaaaattgcttttttggcaaaaggtttaaaatttggcacataaaaattcaaatttaaaatcttcccattccctggcttaaacccaagcatcatcagctgatttgtggtggtgaaatatcaattaattaaatcaaacaaaacattatatatttccccaaaatttgcgcgctgttttcatcaattctgtggtgcctttttcttatcattattatcatcaatcaataattcggatcaatcaataatcgcgcggtgttccaccactgatcaattgatcattgctcgtcctccagcacgtacaccttcggcgagttggacttgttggtcacaacggacgaacggtgcttggcacggatcaggtggagactgaaaagcaagcaaataaaataatttttcccggggatcagataagtcttgaaattgattagatttgtctgtgattgctttgattaaaggtaatcagttcaatgatcggactctgataagatctcgatcatagtcctggtcaaaattacaatagcgatttgtgccttaatcaggtaatggaaaatctgatcagttctttgagatcagttcaaagaaagtttttatcaagctaaataatcattgaccgtccgattagtgatcatggattaaattccaatgtatgttctaatcaagcccaattatacattctgatcaattgatcagccaaaatcagtgaatgccccgtgacgtgttcattgttcatcacctgctctccgcttggtcagcgcgtccttccgcgtcctccaactcgcgctggtatcggcgcacgcgttgcaagttttgcatggtgacagcctcctgaaaatttatgcaaaattaaaaaaaaatcatttatcatcataccgcttcgcccaattgtctcttttggatgttcagcttctccaacaatcggtccgctgtgtcttgggccatgatgaagttctacaaaatgtttcccccaaattaattaattaataaagcatatttaattgattgattgatcagtgtctgccttgt

SEQ ID NO: 44913 - DNA, 1236 bp, Heterodera glycines
atttaaagttacgcttatgattcatacaaattagtcaatgattgacccaaaatatgattggaatataaaaattttctactgttacaatttaattttttatccatttttaccaggattgcatttcccatttgggcattcgccggtcaccacgttacatgcagacccatcagcacaatggcactggcgtgaactttaaaaaaagaatttatatttaaattaattgaatttgcaaccaatccaagtgccattgggttggcaaacacgaatcaacacattcttaaattggaagaaagcgaaaataacttcttccaaagtcgaaccaattcctcgaaagccggcaccacataagaaaatttgctcctcgtcaatcctcattagccattcgcctaattatttttttacaagaaatacgcaacaaaaaatttagaattttaagtttttttaattaagaaaaattgaaattcgaattttttaggaccttaatggaaaaggaaaaaaactaaattttaatttggatattttccacctggaatgcccatattgcttttttcagtcagctgtgatgaatcagatgtgcctgacccgggcagcatcaaaaattttggcatttttgctacagtttcggcacttgatgaagcaaatgttggcccattgaagccactcttgatatgtagtaattggatgtttattcgtaattttataaaaaattaaaattttttgaattcttttttcatagaaataaattctgttattttgggttgttttgggtttcgaatttggatttttattacatcacatcaattaattaccattgcctttacgctcttcggcaatttgctgaaaatattgtgcgcaaaacatgcattgttcccaacaattacggcaagttggaataacacatctgcatcggaaagctgtaaacatcggaaatatgatgtttttcaaaaaattttgagacaaaataagggggaatttacggccgttgtcaccagattccaagcgataaaaaacgcttacaaattttttttatttttaataaatagaaatttttttgaaaatattttaacactttaataaattgtattttctccatgacttaatcaattgtatttaaattagagctcggcctgaacctggtggatccatgcctggattttcctgggtctaggtccaagtcaaatagaaaaaaaccggtgatggagaggttcctaaaactgccaaaagcagaaaaactaa

SEQ ID NO: 44914 - DNA, 1210 bp, Heterodera glycines
ctcctttgcttgccattttttctcctttttatttaaatcatcattttcaatttcatttctcattatccgatttgtccaccatttcacatctgcattttctccatctttcgtcgccccatttgcattttcacattcattcacattttcaaattccttttgtccggcccgattggacatccttttctcaaaatgttttaatcatgggaggagaaaaatataatatttgatacatttttgatcgaataaattgtaaaaatatctgatttgacgcaattttgcgaaatgttcttatttttaaccataaaatcttattttttggcctcaatgttcttattttgaaaaattttcgatccgaaccctggaaaattttacacccataaaaatgaagctttttagtgcctattttccatttttagttattttttcttcatcatccatacattaattactctcttttcttttgatatgaaattttccaaaaaatttaaaaaaatgatgccgacttttcttaatacaaccgatggagtcaacccaacagaccaaggcaatgtttctaaacaaatagcgattcaaaaacctattaggattgtattgagattttttgtggttttcataaccaacgaagcctaattcattctcaaacgactaaacttgtcataaaattgtgattttacaaaaaaatttcaaatgaaaatgaattaattaaatttatttttttcccattaaagtgccgcccccttttgacggctcgccgaattcgccgacgccaagtgaaagcggctttgagttggtggatgaggagggcaagcagaagcagcaacagatggacggagaagcggacaatcagcagaaaaatgacaaaatgtgggcattgtttgcctttaattcggaatgatttctatttctgaccattggcgacaaaaggacaaaaaatcttacatttgttgtctgaaattgttgaaataatccctaaaacttgggatatccttttttatctccattcatttttggcttagaatccaaagtgtcgaaaatctgcgagttgccaatgggaaagaagcgcaacagcaaatggccgaacttgagcaggaagtggccgatgatcagaaaaatgcgcagcaaaaggacccatcccgcgcttctgctcccaaacggatggaattggccaaaaagttaaagtcaaagggtaattacctaattaggcattaag

SEQ ID NO: 44915 - DNA, 1112 bp, Heterodera glycines
cggtctccccataaatctgggcgcatcggtcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgc

SEQ ID NO: 44916 - DNA, 1193 bp, Heterodera glycines
  misc_feature (85)..(85): n is a, c, g, or t
  misc_feature (205)..(205): n is a, c, g, or t
  misc_feature (829)..(829): n is a, c, g, or t
  misc_feature (834)..(834): n is a, c, g, or t
  misc_feature (910)..(910): n is a, c, g, or t
  misc_feature (974)..(974): n is a, c, g, or t
  misc_feature (991)..(991): n is a, c, g, or t
  misc_feature (1008)..(1008): n is a, c, g, or t
  misc_feature (1012)..(1012): n is a, c, g, or t
  misc_feature (1014)..(1015): n is a, c, g, or t
  misc_feature (1044)..(1045): n is a, c, g, or t
  misc_feature (1054)..(1054): n is a, c, g, or t
  misc_feature (1081)..(1081): n is a, c, g, or t
  misc_feature (1084)..(1084): n is a, c, g, or t
  misc_feature (1097)..(1097): n is a, c, g, or t
tttcctgtcccagattttgagtccggccatcttgacccgctaaataatgtccccccagttgttacatcctgccattctgtcccgnctggtgctgaccccggccattctgcacccgacagtgatgtcgcccactgtgctctccccgttcgtgctaacgccgcaaatttctctcccaaatttctgggcggtcttttcctctcccctnacgcactgtcccccgtttttaagtcgccccttttcgtttattcgatcgttttgtcgccgagttggctgagctgatcaaaaattgccttcataaatatttgttgttttccaaaaattttatacagaaatttaattttatttttcgtattattttattttttttcttcttaccatcttttttttgtacatatttttttcatacatatttattaaaaaatttaataaagaataaaattgcaagggaaatacccaaaaattttacaatgtaattttttgtattttacgagtgaatgttacaaaaataaccgtttctacaatattttacatgactcttaaatatcggctatgtttaattaataatttgcattttttctttttattatatttttattacttttcgttcgaattcgactcaaatgactgtggtttaaaaaaataatatttttgatttgtaatattttagtgaacagttcatttctcgttttccattttcggtataaaaatcatttcacgcatatccaccaaaatcggtaatttgtggatttacggaaaattttgcggtcgagatttccgagacttcgttaataaaatttcaataggtaaaatgtttaatgatgaagaatanaatanaaagctggacacttttaattttgcggggaattacaaataattaaggggaaagataacgaacgagggaaatgacagncaatttatggaagaaatgacaacaaaaaacgggaaattttatagacacatcgccaagaacattncaatcggcataactaanatttctctgggcgtatntgcnanngcaaaagtactgggattgaataagcttannacacactanaaagcattttatttggggctattggtnccnatttagcactatntggtaaattatcataattggacaccgtttaagaagtcttaattattaaagactccataagataagcataaaacattcaatgggtttcaataataca

SEQ ID NO: 44917 - DNA, 465 bp, Heterodera glycines
gggtactcaatcaattatggggatgcaaaagtccaacgcagaataaaagtggctatagggaagctattccggaaggattcggtctccccaaaaatctggacgcatcgattcggggggactggcccgaaaacaaaaaaatcgatgttttcaagtgtccgtttggtgtattcaaacaattatggggaacaaaaatccaaggtaataagtaagttgaggtatatagaagctattcccgaaggattcggtctccccataaatttgggcgcatcggttcggggggcctgggccgaaaacaaaagattagattttttcaagtgtccttttggggtactcaaacaattatggggagcaaaaatccaaagcagaattaaagtacagtctatagggaagctattcccgaagcgcccccccccgcccttcagaatttgaaaaaaaaataaaataataggagactcagaatttgaa

SEQ ID NO: 44918 - DNA, 1169 bp, Heterodera glycines
  misc_feature (1093)..(1093): n is a, c, g, or t
  misc_feature (1103)..(1103): n is a, c, g, or t
tagaaaattttaaagtttaataatttaaattacatataatttcattatcactttcatttacatacactaagaggttaattttcgttaaattttataaattttaatataatatttgaaattttgagagagagaattttaacatttacttagctgtaatccttctgagattttacgaaaattttctgaactttaaaattcgccagctcatcaatattaaatttcgtcaatttttttaatttaaaggtgtacaaacaaatttcattatgcaactaaaagcctttcatttttatataaaattgcttaagctcattaaattaaacaaattttcagaatgtcaaaaagtttcataaatattattattcaatttttatttctgctatgcttattttataattttgctaaatcttttggcgaaaaatccgcaccaaaccctcagcaaagtcctaatgtatatttgaatataatttcaaatttaatgggtataatcacgtgattccgttgtcaaaaatgtttttaactaaaatttcattttgggatgccaataattagggactgttaattaggtgtatttccaaatattatatttttcagtccatcataaacagttcctcagggaattatgaaagtaaagcacggattaatgcagaacacgatttgaaaaatttgccaccgtaaataggaaaaatttgaacacatcaaaaataacataaattttaaattcatacaatttttctgaaattttcctcttaattgccaaaatgtgcactaaaaaaacgtaaaatggcaaattatggatttattctacataatatgaattttttataaattataaaatatttaatgaaaaaaaactgccgtttttgcattttagttccaacaaattccatccgatgtcttgtcagttttgtcaaaagatgttgcggcacaactggaagcaatacaaaacaatggcacattgactgtgcacgaaaaggcggaacaaattgaccaaattatgactgagcagcccagcgaagtgttggacaaaattccggacccgcccaattttggcactcttccaatgaatgtgagtgattttattcatttatttgtngtaattatgntgttttatgtccattggctaaaaattatttatttttatgggaaggatcccgcagaaatcccaaaaa

SEQ ID NO: 44919 - DNA, 1190 bp, Heterodera glycines
ataaattttcaatatattttttaattaataaaattgatgtccttaatttggtgcattaaaaaatatttttgtgagttttaattaaaattttcgattactcccgctcccgcccgggactcccgttaaaaatggacgggattttaacgggagcggggattttttacgggaatcccgttcgggactcccgtcccggaaaattttgaacttccgatcccgctcccgctcccggaaatttttttttaccggactctaatttcgacattgagtaaattcgagactatagagcatttttagaaagtaatattaaaaatttgaaaatttgttagtatttgtgataaattttcctattcattttctaattcgtaatttttaaaattattcaaatgccctcgcaacgtccccaattaaacagaacaaacttgtagagatcgagccgggccgggcccggtacgatttttgccaggcccggaaactggttgcttctgaaaatgttagcccggcccggccctgcagattcggaaatctcgatctctaaaaaattgttatctaattttttgaaaagaagcgagtgctaaacaattttacaatcagaaaaaagttgttagaatttcaatctattttgtagccatcatcagtcatttacgtcaacacctgaaaaattataatgtttaaactttttggttgcatactgaattaatcaagaactaaaaaatttggtatttaaactgtagctcttcttgacaatacggcggatgtttagaatattcttttagtgtaaattcaatggaattagttcaaccgtttagaatgagatggagtttaatttaaaattagaaaatgaaaacggccacgcgaaaacggccacgcgatgactgaatcaaacaatcttgatatcattcgaaagctcttcacaggctctattagcctactaaaaattacagaaaatttagaactataaaaaaagatagaaataaaaaacttcgaaaattctgccttttttgcggttttcaactgacaacttttttgagagctgatcaatcactgagaaatagcttataaatatcttctaaacatctagggctttcgaatgataccatgattgtgaagtttggccaacaaagaaaaagttatagctttttgaacattgctgagacggagaaggccagacggagttgacccctaccgaaaat

SEQ ID NO: 44920 - DNA, 1615 bp, Heterodera glycines
atatttttaatattttatgaattatccatatcacaatccattgtttgtgctttgtattgctccttttttacccccaataattcattgcttttctgtgctttttcacttctttaaatttaaattttaaatgctttcccaccactttccgtctcgtcaacaaattttatgcaatttttttttcaaaatttaaattgttttttcacttttcaattgctgctgatgcttttttgtcctcctccggatctcttccacaacaatcacacacatgacacacagtgttatcatttttccggttccaatacactttgttcacatcatgaatttcttcttactaactgtttcttggacactctctcttaatacgaatttttcttggtgccactcgaacgctgtcaaatgaatgtctcgagattgtgacagtaaaaacaagaaacagatgaagaaagttattctttcaaaatccaatttaaaatgataacaataattatgccaactacatggtatggggactgatacactacagacatatgtgccttaattttaagaaaaaggcatgaccagaaaaatcattggataacattaataatggagaccgagcgggaccggaatcccaccgggatcttgccaggactcccaatcccggttttttggactaaacaccgggactgggatcgctccccggtccattttccaagtcccgccaattaggaccgcgactgagtttacgctattaatctcgggcttgagaatggtgataaaaagaaaatagctcgggtttgattcctcttccggaaattatttcttcttttttttgtatgacaaataaaattctaatctttattaaataaagtgcatgcaaatgctgtctgtgcgtacaattataaagtaaaccgaaattttcaaaaaaaaaaaatcaacagtttaaacaaataataatctcgactgaatgtgtttgttcccctgacattttgattattgaaagactgaaaattttctaacatgcgttggaatatgaactgcttgattttatttaaaattgctcataatcacaacattttttggcaaaggtgcgcctcaaaaagcagttttgcaaataattttttatttaaatgaatagaggaattgcaaatttttggtttccagcccccttggtttctttgaaaaatcttttggatatttttctagtgattaagttaaaatttaaataaaaaatcattcaattttttataatcacggatcacggggttttgggttgccgtgatcacgggtcacggatttttttggaagtcccgtgatcacggatttccgtgattggaaattcactcacggccagccctgattggtaatcatgatcaaatgggactgataaaccttgaaatatatacatatgtgccttgattaatcaagaaaaaaaatgatcagaaaagggttaatacattaaaaaatagagaatggacgagaccggcggggccccgtcgaaattttgcagggactccagcaggtctgggtttttgaactaaacgccggcgggtccattcttttgtcctacaattagttggttgagtggtagtttcacggattgagagtgctcgggttcgaaccctcttccgggaat

SEQ ID NO: 44921 - DNA, 922 bp, Heterodera glycines
aaaatcaaacaattgtttaattattccttcggaattggggacccacggaaaaagaaaaaaaaaggtttttttttcattcattttttctaaggaaaaaaatgggccccgttttttttgtcatgaacaaagttcaaagaaaaattttttccatcgggccaaaaattccgagaacgattaaaagaatggcccaaactacggaaggaggcggccggtgacgcgggggagggtgcacagttcctccccgcgcgcatcaatcgcgataattttaaatttgtattcttcgttggaaggcgctccgacttgaaacgtcaaactgtaaggctccatggagctgcgctaaacaaaattgtgtttattccgatggcataagggaaggagggagggggggaggggtcggagcagtgaaaaaactacgaattgtcagccgaaagtgttgtagaatgggttcaatttgctaatgatttttaattttacattgctaagtgaaaatcagcgaggttcagaacattgaaaatcggaatttcaagtattacttcaatcgggtaatagtaactagagttcgacctggacctggatccaggcctggatttttcctggatccaggtccaggtcatttttcggcaacctggatttttcctggacctggatttttctggatttttgtccaggaaatcaaggtccaggtcaaatgtgaaaaaaaatccaggtccaggtccaggcaaaacaggaaaaaacctggattttcctggacaaaattttagaatttattatttcaagtgaccgatgttttttcaagttttcaaaaacagattaaataaatttaaaaacacattattattatttattagatatttttagatgcttctacgcaaataattaattttttcaaaccatttttttgatttttaaaataaatttcaaa

SEQ ID NO: 44922 - DNA, 1107 bp, Heterodera glycines
tttcccggtcccgctcaactctagtttttaggaattttttaaaaaaatttcaatttatcaacgggggggggggggacattgaactgctcgcttcctttgtcctcacctccacatcctgctgtcttccggtggaaaattcgtaatggtgtcttcccgcaactcgtcggaattgtgccggtcgaatggcaccggcgccgccgccatttgtcgtggtgccgccgccttgttcgcgcgaatagtgcccggatttcatggcgacaaaaagctttgccaattgtgagccgaaatcctcgctgatttcgaacggatgcttttggcgcagcaattcgtccgcaaacacacggacaaagtccggcacaacgcacaaaacttggagggcctcaaagaaaaataatggaaaatagtaaaactatttgacgaaatgggcaatgccaaacctttccaagcagaaattagttttcggtaaaagaaaatcgcaaaaaatatttacaaaaactgccgaaaaatgtaaaaaacaaaaaaaaatgattttttaaacaataattttttagaaaagcgtaaaaagggcacaaaatgccacaaaaagacccaccaaggcgaagattagcattttcttaagtgtttttaatgtccctttttataatgatttttaagggcaacttttttcaaaaaataaaaaacaacatttcaaaacttgctacaaatttgtaccaaatctttagggttaaacaaaatgctaaaaaataaccacaaacattacaaagtttccattttttttaaatatcacgcactgaattgatgtaacaagatgagccaagattggcgagcccagtgaggccaggcccaccggcactgaccaagccaaggccctcctcttgaattgccgagaattcgtacctataaacggaaaattgtgtaaaagtgacgaaaaattgcaaaaaaataaaacaaaataataatttggacatctttcactcaaaacaaactgttcgagaccagcttgtttcgaaccctcgaaacgatcattttttttaattcaaagattgaaattttggtacttgttaagtttacagggccaattctacatacatttttagacgccaataa

SEQ ID NO: 44923 - DNA, 637 bp, Heterodera glycines
gtagaaaaactttcatggcaaaattgctgatagaacaataatgagcgaaatgttaggcctcgggtgggaattgaacccactcgtgaaaaactgaactaaaaactttatattttgtgaaaatcgaactttaaaaaatgtcacaaatcgacacagagccaaaaaatggctcgaatgagatctccgttctttctggaaattctttaaataaaattcaaaaaaagaaaaaaattcgcgggggccaattaattttttcatttggacccggtcggtatccacgcttataataaatctatatacatatatggtttatgttttacttagattttgtttccgtcctatttaaaatattccacaatttcaacaactttcagttttagcaatgaattttttatttttgtttgcgatttgcttcgttttccttacgccgttagcagaaggcacaaaaaatttggaggacattccttcgggtagcacaaacaatgaagcgggtgatttgtgttaatttattcgaaaaatagttaaaaatttattttcgtaaattggacacgaaaaaattatgagaatatttaacatgaaatatttgttaaattgataaaagcatgaaaattattagaagaggacgcccagcaaagtgatg

SEQ ID NO: 44924 - DNA, 967 bp, Heterodera glycines
tttttatttcttttatcataattatttttgtatagaattaattaaaaaggcatttttaaaatggccaattttcagtgaaaatctgtaagaatagtcaaaattttcatcctgcgcctggcccccaaataaaaatagagggattttatccaaaaaaatgcccaaaaatttctgatcaccttatctttttttgtttttcaaatcatctttttttcgcggcgctctttttctaaagacttttaggagaaaggggtccggcggtgccgataggcgccgccgggaaaaattctgaaaatttggatggatctgttgaattttgcgaattttgaactaatttttttaataagatttacgaatttttgggctcggcggtgccgataggcgctgccgggacagattttcaccaaaaaatttatgaatttctgataaatttttggttttttttcttggttttttgtcaaaattattttgaaatatattaaatttttatgatttgtcaaaaaattgaatttttaatttcaacgaaaggcaaactgggttcaatacgtcaataaattatgccaatgatgaccaatttttatgggtatttttgtttaaaaaaccctattaattacaaaaaaaattaattaaaaaagaagtcaaccaggatagagctcatgaaaaaagtaatgcattgtgctaacgcttttccactacaccactattacatatgaatagacaaaagcaaattactttatttaataaaaatttagcaaaatggttaaaaaaattcaaatttgtataattttttttctctcacgaaaataccattcttaggggtgtatattaaccccgaccccgaggcggggttaagggtcggggtcgtcggggttggaagcgtcggagttcgggtcggggttaaccccgaaaatggccaaaaatatcggggttcggggtcgaggcggggtcggggttgcaaccctaatttaga

SEQ ID NO: 44925 - DNA, 209 bp, Heterodera glycines
tagagtcacttctgcatttaatattatattatttagctggaatctttttcttgaaaatcggataaaagatgattttttcttttttattaattaatagttttatttttaataatcagggacggatttatatgttctaaaaacttgaattttgctcaagttgttttttgtaactcggttgatagttatcagaatagcttgaaatttggcat

SEQ ID NO: 44926 - DNA, 1286 bp, Heterodera glycines
ccctcagcctcgcccccgacccctgtcgatggccaacccaagctaagcttgcggtacccagcggcttttttgtacagctcgatgagctctacaaaacggtatcaatggtgtcaggctatatctactagaaattgagaaaattggcgagaagtgatgtcaaaaattaaaaaatttgaaaatgacttgcgtcccgccgtacattagtataaaccggacggcaccgtgttttgtgaattgaataataaatttatatatttaattttgtcgatcactgagctttttgtggaacgacctagcaccaccatatgaccacctttcttataattaactcatttaattttttgaatttgataatattatggtcaagctctcattgtagtcaaacattaataatttcagtaaattataatttcaaatgatttattcttagaaataaaaaatattttttcttaattttttgatttattttataaaaataaaagaagtaaaaataaatgagaatttttggcacgtcatttctcggcacataggctaattccgctgctagaaaaaactttttgtaatacaacccagggatggtctacacatttataaagtttcattaaaaaaattccaccatcgcttcaaatctctcttttgtaaatgtaaaagtgtctcaattatggtgcttttcctttccagtggcattgcccattccgtgctttgccgtgaccttcgctattctttggcggtgtggggccaggaactgacggggttcctcaattacaactcacttagattttccgtaagaatttttaattaactgacactcattttttttatttgccttttataagatttggcacggaaaaacgaccactttaattaaatacgcccttttcagaaagtcgaccacatcgctttggtgaagctgttttacggcttgttgaacaaggatctcgaataccgaacagtgcaagcagtcggcagtgtgctgatgcaacttttttcgtctgttaatttttaataatataatttttaaatttaattatataattaatatttctgtttgggaatggcttacaaattgtggcttaattttcattcgttttcagccggaaatcattgctggtccgcgaggatttggtcttggattggcggcctgttaatgaagctctacactgaggcgaggtgcccgaaataataaaattctatttttataataatttccagatggcgttaaaaaatctccaaaaagaaggggttatggttgtggcccaaggacttcaaaaaagggccttggccag

SEQ ID NO: 44927 - DNA, 918 bp, Heterodera glycines
tgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaagggcgggggggggggggcgccccgatgctaatccgttccgcagagcctcttcaaaatttttcccattaccgcaagagctgcggaaattgtgaattaattctcagaaaaatggctatctctttttaggacaattttctatctcgtaaccccgatgctaatccgttccacagagactcttcaaaatttttccattaccgcaagagctgcggaaattgtgaattcattcccccaaaaatggctatctctttttaggacaattttccactccgtaaccccgatgctaatccgttccgcacagcctcttcaaaatct

SEQ ID NO: 44928 - DNA, 966 bp, Heterodera glycines
  misc_feature (51)..(51): n is a, c, g, or t
ttcattcgtgctttgcttcggattagtctaaaaatttctggacgccaattntacatattagccattttttattttatttgtgaccgcaaatttttacatactagccattttttattttattgtgaccaagcatatctttcctcgtatttctgggatttttttcagaatgtggtcatagaataggtggattgaattatttgtattttttatgagtattatgtaaggatattttcgacaaaacataatcaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattaggctaaaaatttctggacgccaatttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaatttacatattagccattttttattttatttgtgaccgccaaatttttacatactagccattttttattttattgtgacccaagccatatct

SEQ ID NO: 44929 - DNA, 1164 bp, Heterodera glycines
  misc_feature (1147)..(1147): n is a, c, g, or t
  misc_feature (1155)..(1155): n is a, c, g, or t
ttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatctttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggagggggggcgaaggcccaccacgagagccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaattgatttttttgttttcggggcagtccccccgaaccgatgcgcccagatttatggggagaaggaatccttcgggaatagcttccctnatagcctngtactttaa

SEQ ID NO: 44930 - DNA, 783 bp, Heterodera glycines
ctgccgaatggatgcgcgtggtttccaggggactcgtccgctcatgggtcgccgtttcggtcggcggcgacggctgtggttgggcggagcgcaacagcggttcagccgctattctagcgctcaattgtcgctcaatgtcggagaaaagtttggacggaggtggcaagagggagctgggcgagtagaaggcgctcaggggaggggggctggcggcctcggctggacaaagcgggtcttgacggccccaggcgagcagtctcctcatggagaacagcgactgtcaacagacgaccgacggagcgagaagtgccaacggcgcagaaggacaaatgccgaagggttgggcaacggcgcagtcgttttggaaaagacacgggaataataatcggcaaaggaaaggcaattgaacgggggggggggggttgattttggtattttcgcaaaatcccttaaatcgtaaatcaaaatttaaaaaagcaagaagtaaaattttatggaaattccgctgatcagatggatcagcagccagcagactaattaatctgtctatttctccaatcaattaattagactaattggtgtgataatgttctcgaaattggtaaaaaaaaagtgcattaaacaagcggtgaagcttatgagaatttattttctgttaccgcccttttcttctgttttattcactgtcgataaacaacaaaacgtgggatgaaaaagagaggcgaaaggaggatggatgtaggaagtgaactgacgaatgagaaggtggaggggggggggaag

SEQ ID NO: 44931 - DNA, 1293 bp, Heterodera glycines
cccccccctttttctccccggggggtattttttttttaaaattttttttttttcccccaaaaaatttttcaaaacccccttttttgcccccgggaaattttttttttttagatttttgaccctttttaggtaattagacataaaaaaaattaaaaattttgaaaatcatttttccccttcctttctccccaggggtattttttttaaaagttttttttcaaaaataaacttttccaaaccccatttttcgccccgggaaatggtttttttatgaaattctgacccggttggagtagattagaatagaaaaattgaaaattttgaaatcatgtttcccactcccttctcacaggggtattatttgtaaagtcttttttccccaataaacttgtcaaaccacatttttcgcaccgtgaatgttatttttattgaaattctgaaccgttttgagtagattagactataaaaaattgaaaattttgaaatcatgtttcccactcccttctcccaggggtattattttgtaaagtcttttttccccaataaacttgtcaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcccccaataaacttgtcaaaccccatttttcgcaccgtgaatgttatttttattgaatttttagtccttctgagttgattatgctagataataattgaaaattttggaatcatgtttc

SEQ ID NO: 44932 - DNA, 1007 bp, Heterodera glycines
tttaacagattttctctgaaatttgcgttcctatcttacactcaagaaaatgaaaaatttctaatttttcaaaatcgaattcattcatatattcgcttcaataaaaacagcctggtctcaaacaatcatataaattttgtattttttttaattttcaaacaaaaaataagcacgtaatgctgaaataagcacaaatcctagaaataagcgcacttggaagccctgttcattagtattctaaaaacctcaaaatggctattatcgggaaaatttttgcagaattcctaaggggctaagcaaattttaatttcgaacagcaaaaaagtactgtaattcttaagaaaacagtgcattttacagtagctttgatcacttcgatattaatcgtacggaatctgagcgtacagaagtgtagcgacatgcggttttttgcatcttgtttaagccattttgaggttttcagatcaccccgaaggaatggtctgatcactgtggagcaaaggacttttttgatcagcatatgctaacattattttttttcagattttttcttaccctatagaaaaagttacatgtcttcaaagtagtgttgttataattgtttaacacccaaatttttcgaaaaatttttggaaatttttttacgttagccgatttttgtaatttttttgtgtatgatgtttttccccatcaacaaactgctggtaaaaatttcagcgcgatcggatgatgggaagtgggcgaaccacaaagaaacaaataaacaaattaatcaaaagtaaaagaagcagtatcctctgcatctcccaatgtcctcagaattcaacatataaaaacatcttacagtatacctaataaggtaatactggagaattggtgtcccgacgaaaaataacgttaagaattttctttacattttttctagggtaaaaaatacactgatcacgaatcagagctcggattttacaaaaccattgattttgtctatgatttttcaacatgcaaca

SEQ ID NO: 44933 - DNA, 920 bp, Heterodera glycines
  misc_feature (903)..(903): n is a, c, g, or t
atttcttcgcctcttatttgtgcaaaatttcgaaaaagtaatttactatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgacgaaagaagtgcagtggggaagaatgacgcctaaaatgaaggaaatattcgatgctgtgcgaactctttgtgacccctctctgactctgccaatgcagcagttgtccatttttaccaatatttttctctcactcatcgtctgctcgtctctcctttattataagctatttttccaaagccaacaacgcccgtttctcccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaatttcgaaaaagtaatttactatttaaaattaaaaaattcagaagcaaattcaagaattttttttatttttaaatgcattttttaccacatgtattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcnaacttgggtaattaaac

SEQ ID NO: 44934 - DNA, 1208 bp, Heterodera glycines
atcggaagcgtaattatcgataaaatccaaacaggcggcagaaagtccttcgattgagtacaaatgcgcgaccgtaaaaatggagcaaacatttcgaactttcaaaatggtctaaatcgatagagaatttttttagaaagaatgtatggtttgttacctttaaatattccggaattgcagcttcgagttcggaaaagccgtacttatggaccagggcgagcatatccaacacaaaactgagctcgaacgatttgagttgcaatttgccagtgtaaatgtatttgagaagggcctaaaaaacagaaaatcatcagcaaaaaaacattaatcagataaaactggaccaacttggaaagcctggacgggcgtatcgtgcagaatgacttcgctttccgatgactcgcgcatgccaccgtaaagcattgcccttttaagttggcattcggttggttatcatctaaacccctcccctacttgaaatatgaactccgtgcggccaaaaccactcgatggacgggaaaacgttgatcatcgacgaccaacacaaaatcactgaattcgtcgttcagatgcaaactcgcaatttgttcaacaagctgagaagtgtgctggatttcaccacctgaggaaatggcaatgaaataatttgtaatattaaagagaatggacgaagcgacacaatctcagatccaagcatgggcgaaagaagttttagtgattaaatctattaaaaattctgacaatgagcaatattttataaatttcgctaatttgttatttcaggccttggtgaactacatgaaatttctcgaaattcaggagcaaacagcactaacaaaaccatggcctgactcactgaggttggacattcgattagtgattgaggacgaagaattgaaatcctgaaggcttccggccaaactcgcactactaccacagttcctcagcgcggggtaataatgcgtactcatcaacgaagcgacactcacttggcaattaataatttaaagagtatactacctaattgaaaaatgaaattaaaatataaaaggaatgctcaaccaaataacaaataaattcgaaattcattattttcataaataatagagaaggcgtgagatattcaaaacatggaaacagcgttttgtgtttgcttctcaacaatgaaaagatccaattgcaaaagatcattttcaattgtccctcag

SEQ ID NO: 44935 - DNA, 308 bp, Heterodera glycines
ccttatttataattgacaaaaaacatttgtaagaattatgggcgaaaacggcttgccgtactaaaccgaccctcgtactaaaccggccctcgtactaaaacggccgtactaaaccggccgtactaaaccggccgtactaaaccgaccccgaccgaaggaaacaacaccaaccccattgtttgaatgtggcgtggcgttttgtattgttttgcgttaaaaaatgatttgaaaaatggaaatgtttggtttgatttttcaatttgttttgtaataaacattcttaaattgtacctatttatttgcttttt

SEQ ID NO: 44936 - DNA, 1381 bp, Heterodera glycines
cttgtcctgctgtgttcgacttttatctgacttctccagtttaaaattatttttttgaagtgtgtttaaaatgtaaaattattgttttaaaatggttgatattttttattcttaatttatatcttggctttaaggattcttctcttatctccaacgaaatttctcatgatcaaaactgctttaccgttgtattataattgggtatttttttcgtgttgtaaaatatacctatgttttgtatggttttggcggaatgactctattctattttattattttattatcgtcatcgtcatcgtcatttaaagatgcaaattttattttgtgaaaaatttttcattcttcaagcataatgaagaataatttaccaaataattgtcttagtatttggcacacatcaattgtggcgtaattatatagcatttatagattttttaaaatattatttttctcccaccaaaattaaacgttttcataagtatttaatagttgcaaaacaaattattaaaatattgcaatttttgaatatttatttataccttgctgtcttgttgttgtgatccatgttgttgaaaagcaaaaacagcctttccttttaataaatattttttactgaatattttcttcatatttcacttttttatccaattgagcaggctcgtgagttttgttggaataataagatattaatatattataaataagttattttttaattaaattaatttttaatttaactatttttctgatttatatatttacattatatactttttaattcatacaatattaaaagaagacacgaaaagcatttaattgattctattaattttttttgtgttaaaagttttaatttaaaatctgctttattaaataatttttaaaatatattatgatccgggcattaaaaatactcacagtttctataaacagcaagcatacttgaaagaaacaatcccttttttacctggaattttttggttttaattaaaaccttaaatttatatttttttctttgccatttgaagttttctctgttctttgttgttttttatattctgtcgatgctttagttgttgcattttaatttaacgcaattaaattatctttaaatgttacaatgatttaactgtttcatataattagtttattccaattgtttgtccaataattacaaaaaataaataaaatttattgtagaaaaacgaaaataaatcgaaatgatttccaattttacacgtgcgttcggatccccattttttttgcttttggccattaaaatggattttaaagaataatccatccatcgacttgtacgagacaaattatttttaaatagttttttgttatctgtacatgttaataaatctctttaaggaaa

SEQ ID NO: 44937 - DNA, 397 bp, Heterodera glycines
gctaaagcagacaacaacattgtgaggattcgcactatggtttcgaaattttttttatttattccttgaaatcctcaaatgtcgggtcctcaaatgtcgggtcctcaaatgtcgggaatatcctcaaaagtcgggtcctcaaaagtcaaatcctcaaaagtcgggtcctcaaaagtcgggtcctcaaatgtcgggtcctcaaatgtcgggaatatcctcaaaagtcgggtcctcaaaagtcaaatcctcaaaagtcgggtcctcaaaagtcgggtcctcaaaagtcgggtcctcaaaagtcaaatcctcaaaagtcgggtcctcaaaagtcgggtcctctaatgtcgggtcctcaaaagtcaaatcctcaaaagtcgggtcctcaaaagtcgggtcc

SEQ ID NO: 44938 - DNA, 1625 bp, Heterodera glycines
  misc_feature (108)..(108): n is a, c, g, or t
  misc_feature (1547)..(1547): n is a, c, g, or t
aaaatgatttcagaaattgctattgaactattcattaatcccaaaaaaatgctcttgtaaattttgattaagtataattttagtgcttatatgtggaaaatttgtttnaaaaaataaaaatcaataaagttaaattttatgggagattttatgaggaggcgcacgcggccaaattgtatatggcgtagcaagaggaatgggcagtgactctccagcagcgcgcaactacgcctatacatatgtaagtgcattaattgtttataaaatcccacaaattaatttatttttaatagattatcaaccaacgacttaagctacccaaaattgaggtaatccctttaccaccagctgatcaaatccacccagccgacctcaacgcaatgaatgtcctccgccaaaatctttacatcgaggtgaaaactgaattggggaaatgcagaatgctgtggaaagggatgagggtatgaaaaaacttaattaaaattgattaatccatatttttagctcaaaaatagactcataattaaaaaaacaatgttgggaacagagttacggcgtaagtcctttgaaaaattaaactaaaaatgatttttttctaaaatcagaaaaaatcatttaatttttagtgtaattggaaatattcgccgccctaagggatgataatttaagaaaattttatgttctggaatggaagcttgttcaattgcaaaatttttaaattttttcattaatgttcaatttcgaaaatgtgctttctttttgtcagtcaaaagtttaaaataaaattgatagaaaaattaatatttgaaaaatttgtcaaccaatttggcagatattcttaggtgctcatggggaagggaatctaaaaaacaatgtcgggagccgaagtcaaagcgtatgtccattgaaaaaaaataagttaaaaattaatcattttttcaaaaatcaaagatgttgaaaaaaaattttgtttagggaaatggaaacattcgacgccataaaggaggataatttaagaaaattttaaatttaggaatggaagctggttaattgcaaaatttttaaataataaaatgtttattacttaaaggtgactattgtgcctgatggggtacgcttgggttgcatttctatgaaataaaattttaatgaagattatgagtaagcattcgcttacttcatttattgaaacaaatttctcaagaaaaacggagaacagctcggatgcactgttcattgggttccgaagaaattggccaacgaacagttacttacaatggtcagagtaaaattcggtatgtaacatttgattatgatagaattattattttttcaatcccccaaaagaagggttatttatgtaaaaagaaattttattataaaataatcgagcatttcttttgaaaattttctttgacagcatctatcgaattgtaaattttcttaattaagaatgttttcaaaaaatttgctattgaactgttcctccattccaaatatgtgtgaaattttatatttaaaatatttaagtttaaaaactttgatgngagatttatttaaacatgataaagtaaaatatttatcattcgatagaaggaggcgcacgaggagaaatagtttatgtc

SEQ ID NO: 44939 - DNA, 939 bp, Heterodera glycines
atatacaaaatattacttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgaccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttgga

SEQ ID NO: 44940 - DNA, 1142 bp, Heterodera glycines
aaaagttttttctttttctctcattttggcgtattatttcaattgtacttggagcccaaaattgaatcgccatattttaaatacctaaaatttgcatccctagcaacaattattcccaatttttagtggcgctgtacgactgcgtggactgctcgcaaccacttcagcagcttttctgatcgaatgcccaaatctccgatcaatttactatgattggtattgcaatggccatgatcgtcccgttgacgccaacgcaaaagtgcgggaatggcttctgtggccgcgcgcggatggccgtccgaaagtgttgtactgcaccttttggtacgatataagtgacgaatacaagcaggcaagcggcgggaaagcaaaccaataaaaatgataattaatcgaaaagtaagagaggttgaaagataacagagagagagagagagaatgggagagcaaaagagggaggaacggggagggatataaaaagatgagagagtgggagaaaagagtgagtttgagagggagagaaaagacatgaaatagagaaaaaagataaatagagaaaaagagaaggagaagagggcagataaatgagactgtgagggtgaataagtttcaaaaaatagaatttaaaattactaagttggcagaatcattttggcattcatttccatttccaggaatttctgagtgccactagctcagtcaatttcatcatttgtttcacatcgttttgcattgccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataaactgatcagaagcgcaccagattttgcaagggcatcaaaaagacaaggaaaagcaaagctatgatgctaacgccaagtaactcttaatttaaaaataaaggtaatttttaaaacttacacttattttatttttttaatag

SEQ ID NO: 44941 - DNA, 897 bp, Heterodera glycines
tttattcctgaaatttaaaatattttaaatttattttaagacaaattttcatttaaaaatggatccaatacaggcaagaccgtctaattatgacgacagtgagctgatttcgttgatccaattccatagcatcgacataattgtaaaaataattaaaataattaacttaaaaaaaaattaattaatttgtgaggttggcgccttctcttcaatgatttgtgtcataacactttttgtcttcattagttcaaagcaaatgttatgccataatgaggtaatatatttttttaattcattaaagcaacaaatttatttttttaaataatttatctttatttattctttaataaaaaataaaatttaagcatacaagatttcagcaaatttcttaaaaatgaatttaattcaattttttatttctttagtttattataattttgttttaattaaatttttgattaaatttcttctctgagcattttgattttgatttttttattattttaatacttcgaataattgcatatttttaccattttaaaattcttttttatatgttgaagaaataattcattcaaattttctttcagttgctaacattgctcgctgccgctgacctttgcaccagcctcggcatttttgtgctcggtctaatgcgcaaggcactttatgaacaggtcatggaaacaagtcggataccaattgaggtatggtgaacaaaaataaggaaaaagatgttactaatttgaaaataataaaaattattacaattattagtgttcctaattgaataggcaattaggcaaagcaaaaacaaagctctatgctctgtttaataaaaacaagaaacaaaaatgaatgcataaatagctaaatctttccaaacggatcatattt

SEQ ID NO: 44942 - DNA, 1666 bp, Heterodera glycines
atgatgaaattaaaatgctcaaataaaaatttaaataattattaaatattttggcaatttttaaaaatttgattttttgttgcaaaaatagctttttttcgaactcacattctttgaaagacaatgaccataaatgttcaaaaattcttgtgtagaatggatttttttttgagaaattcacgtatttattgaggcgttttttaattattttgtaaatatttttggaatttttagcaaagattttaggtttttggcaaatattatttgatttttgggttttaaatcctaacagtggtaattagttaattatttgtgaatttttaactaaaaatgagcaccctcttcatcaaaatatcaaaacattcacttcttgcaactgtttatggcaaaataggtgacctaattagtcacttgaataaataattagacataaatcaataaataatttaattcaattttattttatttcgtcgttcgtccttttttctatcgtgccatatattccgcgcatttgagcaccttctgactcgggcacccgttgcaggacacggccacggcatcgaacgattggccaacattgaaagcacactttttggcaccatctttttccaccagacaggcttcatccgctgctggggagttggtcgagccgcgtaaaacggcacgcattagacatgctaaaaagcggggacaaaaaaattggcatttttatcgccgagacgacttttttcgccaatgccaggcctgtaaattgaatataggcctaatttttcgttataattttttaaatttaagagctcaagtgaaaaatgtcactttttagcaaatttattaacagaagaagttccaagaaaaaaaatttcaattttttgtttattttcccaattccatcccctggctacgggcctggcgtttaagtctggcgagattagctgataaaaccccagaaactcagtgaaaattttgtatttttccatgaattaactaaattaaatcttcttacgcaatttttaattaaattttaaaaaattaaacgaaataatttgttcgatctatatttcaaccgagaataaatataaaaaagtaaattctaaaaaaatctcttacggctcacgctgcagtcggcgctgaaccgcaacgaaatgccaccagttttggcactttcgtttggcataaagcatttgccagccattgtgcacacgcacaatcgttggcactccgaatttgtgcgcaaatcgaagaacattacatccttccacgcgcgccaagcagtgtttttcctggcgaatttataaattatttaaaattaaaaaaataaatttacaacaatttattaaatatatttatgcattaaaaaaatacataataaaattaaaaatttaatgactataacagaattttttaaatttaattaatttcataaaaagcattataatattttgccttacaataaagccattgccttttttcacttttggattattttttaattttaatataaaaaatttagataaatttaaaaatattcaaaaattctttgaattttcgtttattaaaaaaacaatattttttgaactttattttaatttttttttttaattaaatttattataaatataaaatattattattaaaatttttaacatattttacattaattaattaa

SEQ ID NO: 44943 - DNA, 1004 bp, Heterodera glycines
actgcgctgcctaacggcggtgcttaaagtgcgctaaaaatgatcaaatgattatcaatttttatttttcttaattccaaaatgaattcgaacgcaaaaatttaatcataatacatgtggtaaaaaatgcatttaaaaataaaaaaaattcttgaatttgcttctgaattttttaattttaaatagtaaattactttttcgaaattttgcacaaataaggggcgaagaaattcaacgaaatttttattaggattttgatttaaaatgttgagaggtttaacaaatttgtacactgaatgttggatcgtcaacaccaatgagaaatgactaacagaaaagagggagaaaagggcgttgttggctttggaaaaatagcttataataaaggagagacgagcagacgatgagtgagagaaaaatagtggtaaaaatggaaaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaatgcatttaaaaataaaaaaattattgaatttgcttctgaattttttaattttaaatagtaaattactttttcgaaattttgcacaaataagaggcgaagaaattcaacgaaatttttattaggatttgatttaaaatgttgagaggtttaacaaatttgtacactgaatgttggatcgtcaacaccaatgagaaatgactaacagaaaagaggggagaaacgggcgttgttggctttggaaaaatagcttataataaaggaga

SEQ ID NO: 44944 - DNA, 1262 bp, Heterodera glycines
  misc_feature (1224)..(1224): n is a, c, g, or t
  misc_feature (1232)..(1232): n is a, c, g, or t
  misc_feature (1242)..(1242): n is a, c, g, or t
ctatcatctgtcacccgatctttttccagctaaactttctatttcaatttcactaaccaaaacatttcttctgctgctggtaaaatttatatgtgaatttcatttcactttttggggagtgcaaatttgttcgaaaccgatttacattttcagaaaaattcaggtatattttattaaaaaaaaacattgaaaaatttttactcttgaaaattttgtcagaggggggctgggatgggctgattcggcggatgaggggagggtaacggtttgatgccagaacgtaacgttttgcatttaaatttgacatattcaaataagtcgaaatgttgccaaccctggaaaatgtcaaaaccccatggccaagcaaatccaatttatttgcattgataaatatgcaacattttccgcctgtaatcattgtcattttcacgaaaattccggtttttcattctgaaatattcccgaaaacagcagttggccttcattcactacgcacaatcataaaattgaatgggtgatcggcaatgaattcgatcgttggtggccgtatgatcagcagtgatcgctccaccatgatcagaccggtggctgcagccgcttcacttccagcctcattattcttaatggaaaatcagccaatttttgatactaaagtttttaaatggcattaatggccatgtgttttaaaaataacaaaaaaaagttttaggaaattctgctgttttaaatcgtattttttaaaaatatcgaatctttaaattcgaataattccgaaaataacaaaatcagcgcaaaaaacccgcaattaaaaaataaattccatttgaacagattttttaatgtgtgagagaagatttcaaatatttaattaattcaacgttttgatcacaacaaatgattattgctgtgcattggattatgtcttcaatttgcgattattatgattaatgaacgatcagtataatcaaatcatccgtgaaaaactgtgccgaaaagcatattggcattatcatcgccagttgccaagaaagcgaggaaagggtgatcagcgatgaagcgatttggggaaatgttggcactattggccacaacatgaatgccagtggcagctgcagcttcggtgccctgctcattgacctaagtgaggatcatcgattggtttatttggcagtgtgatcaaggcccgtgtcgagaccgagatgaagatttgatcccgagaccganaaccctanaccaagactncagaacgagatcaaaaccta

SEQ ID NO: 44945 - DNA, 725 bp, Heterodera glycines
tttttggggtttttcacccccaaattaattttatcccggcaacgaaaattatggacttataaatcctttttttgggtttttcgaccccaaattaatttttaatttggggttttggactcccggcaactgaaattatggacttacaaatcctttttttgggtttttcaaccccaaattaatttttaatttggggttttggactcccggtaactgaaattatggacttacaaatcctttttttgggtttttcaaccccaaattaattttaatttggggttattggcttttgacaaacgaaattatggacttataaatcttttttttgggttttaaaaccccaaattaattttaatttggggttattgcctcccggcaaacgaaattatggacttagaaatcctttttttgagttttaaaatcccaaattaattcaacattttccatgtttgttttgttattttataaaagaatttcgtgttttttttataggtcaaaaactcaaatgctttatttttgccgtcgggattttcctccataattcgggtggtcagtcttcccaggttgaactcggaatacaaagaagcaaataagcttaaactaacatttttttactaacctccacgatatttttaaattgttgaaagatccacatacaaaatagattcataacaaagaattatagatattttcgctgcgaattgattactatatatgagatagaaaat

SEQ ID NO: 44946 - DNA, 883 bp, Heterodera glycines
ttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctgtaattttgtttctcggcgcgtttgtttgggaaaaatttggaaaattggctatctctttttctgctcaacagtaataggaattccaaccgcattctcagaataattacgccgatactaattgttctggaatttgtttctcgtcgcggttgtttg

SEQ ID NO: 44947 - DNA, 1001 bp, Heterodera glycines
aaaaaaatcgattttttcaagtgtccgtttgggggtactcaaacaattatggggagcaaaaatccaacgcagaattaaagtacatactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgcccccaaaacaaaaaaatcgattttttcaagtgtccgtttggggtactcaaacaattatggggagcaaaaatccaacgcagaattaaagtacaggctataggggaagctattccccgaaagattcgggcttccccataaatctggggcgcatcgggttcgggggggactggccccgaaaaccaaaaaaaa

SEQ ID NO: 44948 - DNA, 1063 bp, Heterodera glycines
ttttacttttaaaattaaaatttaattttaaaactttagtttactaatcctttgtattttttaacttatttaatgaattattatttcatctctcgcagttatttttctttttttaaactcaaatttctttaaacttttgttgattgtattttaattattcaaattttaattattttatcacgtatatttattgaattaatgaatttaaagttatatattgttgttttttaatcatgtctatcagcagatcattcagatcattcatttgctcagccgccggcggtgccgtagtaatttctcataaatattttttctttcattttaattttaattttataaaatttaatattattttactaaatgtttatagttttataattattatggtaattatttgtacatatcctttttgaattaaaaatttaaaaaaatatattttagattataatctgtctagtaaagtttctgtgcaaatttggggaatatttttgttttgattggtttcatttcttttcatataaatttgattaaagtatttcttttctttttcctttaatcaaatgtttaaaataattattatttataatatcgactttttgagaattggtattttatgaaaaagggtttaattaatgacgaaatttaaaagtatttatcatttaagtcattttaatatggttgatttggtttgttttcattgcaaattaatttaataggtaaatacagttattttttcactttttaattaattttttatatataaattgattttactatttaaaaaattatttaagctcgctttttagcacttttagagaattggcattttgtcattaatatttgtttttttaaatttgttattgaattattttaagttttttattatgtataaattagcttaatttaattcattatttttatcattaattctaattgcattaattatttacttccataataaagttgctccggtttctgaaggtctgcaacagatcattgaatcttttatttttctttttaaatatatttttttatatttattcacattacggatagaagtttg

SEQ ID NO: 44949 - DNA, 1231 bp, Heterodera glycines
aaacatgaaaaattagaaatcttaaaaatgaaatatgtggcacaaagtcggcgatatatctcttaatctcgtcaaattcaccaaaattatgtcgcttacaaattaatgttctgctgccataaaaacgtgcgttttcacgtaaatttttaaaaactcaatgagaaacattattactaaaaacaaaagtcagattcatttcactgatcagcggaacttaaagtacgaagagatcattaaagttcgtcatattttgtcaatcggtaattaaaatgaaatttaaaacatttcattgataaattttgaaaataataatattttccttaccaatttcattgtcgtcagaaacggctttggggttaatgaacgaatgaatttataaatgaattatgaagtcagccgcacattcgattaaataggcatttaatacgtataaaatgagcctttgaaacaaaatgttttcacacggttaaaatgaaaaaaaaagtgaaatgccaaagaatttttttataaaaagcaaattttcccactgttttgttaaaaattattatgaatttattttatgacgttaatcggttagccgttactaaatggggacgagattttacgaaaagtcggtctctactcataactcactggaaagaccgtttaaattaaaaattcaattatatgaaattgaaatcggtaataatttaaattatttgcgaattttttttgcttctttaaaaattaaattaaataataaattaaccaatgaagtgatcaagagtcttggggagaggggtgggggtgagggaactgcaccagggaaaatgaatgaaaaacacggaatgaccttgaaatcaattagtaattcaatatttaaatcaattagtaattcaatttttcacataattattacattcaccaaattggcattaataatttgccggggaagaaatctttgtccgaattgttgagagataaactccaaaatttacaaataatatccttaataacgcgtaagcctaaatgttctaatggtttttgatgcagaaaaaattgttactatttttatacattaaattctcaatttttggcacgttaagtaacttttttggcacgtgaagtaacctatggtatttacagagcacaaaaagcaattggctcaaaggttggccacaaaagtcaacctaaattagttttggcattaacgagatggtcttttgttgcgcatataaagtaataaaattaa

SEQ ID NO: 44950 - DNA, 1400 bp, Heterodera glycines
ttttatcaatttctcataactgtgatagttgatagcatagataaatattgttttacaaagtgctaaaatgttaaaaatcagaaaactttcaaaaaatagccccccccccattgttgcatctttttcaaatacaaaacaatcgcgtcataattttttctttttcaatttttcgttgatttggcaaatgtttccaatttttcctcaaacttttctacaaacgcaataagtttcttccataattcttttaatccacttttgacgatgtgcttaatgctgtccagcaactgctgcatttctttgaaaaaatggacataaaatttcaaattgtttttgccaattttattggtttcttcagctgatgatgcacgaatagggacaaaattggtaatgaatttcttaaatttaaataaagcatatttaatttaatgtaaacagccctcatcaaaaacaaaaacataaaaaatgttatttctcaaaaaatttattcattaatttttaatataaaaaacattttttttaattaatgttctcttttgcatttaaaattaaaaaagatcaattatggttaaatgatcccaaagcaagaaaattttgtttgatttttcttttagtcacttttttaccaaaggaatttttatgagcctcctccttccagaaagtttctgaaattttgtgttttttttattttcagtgtaaaagacaaattgttaactttgcaaaaaaaaaactgaaaatttctaagccatttttaatatttgcatatcaatgccaaacctccaaatttttgcattcagcttcgatcaatgccgtttcatcagcacccaatgaatcggccaacaaaaatatttttgaaatttttaaatattctaaaaatttgtgctcaattggttcagaaatgccaagcaaagctttgccaattctatcagcattagccaatgttacttctaatttcgaattctcgttgaattcagtccgagtagagattatggtaaatgccaattgcatacctaaagtgccatttttcaaaaaaaaaagtatagaaaaagaaacaataatatttttgcttttaacgaatgggtagtttttcgaattcaaaaagcaatgattttaaatgtgtaaaatatatttattcaaaacatctttgcataattttactagaaaaatctcatctagctataatttttgtcagtttttaaaattttcttttgggcttgtggcccggacggactcgatcagttcggccccaaccaattttttgactataatttttccattgccaaccaaatcaaacgattttcatagcaagcctaatatgtttagaagttttttctaagctattgcttggcaattagacaattataaaataaattattacctgtaaacttgaaaatcgatatttt

SEQ ID NO: 44951 - DNA, 1658 bp, Heterodera glycines
aaaggaatttcaggggaaaaaaaaaattgtggcccttttttgtgcccctcccatgccagcccgattaaatttatttttccaaccggaagagagaaatgcaacttggggtgggcttttgtccccctaaagcaaaaaatgtcccttcaaaattggtcctcatttttctcgaaaaatgcttgacaattgccggcatcatttttactattgccggcatttccttttgtgtaattcgcgcatatttgtggtcaattgaacccgattcaattgaaattaatgtttgaaatttcttttcaaaatttgcaatttccccgctttttactgcgtttttaattaattccatatgaccaaagttttgcagtgccccccccccatttttttctctccgtgccaaatatggcagccgacggaaagcaatttatctcccgtcccctctcccgttttttgctcttccccgtcgcgacattagctttttgcggcgatgaatctcccctgtcgctcgggagaaaaacgttttttgccttttttcccattagctcgccgctgttgtaacatttaaaaaaaataaattgcattttttgctgtaacgcccatcgtccactcggacccgtcgttatttaaggccggctcatccttcagaaaagccatttcttgtcttcattctcatttttcctccgctccttatttttcattttttccattttccattttctttttttcaatttttatttttttttatttttcagtttttcatttgtttagatgcaaaaacctattccttcaaatcgccccaactcttctgtctccaaaacccttgcctgcgggcttgaaaaaatggtgaatgcgagtggaaatgagccactcacggtgccggtgctggcggatcggagtgatccgctggggctcaagtcggttcaacccgacccggtgccaatggaaagtgccgaggctggcacaaaagaaatggaagtgatggaagtggatgaaatgagcggagaaaaagggaaaaagggagaaatgggtaaagaaaaggtgaaaagtggtggaattgaagaggaggaagaaagtgagggcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaatagcggaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggctatggtgtcagcacctgagctgagctgcgtgatgcgcgcctaccgtcgccacttcccggccgatttcacggataacgacatccgctaccgctccgttgttcgtcttcaacatcggcagatcaacagtccgccatgggtgctgtattcaca

SEQ ID NO: 44952 - DNA, 1176 bp, Heterodera glycines
agatttatttgaaatttatacctcaaaaacaaaaaaagttattccagaaattctggaaattttcgatttttcagaaaaaaatttatatctcggttctgaaaagtcattagggaaaagtaaaatactacaaaaatccgcaattttttgctctattaaataaattttaattcatatttttatcacttttttaagaattgttataaaaataaaagtgattttggcattcggaaccaaaggggtgagcataggattattgagttgaaaatttttttcgtcaaaaatcttccaaaaacatgtctttaggggttatttgggccgctgatcacgaatacgtgatcagattttacttttgacatcgttaagccctcagaatccctgtgtgattggggattctgaggcatcatttttgggggggggcgaagttcggatccgatcggtgtacattatttttctgtgcattttttgattacttttacatgttttattaattccaaatattttttataaattatttaaatttatttattttttttaattaaagaatttcattatttattttttgaatttgtaaaaaaattaatttaatttcaaattaaatgaatattcaattaataatttccaacgttgtttttaattaataactaacatttttttcgtgttttcattgtttaattcatttaaaatattttttattttattaataataaattacatttttttatttgaattaaatttttttttataaataaatgttttgttttaaaattaattatttatttattttaattaatttaatattgtttgtttaattaaatgttttaaaataaaattaatttcttatttatttttaaataaaagaaggaatttattttataatttttaaaaaattattaacacattcaatttttaattatattttttataaaaccatttccttatttatttaattttgaaaccatgaatcacggatacgtgatcagttttcacttttgacatcgctaaagcctcagaattcctgtgtgattggggattctggggtatcattttttggggggggggaggaagttcaaatccggtcggtgtaaattcctttttttatgcattttttcgtcaaaacacgttgttgtacctcttctaatcactattgaaactcatttaatcactgttgtacctctt

SEQ ID NO: 44953 - DNA, 642 bp, Heterodera glycines
cggtaccggttttttcaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatggggttacacacatgcacatgtggtgtagtggttaactttctacctttcataatttttcgcctgggttcaattccccacttggatagaatattcctcatattttctttaccattattttaattaaaattttaatattaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgcactacatagggtgcccactttaaatatcgattgattttctccgcagagcgcagagagtatgagcgggcatgcccgtgcctattgggtgattgtgtctgcgtctctgacgtgtggtgcgcggggagggggtggggggggtgcgtcgggaaatgtgggttcgggatggtggttggtgcgcgcgacggtgtgggg

SEQ ID NO: 44954 - DNA, 1344 bp, Heterodera glycines
tgaggcttttttatggatgaaatgaggattatcaaaattttgagatcgaaaccctcggataataatatattttttatttttttttaaattggtattttcttttttcatttttcatttgaaaacaattaatttttaccagttttttggtttaattattttatctcatggctcgtaaaagttcagtgttttcacttcaatattagatggagacgctttgcatcgtaaaatatgaataagttttattttgttggaaaatcattactaaattagagaatttttctaaattttcttatatttaaaagtgtttttaaatattactatattccttttaaaatcattttttatcattttctaaaaaccaaaaaaaaatttattatgaattaatcataaataatctcttgtattcatgcattcactgtgattctttgttgacggaacggagggcatttttatttcaaataattaattctaataaataataattgaaattaattattttattattttattcatctcatttattttctatttcttctggcttatttaaaatttagatttattgttttaaaataataaaaatcattttattgatactttttttgacagtgcattaaaacattgttaattaattatttaaatttcctttttatctgataaaagcaaataatccatcttttttattaatatataaagtgttcataattttaatatatgttcattctagaaatcatataataatataatatctatctataaatttatagaatttattatttctttgtttaacatttgaatataattttcataaatattatatttttaaaatattaattatattaatttgtattataattattcctaatcagttctatataaaaatcaaattaaagttttttttttaataacttatgtagaagtgctataataattttaatatttattattttttaataattgttattctcatgatcagtaaactacacaaaaagataataaaatgccatcgccaaaagggaccgattgtgccatatcaagaagaaaaaaacaggcaaataaaaaagtgcgaatgcagtctaaaacattatttcgttgcaaattagtttggcatttataaataacggttacacatttgatgaattttaagcgctttttcttgccattcctcgagcacaatgccgtcctgtggattatagcataatcggtccccttcggctacggcattttattatctttttgtgtattaggaaattttgatttgaaaagatataacgaaggtaagataaaaataataattatctagggggaaaatatctttccctgtaataattgatacaacagttttat

SEQ ID NO: 44955 - DNA, 1040 bp, Heterodera glycines
taaggtgaaaacacacattttacaacccatttttggccaattgtaaaaagccgggtttttttctttaaccctgttattctcgaaaaaatgtcttgcgacattttcatccactaggatagatcgctagagaattattttgcattgcagcagttatttacgtctagttcatttatgattaaaatattgaaaaatcttttataaattctatggtttattaaattgattcacttttattattggatgaaacgaaaattgggatttttccttttttaattttttaataaatttttgctcataatgcttgttattccattgctcttagatttttctatcatgtacattttaatttctttacatttctcacagcatattcacatatcacaaaaatggtaatagcattaaatatattaaacttcattcataatttaattttatctcgagcttcagcagcaatcgtgctgtccttccattttcatcaagaatctatggagagttagtaagtgaaagcaattttttgcctaatttaagaattgattgggtttatttttaaattataattcgacttaataatgctatttatatcctttaaatttaaaactaactaaaatcgatataaaaatattgagttgattgatgtaatagaaaatattatattaattttaagcaataaatttgcattgtttataaaatttttaaagttttttaaaattcttgtgaagtttgtgttatgtatgactttctcgtctattcatcaagctcagatcacttacgttagaatttcttattttctggttaagtatttttattgaaatataaattttaaattatactttaaaacgcacttagatattaaggacaattctttttctcaaatgctagtcgtatttcttttaattttttatttggttttaatttgttgtagataattctgttgggataaacgaaaactgtagtttttctttttttaattttatgaatatttttgtatcgttcagaaaaacttttatgttaatttgggctcttttcatcataaagtttct

SEQ ID NO: 44956 - DNA, 1379 bp, Heterodera glycines
agggtgtccatttcaaattaattaatgggaaatcgttcgttcttttttaatcaaggatttaacaaacaatagcagaagaaataatttaattaaagttaaaataaatgtaaataaattttctttcaaattaattttacagtgaatgtgaagagggagagaccggaaaagaagctcgagagaggggaaaagcatcagtacaattctcgcttttcctcccttcggattaatcacatcgcaaattccaatttttccgtttcccttaaacggataaatacgactgaaaaggtgtacacccttttgtgcggagggccttttgctgaagacccttttttgacaatttttggcaggcccaacggaattgggccttaaaacggacgtggaccgatcagtatttttgttgtaagtgatttttggcacgaaaaaataaagttttaataaatgaatataacttttggtttaatttttgattactgttttttgagttggattataataaaatttgtggaaaatgtttaaatgtaaggccgtattaaaaactaatcattatttaaccatttttgaacgtttaactttatatatagcgaatttttaaaatttttgacattttatatgaaggaccggtagaaaatattgccgtgctccagccggaccggggctttgttcaaaatttgtggtacgttgcttaaaaaattgcggaatgtgcaaatttagattgggattaattactttaattaaatgtaattctttttcttacaatttcagggaaggaagaggaccagcggcatatgtggataaagagaggggggtcaggggtcgggtcaatgtcgtaaattttaggcaaaatcgaaaaaagatatgaaaatttacttttacgacattgaatcgcttttcgttaaaataattaaatttttgcatatctaaaattatttaattgtttattgaaataattatgtagtaataaccttttcaaactatttttaatttattgaaatattcagcgtatttaaaatgagggatatgagttcattttgttaatttccatgtttaaattattatgtgtttctttagtttagcataatttttttttgaaattaatttgaaaggcccaaattgggtaaaggtcaaaagcaattctgaatttttttttaagtgggtgtttccaatgataccaaacttgaagaaaagtgtcagctgttactggttgggagttagttgaaatacattcacccccatttctaggtgtaccatatgtttggcataaaattttatttttttttaaatctcaatatttgcaggtcaaaaattctgaaaaaattcccattaaagtaacttttaatgctgatcaaaaaaagtcttttcagcaacttcattaaatcact

SEQ ID NO: 44957 - DNA, 776 bp, Heterodera glycines
ttttgttgttgtttgttaacttcgttggtattataattttttttgttcaacttcgtttgtattaatatttaattaatttatttaatttaacatatacgaattaaaagcatggaataaaaattccacaatatgcgatactaattcatactgtatcctttttttttgtttttgtttccgtccaaggtcaggcttttcccgttttcttttttgtgcaaacaaaaatgagtgcgtttggagatgcgagttcaaaaacagcaccaacaaatgcaacggccgaatctggacggacctccacgaccaattcattcgcctagcaactccgcacacatgtccagcagatgcgtcacgtgttgatgctcaaatggtcacgaccgcaatcaaaaggcgtgcaattgccaccttcgaaccaccttctgtcatcagagcagaagcgcttcaaaatgtcccgtctccgtcagcaattttggtgtcaaaacaagcagcaaaagatgtgaaaacaaaatatttttcatttaataaaaacaattccaatttagttgatcaaaagagctcgccgagaagtgaatgcgccccccgtcgttcctgcaaatcttgagcagcttattatcagcccggcgtatcagacgtacacaccgacggacggcattgatgaagagttcctgttaggagacagcggcgtatattatgaacgaggaaatgagaacccacagaggtaaaatgacaattattttcttatttcttttgttatagaattttgttgttcggacgcgagtcat

SEQ ID NO: 44958 - DNA, 931 bp, Heterodera glycines
aaaaacttttgggtaatgattatttttgaagtgagtcaaacaccgtattagtgcttgctgtgccgagaaccggcaggcaatggatggctttaaatctgcaagaaattagattggcaataagtggttgtaaaaaacttttgggtaaggaattattttttgaagtgagtcaaacaccgtattagtgctttgctgtgccgagaaccggcaggcaatggatggctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaataagtggttgtaaaaaacttttgggtaatgaattattttttgaagtaagtcaaacaccgtattagtgctttgctgtgccgagaaccggcaggcaatggatggctttaaatctgcaagaaattagattggcaataagtggttgtaaaaaacttttgggtaaggaattattttttgaagtgagtcaaacaccctattagtgctttgctctgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaccggcaggcaattgatagctttaaatctgcaagaaattagattggcaataagtggttgtaaaaaacttttgggtaatgaattattttttgaagtgagtcaaactccgtattagtgctttgctgtgccgagaaccggcaggcaatggatggctttaaatctgcaagaaattagattggcaatatgtggttgtaaaaaacttttg

SEQ ID NO: 44959 - DNA, 926 bp, Heterodera glycines
agtcttttaaatggtcaatccggacaaatttggtattattcgaaagctcttgatgagttacgtttaaaaccccaagaattattacatctgagctcccggacaactgagttccagtgaaaacagacctttcagtaccagatattatcgaagacgattaccaaatttgtcagggttcgaccgttttaaaaatcccccgtataagtcaggagattcaaaaagacctatagagcaaaacatcaccaaatttgatcgatttcattctgcggcgtcagcaacgaaagtgcctaaattaacaaatgaattccaaaaacaatgaaatcaaaaagaatacattctgcgcaagctgacgaacttcctccgccaactttaagcttcaaaatggaacacagcgaagttgagcgttaagcccaggcgagttggattggacagtttcatctccttggtggcaatgtcaaggccatcatggtaggaatgttttgacgggtccatgacagctaaaaatgtaaaaatccgttttcatttatttattcgaatatttagttttaaattatactaatcgataatgcgcttgcgcagcaagttccaacgccccaaggcggtcttccacggtgttgaaccaatccaccaattctcccatcttcaatgcgaccagacgatgatcgactgggaaatggccaccaacacgaacattaatagttcggaagacaccctgcatctctcgttactctgtagacgcgccgatgcatttgccgaagcatcttaaaggcgagcgtttggtaatcgaggtttcgcaggataataaaatgactcttggacctcgagggttaatttctttctataatgaaagaaggctgaagcaggtccaaatataatgcatcgtgtttaaaaagcgactggtaaacgccctctctcatttggtcccagcg

SEQ ID NO: 44960 - DNA, 949 bp, Heterodera glycines
  misc_feature (829)..(830): n is a, c, g, or t
  misc_feature (835)..(835): n is a, c, g, or t
  misc_feature (844)..(844): n is a, c, g, or t
  misc_feature (848)..(848): n is a, c, g, or t
  misc_feature (871)..(872): n is a, c, g, or t
  misc_feature (876)..(876): n is a, c, g, or t
  misc_feature (881)..(881): n is a, c, g, or t
  misc_feature (885)..(885): n is a, c, g, or t
  misc_feature (890)..(890): n is a, c, g, or t
  misc_feature (897)..(897): n is a, c, g, or t
gtttcttacctttgccaagttgtagataaataaaaaaaatataaaacatactttcatatcttggcccagtttcaaccaaattaatatttcatggtgtcattcaattttagtctacttgcttctgaaaaaaaagttataaagcattgaacaggctatgttttttgccatggtcatgcgaatataattataaacatttaaaattttcaagtcattaaaatgcaactaagtcaaaatgcatttatatattcgatagtactaagaattctctatttacggttaaaatttcaaaaaatttcagtattaaaaaagttctggtaaaataatttgactcagcacttattgaaaattttggaccataatttttttataatttcatataaaaattttataaattaatattctaatagaaaacattgtatgataccatgaaatataaatttggttgaaattgaccaagttatgaatttatgtcttacattttttgttttcctaccacttggcggtttttaggaaacgacccagcacgattaaaaaccacggtcatggtcacggtcccggctctgctctcgggaagtgccggtcccggttttgcacaatgtctcttttcctatgcaactatttttatttacgccaaatttttaacgtttttgtagtgttcttttaaattacaattttgaaaatcgcataattagggaaaatgattcgtccacgctgattttctatttgcacgccgaggccccaatggtgggatggcctcagcacagacggaccgatcaaagttatgtgatgtacacggctgaatcgccaccgaacacattgccacatttcnnccgcnccatcatgncggncaattggttcttcgtaaggggtnncctntcggncggncagtnccgtatncttgccttgtaaaggaggcttgtccgaatcgcacccgacactcccgcggaag

SEQ ID NO: 44961 - DNA, 911 bp, Heterodera glycines
tcagcgcgaactcactttacattcaattcataaagagattactattaaattacatttgtaattattttataattgatacaaattacatttgttcagccttagagactaaccgtgggggacctctctatctcggccaagcttaaaaagtcctaactttatcattccgaacaagtttggcttcctgaatatttcaagttttggtctatatttttcattaataatttatattttacaagaatttggaccccggactataacgtttttctttctcaactaattgaacattgttggtatcatttgatagcccagtgtcctctattagcctgcaaaatctcgaaaaattttgttaaggctcacaaaaagttatggccaaaaatgattgaaaataaatattccgcacttataattaagtgcgtcaaagcattcaggtagcgtatattgattgttctgttatggttcgaattattaatttagcggtgcattcgcctgcctcaagagttacatggcctaaaaaattggaaattttaacacatttgcgatagagtgaatgaagcgagactgagttgtacggttggttaaaaataagtttttttttaggccatgcgttcaattccacttgcctgttttagaatatagacacgttcgaaaaaagatatgagcgttcgaaaatttgtttttctcattttttatgaaacggtatgttaatgaatgatcataatgttcccaagcaagcatttttatgcaaaatgaaaggagcaaaaataaaagagaaaatcggatggatgctcaattaatgggtcattgttgcatttaagaatgaattgctttaaactgacaaatacaatcgaatagaaactaaatttccaaagataaagcctttgaaaactccttcaaaatcacttgccatcaca

SEQ ID NO: 44962 - DNA, 199 bp, Heterodera glycines
ccgcaaatgtccgggtcgcaaatgtccgggacgcaaatgtcgggccgcaaatgtccgattttggcttgggccgcaaaattcaacaaaaaattgggccgcaaatgtccgggacgcaaatgtcgggccgcaaaagtcgcgacgcaaatgtccgattttggctggggccgcaaatgtccgggccgcaaatgtggggtaaccg

SEQ ID NO: 44963 - DNA, 1200 bp, Heterodera glycines
  misc_feature (90)..(90): n is a, c, g, or t
gaaatttttttttaatttatagataaataaagaattcttatgtatattcaatatataaattaattttggctcaattgcatttaaagactntagaattttaaatgtttataaataaatatgcatgaccaaggcaaaaaacatagcacgttcctgttttataactatttttcagaagcaattagattaaatttaatttttagaatttcaagtccactacttaatatatttatcttgaaaaaccattttgttcataattatttaaaatgtatggaaaagtttcagaactcaagaagaaaaaacataatacccaaataaataattaaattttgcataatataaacttcttaaatgctcatgatacgattaaaggataaaaaccaatgataacactttatatttaataaatcttatgatgattaaaatatagcaattaaatattctatacactttatatttacattaattatttctatgttaaataataatgaaattaaattgaatataataaattttagaataaaaaatgaaaatatagcaaaaatgtatttgaatatatggataaagatagtttgacaattataaaaaaatgcaaataaattctccagtatttattgtttaaatgaaaaaacacaaaacagatagtttcttcattcatagttgcaattaatcatttcgttggttgatgaaatcagcaatttatattacttagcttgaaattgttagcatgaaatgcaataacaataaatgtataaaaaaattctaacaaagtaagaataatacgaataaaaatgagatattatttatttccaaaaataatttattaataaataaaccgttatatgtacatttacatactttgaaatgtcctttccaagaaaacatgtgataagaataactaagtttatacatgattaacgagtaaaaaaaattttataaaatacatgtagattattattataaatataaaatattgtaagtaattgtgatcatcgatgtgaaaaatggtcgaaatttggacggaaaagtccatgcacataatattttttaactcagtcattataaaaatttttaaataaattattaccaagatttgcataatatggaaaagtttcagagctcaagaagaaaacaacataatacccaaataaataattaaattttgcataatataaacttcttaaatgctcatgatacgattaa

SEQ ID NO: 44964 - DNA, 1416 bp, Heterodera glycines
attcccaaaagcttcattcagtcggcattcgtcccccacataaagcatttggctgctcctccatttggtgcaaaacggaacggtactgaaacgcacaacaaagggcttattgttgaatttgctgccgaaaaagggccagcaaaacctttttccaaaatcccaaatcgaactgttcgggcagtcttcgcactgtacacagccctttctccttcaaaatgacatgggacaatccgttgacaaccgctcaagcaaaaaagggcaattacggggagcgtacaaaaagcgccgactcaccggcacccaacaattggtcacccgactcgccaaagccatccaaacaaaagacggaagcgccgctcggtttgatcggatgacggacaagcagaaaggaatcggagaaaacgacggcacattcttcggctgacggcaccaacaaagagcagcgggaaaggcgtttgtcctggaggcgtttgataaatttgacaacaatgggcccaaaaacaaacaaatccagtggcactcagcgattcgggaatcgcaattcggaccaatgttttgagagaacgcggcgaatgggcactttgttgatgacgagtgtcctcttcataataccctggaaaaggaaggaaatcatttgattaacaaatgttaaaaaccaatgaaaatttgtttgtcttcttcggccctgtctttgccgatgagtacgccaacgaaaagcagcaaaatacccgaccgaaacattgctgcgtcaagaacaacaaaatgacgaagttcagcactgtctcgactctttcagttaattatgaattggtttataaatgccaatgcttccgctctcctcgccaaccttattgtgtttgctcaacgccaagtcggcaatgtcaacttcatgaagttgcatttttcgctcgaaaatggcataaaagcgcaaataacgggccaaaacggtgacgagatcggccggaccaaagttcccccgaacaaagagaatctttttgattctgaaagaaatgaggtaaagatggaatggcagaaaagacacgcactgctccttttcagatgccaaattgccgaagagaaaaagggacattcgtttgccaatgccaccgcccggcccaccaacatccaaaggacgcgtcgccattcttctgaatttgctcggcgatttaaactcacaaataaaaactcactcggcctgaccagcggagctgcggaaaacgtcaatcatatgaaaggagccggtggttgtggtcaagagaaagcgattgacatggtctgaagaggaaatgggaagaaaagggaagggaacggaggagggacaacagaaagaggggtaatcaccttccgattcgaccaactgcacggagtgcgccacttaaatgttcagcaaacagctctcgtccctgtacggcttcc

SEQ ID NO: 44965 - DNA, 1054 bp, Heterodera glycines
taatatgttttgattactttctaaattaaatttggttttttgttcagtttttctttaatttgttattaaatacaaaataataaaatgacgagataacccaacccaaccacgatgatgctcagtggttaatattttcatttttcaatgaaacttgtagtttattttttcataagataatttatataatttaattagataaaaaaaaattatgttcaattgtaatttttgattttctatatttttcttcaaatatatttttattgatttttttatgatttttcttaaatgatcttagttttttagttaattatatgatcatttttcttacctttgatttattttttaaattatatattgcttgtttttgtcattttcttcattgtatattatattttttaattttcgagaagtgtattcagaatttaattaattgatgctatcttttaataaatttttctgatataagttaattaattttttttagttgcacaaattaaaaaaatatttttctttgttaacctttgttgtatttgtataggtttatttattgaaacggtttcttgtaccggaatcacacctttcgcaaaagattgtcaactcttttttgcatctagttttttgaacttaatttaattttatgttcaattatttttgattttaaaattgatgttctataatttttttttaatttaatttttttttaattcgttgacggcgtgttttctcggttaacacattatacatagaaattattaattgggtaaaataatgattttctctttgatccctgttgttatagttactattggttatcatttttatacttttttcggttttattagttcggatattatgctttgttacacagtatatttaataaagaatttgggaaaaacataaaatgtgagattatcgattgctttattaaataattcttagtaattatcttttttttcaagaacaaagtcttcagcttgtacactcgccgcaaactcagatggttgattctttcactgaaaaatttgtgttgcttgttatgtcaagtatattgtca

SEQ ID NO: 44966 - DNA, 609 bp, Heterodera glycines
  misc_feature (27)..(27): n is a, c, g, or t
aaatttttcagaattttaacgaatttntgttaaaaaatagtcaaatttttcgacatttcctcttttcccctttgctagcctcccgcccccaccccctttatgtatgttaataatactacaaattaccaagaataagtcagattaaatcgaaatttgggtagccttttaataaaaatagaaaaaaaaattcattttataaaaaataacttacaagaaatcgtctcgaaaaatattctaaaaaagccagttacggatcaaaattacggaaaaatccgtaacccgtaatccgtaactccaaaaaggccgtaatttccgtaatccgtaatacgtaatccgtaattacgtccagccctgggggggaaccaaccttcaaaaaaactgaaaaaaaatctccgaaaaattgaattaattggttgtcgtcaaaagggtataagatgattgtgggtgggggacattatagtctggccggatagtctgagccaagtttaaagcatcataacttttttctcagctggccaaattttataaggttggcatcattcgaaagctctacatgtttagaagcttttgataaactaatttctaaccgattgaacagcttataaaaaa

SEQ ID NO: 44967 - DNA, 990 bp, Heterodera glycines
tagtcagagaaattgagaaaattagtgatgaaagaaatgaaaatgcagggtgtgagacgaaaggagagagacaaagagagaagagggatataaagacagagagtgaggagagagacaatgagagagaaaaagaggagagagacaaaacagagagtgaggagagagacaatgggagaagtggcatagagacaaagagagagacaaagagagaagagggagacaaagacagagagagaggaaagagacaaatagagagaaaaagagaagagagacaaagacagagaggaaaacgagaggagtgcggcatggtgggacgcgactgcgatcgcggtattttgttttgcgaggcgtgccgagaattttttgggagaaaatttatttaaaacatttattgaagcgattgtctttttgaatacctattcaaatttgggactgggtcgttttggcgccgacgttttggcgccaacccaagttttcggactataacttttttcattgttgaccaaatctaacaatattggtatcattcgaaagcccttctcaagctctattagccttacaaaaaacaaaaaaagtttggcttgtaaaaaagataataagaaaaaacttccaaaattttgtttttttttgtaatttcatgttataacttttttgataattgtctaatcgcgaaacaatagcttagaaatagcttctaaacacgttaagctttcgaatgataccaagaatgttaaatttggttaacaattaaaaaagttatagtccgaaaacttgggctggcgccaaaacgtcggcgccaaaacgaccccgaccctcaaatttaaaccatttttttttaaatttaggttatttttctcaaaaaacgtttcaaattccaattttttcccatcggagctaagaaaatctttaatttttctttaaaaaaattgactctaaatcacaaaataggtcattttatacaaaatcttttaccaaattgcactcaaattt

SEQ ID NO: 44968 - DNA, 983 bp, Heterodera glycines
atttttaatttgaaaaaacagaatgccaagaattaaaattttttaattttgagaaaacagaatgccaagatttaaaataatttttaaattggaaaaaacagaatgccaataattaaaataattttaaatttgcaaaaacagaatgccaagaattaaaataattttaaatttgaaaaaacagaatgccaagaattaaaataatttttaaatttgagaaaacagaatgccaagaattaaaataatttttaaatttgaaaaaacagaatgccaagaattaaaataatttttaaatttgagaaaacagaatgccaagaattaaaataatttttaaatttgagaaaacagaatgccaataattaaaatattttaaattagagaaaacagaataccaagaattaaaataatttttaaatttgagaaaacagaatgccaagaattaaaataatttttaaatttgaaaaaacagaatgccaagaattaaaatattttaaatttgagaaaacagaatgccaagaattaaaataatttttaaatttgagaaaacagaatgccaataattaaaatatttttaaatttgcaaaaacagaatgccaataattaaaatatttttaaatttgagaaaacagaatgccaagaattaaaataatttttaaatttgaaaaaacagaatgccaagaattaaaataatttttaaatttgagaaaacagaatgccaagaattaaaataatttttaaatttgaaaaaacagaatgccaagaattaaaataatttttaaatttgagaaaacagaatgccaataattaaaatattttaaattagagaaaacagaataccaagaattaaaataatttttaaatttgagaaaacagaatgccaagaattaaaataatttttaaatttgaaaaaacagaatgccaagaattaaaatattttaaatttgagaaaacagaatgccaagaattaaaataatttttaaatttga

SEQ ID NO: 44969 - DNA, 866 bp, Heterodera glycines
tagggagggcgggtgcgcaatagcccttttatttttgagggaattttttaaatttatactctatcccagaaaaatggctatctcttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacacatacaaatgctctcgagcatgatagggagggcggtgcgcaatagaccttttatttttgagggaatttttaaatttatactctatcccagaaaaatgtcaatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaattttttaaatttatactctatcccagaaaaatgtctatctctttttttgagaaattttata

SEQ ID NO: 44970 - DNA, 1179 bp, Heterodera glycines
  misc_feature (158)..(158): n is a, c, g, or t
  misc_feature (166)..(166): n is a, c, g, or t
  misc_feature (184)..(184): n is a, c, g, or t
  misc_feature (190)..(192): n is a, c, g, or t
  misc_feature (204)..(204): n is a, c, g, or t
  misc_feature (214)..(214): n is a, c, g, or t
  misc_feature (219)..(219): n is a, c, g, or t
  misc_feature (229)..(229): n is a, c, g, or t
  misc_feature (246)..(246): n is a, c, g, or t
  misc_feature (253)..(253): n is a, c, g, or t
  misc_feature (255)..(255): n is a, c, g, or t
  misc_feature (258)..(258): n is a, c, g, or t
  misc_feature (278)..(279): n is a, c, g, or t
  misc_feature (290)..(290): n is a, c, g, or t
  misc_feature (296)..(297): n is a, c, g, or t
  misc_feature (311)..(311): n is a, c, g, or t
  misc_feature (316)..(316): n is a, c, g, or t
  misc_feature (318)..(318): n is a, c, g, or t
  misc_feature (329)..(329): n is a, c, g, or t
  misc_feature (332)..(333): n is a, c, g, or t
  misc_feature (349)..(349): n is a, c, g, or t
  misc_feature (455)..(455): n is a, c, g, or t
  misc_feature (561)..(561): n is a, c, g, or t
  misc_feature (711)..(711): n is a, c, g, or t
  misc_feature (808)..(808): n is a, c, g, or t
  misc_feature (867)..(867): n is a, c, g, or t
  misc_feature (875)..(875): n is a, c, g, or t
  misc_feature (882)..(882): n is a, c, g, or t
  misc_feature (891)..(892): n is a, c, g, or t
  misc_feature (894)..(894): n is a, c, g, or t
  misc_feature (898)..(898): n is a, c, g, or t
  misc_feature (907)..(909): n is a, c, g, or t
  misc_feature (925)..(925): n is a, c, g, or t
  misc_feature (942)..(942): n is a, c, g, or t
  misc_feature (944)..(944): n is a, c, g, or t
  misc_feature (947)..(947): n is a, c, g, or t
  misc_feature (955)..(955): n is a, c, g, or t
  misc_feature (968)..(968): n is a, c, g, or t
  misc_feature (974)..(974): n is a, c, g, or t
  misc_feature (986)..(986): n is a, c, g, or t
  misc_feature (1002)..(1002): n is a, c, g, or t
  misc_feature (1011)..(1011): n is a, c, g, or t
  misc_feature (1017)..(1019): n is a, c, g, or t
  misc_feature (1031)..(1031): n is a, c, g, or t
  misc_feature (1036)..(1036): n is a, c, g, or t
  misc_feature (1039)..(1039): n is a, c, g, or t
  misc_feature (1041)..(1041): n is a, c, g, or t
  misc_feature (1046)..(1046): n is a, c, g, or t
  misc_feature (1053)..(1056): n is a, c, g, or t
  misc_feature (1058)..(1058): n is a, c, g, or t
  misc_feature (1062)..(1062): n is a, c, g, or t
  misc_feature (1071)..(1073): n is a, c, g, or t
  misc_feature (1078)..(1078): n is a, c, g, or t
  misc_feature (1089)..(1089): n is a, c, g, or t
  misc_feature (1093)..(1093): n is a, c, g, or t
  misc_feature (1106)..(1106): n is a, c, g, or t
  misc_feature (1108)..(1108): n is a, c, g, or t
  misc_feature (1111)..(1112): n is a, c, g, or t
  misc_feature (1119)..(1119): n is a, c, g, or t
  misc_feature (1132)..(1132): n is a, c, g, or t
  misc_feature (1136)..(1136): n is a, c, g, or t
  misc_feature (1138)..(1138): n is a, c, g, or t
  misc_feature (1149)..(1150): n is a, c, g, or t
  misc_feature (1157)..(1157): n is a, c, g, or t
  misc_feature (1163)..(1163): n is a, c, g, or t
  misc_feature (1166)..(1167): n is a, c, g, or t
  misc_feature (1175)..(1175): n is a, c, g, or t
aaaaaaatctatttttttttttttccacacatcccccccaaaccaattcccccatatttatataaaccccaaatccttcataattatcttccctataccctttactttaattctactttcattttttcctccccataattatttaattcccccaaacncacacttnaaaaaatctatttttttnttttcnnnccaatccccccnaacccatccncccanatttaattcnatcactcatattttttnctaattnancanaatcctcccaaactttccannaatactccccnttaaannactaacttacactnaaatnanctcccacctanctnnctcaaaaaaattttcnaaaatctcactctttcttttttatttattttttccaaaattaattcttaaatattttttcaaaaaaaattctaaaacccaccaaattttatttacatttattttanacactctaatcctttttctatcaaaaacccccatcaataaaatttttaaaaatttttaattcctttttaaacaaaccaaaaaatttatccttaacttttttttcanaaactcatcacaatcccaccaaactttccacctttacataaactaatacaaataacctattttaaatattatctacgcttgtcatttaaataatttttatccaaaaaattttttttttttttttctcatcactccccctcaacccatacncccacatttatatcaatacccaatccttccccaatatcttcactatatcctctactttaattctccattttattttttctccccataatttttttantaccccaaacacacactttaaaaaatctatttatttttcttttcatcacattccccccnaacctatncacccanatttataannanaccnaatccttcnnnaataacttccctatancctatactttaattctncnttnaatttttnctccccataattntttaantaccccaaactnacacttaaaaaaatcnatttttttnttttcnnnccactccccccnaaccnatncncccanatttatnnnnanaccnaatccttcnnnaatancttccctatancctntactttaattctncnttnnatttttnctccccataattntttnantaccccaaacnnacacttnaaaaantcnntttttttntttt

SEQ ID NO: 44971 - DNA, 1256 bp, Heterodera glycines
tatgtatgttaataatactacaaattaccaagaataagtcagattaaatcgaaatatgagtagccttttaataaaaatagaaaaaaattcattttataaaaaataatctcgcaagaaatcgtctcgaaaaataatctaaaaagccagttacggaccaaattacggaaaatcccaaaaatccgtaacccgtaatccgtaatccgtaactcaaaaaaggccgtaatttccgtaatacgtaatccgtaattacgtccagccctgaagcaaatgggaacttttccttcactttttttaatgattttttcataatgatataaagaaaaaataatatttttaaataaaattttgtaatttttcaatttcctttcctttaattatgccattatcaaagacttaagaaatgttttttatgaatctcatcttgctaaattttgttttaattatggttctaattaatttgcctttgtaataattctgaaaagcattttcaaaatttatttggtgccaaatttattattttaccttctttacgcaatatgaattttacttgaaattggtttatcaaaaaatagaaaattttttatttgcctgtaaaatttaaaaaattcatcacgataaaaaaaagttaaatatatttttgaaatttttttgctcatatttttctagaattgaaaaatttgtagttatgataattaatctcttttagcactttttttcaatttaaattttcttagccaaaatagaataaaactgcattctgctccattttgttggaaaatattttcatttttggcattataacaattataaccaaaattttatttttacttgggttttattatttttatttaatccatattttgtttattttttcatttttagtcttttggcaatccttaatgttttattaggttttgttttgatcatagctcgtaactgaacaaattcaagtgaatttattttttattatttacttttatttaacaatgtacattgtgactgtctaaggaatgattgatttccttataattttttttaattttaaaattcaattttggtttaaagtctcttttttaatattttataatagacactcctggtacgatgttatccaatgttaccgaggcaatcgttggtcagatcaaatagcacaacgtaatcagtaaaaggtaacgaattttttttttttaatttataacattttctggtaaattatttttatttttaaatttatgtctcatgaactatatttaatt

SEQ ID NO: 44972 - DNA, 1247 bp, Heterodera glycines
ttttgcccgaattatttgacaaaagaaggcggtgaaataacgaaaatgccgctaatttcgccttttgtgttatttaatattttaattttaatgggatttaaattagttagagaaaatatattttttcatttttttgtttgcgattttcagcttggatttggaattttttcataatctgctgaaattaccgtccatttttatgtgcaataattaggcgaattattgccccaattagtgataccaaccatttttttcataattggttttcaactttcttttcaatctttgcgttttccatcgtttcggggaattttgacaaatatcgcacttttaatggcgcataaattgagaatatcgaactggtgcaattcagcaaagaaaacagctggggtcacatagaaatttcaaattttaacgatttgattgaatttggccatccgtccattttatgttcattttctgtccattcccgtaaagccgggccccgtgaaagaatcgaacgatcgcttctcaaatccgttgaagccatagcctgaaaaaaagaaaacataaatcaaatataatcaaagggttgtcctttttaccatcaaacggttcaaatcgcttgtcaagtccggtgaagccaggcccagtgaacgagtcgaacgcgcgtttgtcgtaattggtgaagccggtgtcgaaagcggcccgcttgtccagcccagtgaagccggggccagtgaaggaatcgaaagatcgcttgtcaaagccgggatttagcttaaaatggggacaaatagttttttcaattaaattataattaatttgagttttcctttttttattgttttacaacacttacataagcattgaatggctgcttttctgctgggtgttgttgttggttttgcggttttggtgctggggccgaaagcgtcgactgaaattatttaaagaatgaaattaatttattttttaatttttaattaccgtaataaaaactaagccgaaaagaacggcggaggtggagaaaatttgttggaaggacattttgtgactttcaaagaacgattaaacacggaattattgcgaattgtctaaaagaaatttaagtaatttgccaattcattctgagatagagaagaagaagttccaaatatttctaagaagtgtttttaatgggttttgattattaattttcatcgcttttctttcttttggcctcttacgtgcgtggcgtccccaaacaaaggcaattaggcgccaat

SEQ ID NO: 44973 - DNA, 1598 bp, Heterodera glycines
gcgcaaagtgaaccaattttttcaaggttaaaatatttgaggaatcttcagcttttggtattcgttctaattgatcaaatttataattcaaaaacaagaacactcgagaagaaactaagcttggtcgggaccacaggaattcccgtatttttagatccccggtttttgaaaaaaaaattaaagcttaagtacgaatcataaatttttatcttaataaaaacatgttaacaaaaatttcaagggtgacaacgaagaatatggtagttttatctgtttatactgtatctatctatatgtgtctcagcttactgtacgtcaatttatctaacagttcgtctctcttctgctgtttttgttttcttttcagccgtagtaatagctgtaatgacatgaaaaagacagaattaagcaaaataagtttaagtatgagctttgaattgaaaatgaaaggagccaacggaaatttatttattttgaaaagcgtacgaaagcgcaaaagggcggcataatgaaagtgatttgagagcagacaaattgagagactttttatagtagcgccaagccagacaaatgccataccttccaaacacaccaaaatgacacaacatcaaaaaaatagactcttcagctattttaccataaacaatgtattaattaattaattattaataattcaaaacaccgcagccaaactcaaattatgaccggaagtgacacacataacaaattcagaaaacctaattttgcacaattgctttcaaatttaattaattagggaagaatttagtgattcataaatcattcaaaccattaaatttaattagtgtattttaattggggaatatgtctaaaccaaattaccacatcaaaacatcaattcatttttatgacggaaatgacgcaacaaattcttaagtaattatatttttattaagatattttaaattttagaaaagaataataattacaaagaaaaataaattaaaattttaacagcaactttttttttacattattcgtttttgaattcatctttttagtcgaagaattaagttaaattacaaaaaataataataatacatctttaaaactattttatggtttagtttttaatttagcatttaacataaacattcatttaaacaaatcatgtgcttatgactaactcggattggcataacacttgaattggcatttctttcttatttatgaaagaatgaaaaaattgtgcatatgacaccaaagaaattataaatgtcaaaaaatatggccatataaattgcgattaatgcttttgggttttcaaaataaattttcaaaaataattttccgcttttaataatttcaaataattttccgcttttaataatttcaaataattttccgcttttaataatttcaaataattttccgctttttccaaatgttccatttgcgtttcgttgtgcttcttctgctggtaattgtcggccttttcattggccccaattttgtttctgctgattgtgataaaaaggtggccggttgggacgacaagaaagtgaacaaaggctgagaggaagccgaagcaccgctcaacatcccgtgcccgtcgtcag

SEQ ID NO: 44974 - DNA, 1151 bp, Heterodera glycines
  misc_feature (1139)..(1139): n is a, c, g, or t
aataaataaaaatataaaagaaatccgacaaaaaataaataaaataaaatgaataaaacagttttcttaatactttttggtttggcaatcggccaagcaaatgctaattgttgttgtctatctaatgaagaaaaacagcaattgaatgctgcgagaaaaaccattgaaaaagcatttcgggatacgctcagattaaatactgaagcccgagatttcgcggctgcatctcatagggcaattacggaggcagaaaaaattaaagttcgtcatcccgaggcaccgggcatgaaaacatggttcggtaggttattggaaggggtgagaaaagtacaaggaatttctgaaaaaataaatgaagaaaggcagaaaatagaccatattagaaaagaaatggacaagtgtttgaaccgaaaagatgtgttaatgtgtcgagaattggctgacgaagcgaagggggcatttgaaattgttaagcagtataggttggatgccggtactgcgtaccgtaacgcctatactcagtctgacctcgggatcggggaattggccgaaaaggtaaaggaaacaatgaaagaatatttgtcccgaccggggctatcctcaagaccaacatttaatgatgagtttatatctgcttaagggtataaaagagaacggaaaaaaataaataataaattttttaaaatgattcaaagaacagaaaaaggaacagcaattttgatggaagcctcaaaaaaagaggcagaaagggtgtggaaggaagtttcggtattagcagaggaagccgatgagtatgtcaaatctgcccgtggagcccttaatcgggcaattaaatcccgagaaaaagccccctatgccccgggggttcgagatttgttcgtaaagatctcagattgtatctgggaaagttacaccattttagataaaattacttccgagtctgaaagggtagaatctatttggcgtgagtccgaacgttctaaagatttcgatcagaccaaaaaactagaggagaaattacttaagggtttgagtgaagttagaaagctacacttagaatctcgcaggattcacacaaaaattttggagctggaaaataaagttcagtctgtagtgtgggattttattgaacttcccanaataaaatagaa

SEQ ID NO: 44975 - DNA, 1132 bp, Heterodera glycines
  misc_feature (37)..(37): n is a, c, g, or t
  misc_feature (88)..(88): n is a, c, g, or t
gcaattgtttttgttgcgcttttgaacacaaaagtancattgttgttttcggtgccagtgctaattattctcctaattaagttggctnttcttagaacaacgaaccaaatggacgattcagctttattcatttaaatgtgtaaaattaaataattgaataaaataaaattgaaattaatatgccaaatttccaagttttttggcaaatttcgattaattccgttttcaaatgcattttgctcatttcttgtttatttcactttttacttaatgatatgtggaggtgtgccgtgactgaaaaatcccgtgaatcgtgaccgtgaccgttaatttttgagtttaatttttctctggtgctgaatttttttgcgttttttggggaacagggggtccagtgcgccaataggcgcatgaattttgtgcacagattttaaccaaaaaatggccaaattttgcaaatttgagccattaaaataattggcttaattagaagtgcgtaaaatttgtaaaattcgaatttttagaagataagcattgaatgctatagtaacatgtaaaacattggagaggttttattattttagtttttaaaaaaatttgatcacacataacttatcattaactgatcagaagctcacaaaactttggaggaaaaaaacatcagaattcatgagcaattttcaaaaaataaacattataatgctatagtaacatgcaaaaaccaaaccttattcgttttatatatatatttcgaattttccattatttttcaatttttttgcggttaactattgattgcaaattgcacataaaagggtgatttcagccttacaaatcacaattttttaacaaatccaagcatcctttagctataatagcttcttttctttaatttctttttttaaataatattctttatataatggaaaatgcggataggcgccgccggaaaattttgaaaatttgattgtgaagtgttaacagattttcaccaaaaaaagacaaaatttttgcgattttggtcaatttgttaagaaaaattgtgcgttattttttggggttgggcggtgccattggcgctgccgggagaaaaattataacttttgacccttttaaacagattttcattgaa

SEQ ID NO: 44976 - DNA, 889 bp, Heterodera glycines
  misc_feature (790)..(790): n is a, c, g, or t
ttccttatatttggttatatcgttttgcttttggtggcttcgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggggcgaaattgggaaaagttgaattttcgactaattttggcagttcgacttcgggattcgaaattggtcgaatgaatgaaaatttctaaaatattctaaattagaagaatcaggccataaaaagcgaaatttgcgaaattgaaaaatgcgaaatgaaaaaaaaatgcgaaatgcgaatagccaaaatatgcgaaaagcgaaattcgaaatttttttcaaaaattttaccaatagtctaagtcatatattaagaggttgtgatatgaaaaccacaaaatttctgtatttccggtttaatcattttctcagaccacaaaaaatgacaaatctacccattttgggcttaaaatttcaaaaaacaaggtaaaatgagggttcggcggtggcgacatgcgccgccggaaatttttttggaaattgtaataaatatgatagttcagggctcggatcgtaccaagtcattttccaagtacatacggnggaatttttaacatccaagtatacataaaattttgatagaattgatagatggttttttgcttttcaaaacgatttttttgcggccttgtttcaaaaaaa

SEQ ID NO: 44977 - DNA, 710 bp, Heterodera glycines
taaaaattaccagctattggagatgcagtgggcaagcacagcgagtcgcttaaatgcacccccttcaacacgtaaaatattccaaaaaaagagatagtgattttttttggattaggccggagaaataaaaattcccaggttatttgaaatgcagtgggcaagcacacagagtctcttaaatacacgccctttttcacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggacaaataaaaattaccagctatttgaaatgcagtgggcaagcacataaaggagcttaaatgcacaccctttgacacgtaaaatattc

SEQ ID NO: 44978 - DNA, 1431 bp, Heterodera glycines
aattttatttatcaatgaccaacaaatgcgtctcatccctcacccccgggaccgccaaaaatggaattttcacgattttttaaatttatgagtcggactatcagtggtcgtcgtcccattttgcgcaccattcctcacttttggactcgtcactgatccgcactttcttcaacaccatttgggcaccgtccgccacccttttgcacagaaagcatttgccaaacgaaccgctgccaatctgtgaaagcattgtgaattgactgtgcgatgggttgctcatcgaggaacatggccaaacgcattcaaatgcatgtgttgtgaaatatcaaaattatgtgtttgtaaatgtgcaaaaagaaaagtgaatgtaagaaaattgttgaaaatgctatattaaacaagaattgtggatagataacaaagtttcagtttgataatatgttcaaagttcgatatcctcgtgagtttacgtttcagggtcaaataaactaatgcaaaaaagctttgtaattgttttttcctgctatgtacaaccccatcactgctttttaataaatcacaagctcctctcttccctcttaaaaaggcaataaataagcgtttagcacttccgaatggtctttgaactctcgtgcaaagaaaacagtcagcgagtgagaacaaatccacaaatatttccaaaaatagttcaataaaaaatgcatgggattttgcttttcctcaacagatttccagcttttttggaacaaaaagtcattccatggtccaaaattagaattaaatcagagttcccaagttttttttttcaaaataggacaaaatggcctaaaaactaagattctgaccccaaaaataagatttttctaaaactaatatttgcgtgaaggaaacgcaataaaaacatgaaaaattgacttaaaacaatattttattagcgtaaaaacaattaaaattgatcatcaaaagtattttccccatccgccgattttctccaacaatttgtgattggaaatgagcatttggtacatttgtgggcaagaaagatcataattgactttggtttggaccaacgccttgactgttcgttcgacttgcaaaagatttcgtttatcagtccattgcgatccgcacaaagagaataccctcgcaacaaatgcatttgagacaggcacggaaagtacgacgctgaccagcttgagcagattaggcaaatctgcttcaaacagcttcttccacttctgttcgggggttaatttttgaaattcatcatttgggaaagaattcaatatttggtttgcttcgctaacatcgtcaaacaaatcatttgttaactagggcgcaatttgtcgagccagagccaatgcatcgtcgtggggaatttgcggtatgccagcgcaacccattgcaacttttccggaaatcgggcaatgc

SEQ ID NO: 44979 - DNA, 1399 bp, Heterodera glycines
agtttcccccccccccccccccctgggcacccaaaaaagtgttgcctcataaacagcaaatccgatggctaaattctcgacgccggtgttcttcaactcgcgtcgatacttttgcatcaccgcgatgattacggtgcacagtttgtcgtcgtcgttggggtccgagtcggtcaatttcatgcggaactgcggattcagcgcaaaagtgccttaaaagcgatataagagtcaattaacccaaaagaaacgtacgcaaattgttgcggcatccgccggccgttcgccccgcacgccacgagccgtcgtgggcgacggtggcccacgcgttgtgcggagtcgccttgacgccggtcatttcgtaaatctcctccataacttcgggccccaaattgcaaatttccatcttttcaaaattggacaaaaagtcgctgaaggacatccttaaaaggaacccaaaacaaaatgagtgaaatggaaaaattgaccaaccaaaattcgccgtcgtgggcaaatgtgaggccccatgtccgttttgagttcgttggacaactgtcgccactccgacgaattgtccgaccagggcccgttccattcctggtcgttgccccaagggttgcgaattcgcaacaacggcacttcgccccgcggggtcggcacaattcgcatgccggtgattgagtaggcgtggccctgaaaacaaaaagggagaacccggtaaatttctcattctgcgcttttcgcactttgaccaatccgttgggcagtcgcgcctcccaaacttgggggtccgcttcgatggaacagccgaacagagagcccatctcaaagccacgggccatcatctgcagaggggagggattttgcgataaattgggacgacgccaaaaggattattgacttggaaaatgcaattagcgacggaatttcggaattaaactccgtgaggtcgaaattgaaagcaactatttaattctctgccaacaatttgtctccctttgttaaatccttttcccaattgcctcgcctgcatcaaattctccgatggctgctgcaagtcgaagaattcggtcagtccccccgtcatgtcctccaatgcttcgctggtcgtcccgcccttcagcgcttcgtacgagccgtacagcctgaagaggtcgaatgggaattcaaatttaaatgcgatttttgaaatacgaaaacatttctaaaaaaataatgcttttttccaattgtttcgcttactttgcgtatgctttttccaacaaagcgctccaaaattcgtttctaaaaccaaaaaacaatgaaattaaaaatgtttttgaaatgttattccaactgacagttcttgcgagtgcatgtaaagcaactcgccctccattgagcagggcaatcggtcgtcgat

SEQ ID NO: 44980 - DNA, 749 bp, Heterodera glycines
ggggatctctagagtcttgctcactgaaacaaaataacatttttgactgcccctcgtggcccattgttggcttcgcgtattgcaaggatacttccaggaaaattcaattagtccgtaattacggagggatcgagacaaaaagtcgtcgcaaattttttttcttagaaaaaaatcagaaaaaatattaatcttttagttaacctagcctagctaattcaaaattttttttattaagaaaatacaaagaaacgaaaaattttttgtttttcctggaattcagcaaaatttgtataaaaaaagctttaaaagcattttactaaaatttctgaaaagatttctatatttttcttttgcggcgacgtttggagggtagcaattgcggaggacctaaaaaacccgtaaccggtcacggcagggaccaaaaaggtcgtataattccgcaatccgtcgtcaccccaaactctgtcagagccctgctaacgctttccaaatcccatttttgcccatcatgctctgtgctcaccaaagcgcattgaaacgcaatccgaattcgtcagccatctgttgaaaagtctgtacacgttgcgatggtggaatggcgttgtggttgccacaaattggtggcacgccggtggcaattggcggagtcgttttggtggtggtggacgacgaagttggcactgcttttgctgtcggcgccgatttcgccgccgccacccttttcctcgtcgttctctccgtcgtgttgg

SEQ ID NO: 44981 - DNA, 1091 bp, Heterodera glycines
atgttagtttaggcactctgatgcttttctatcaataatggaggtgaataaaatttaatagctttttactttggaaaaagtttaggcttactttttagtgaaagtttgatcactcatattttttagtctatctactcaaaacgggtcagaatcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaagcatgatttcaaaattttcaattttttctagtctaatcta

SEQ ID NO: 44982 - DNA, 1167 bp, Heterodera glycines
  misc_feature (998)..(998): n is a, c, g, or t
  misc_feature (1063)..(1063): n is a, c, g, or t
  misc_feature (1141)..(1141): n is a, c, g, or t
ttattttaaaaaaacaaattaaaaattaaactgtgtaactctaacaaataagacaggtagcatgaaaacgcattacaacgtggtttgaggcttctagatgaagtttttcgtgcatgcttaattttactaggcttggttgcttaatgcttatttgttagcatttattatttatttttttatttttgctataattttctttaatttttgctttgtgaatttgttgccgcaattccattgtaatatttgttaattttttttctttggcactttttgaatttatttattttttttgtgtgtatgacattcaaaatattaatcattcaatttttttttacatttttgcttttgggatttaatgaataaattgtcttatcacattttatcagagcattgaaatttaatctcattcagaaaattttcattttagacaatttcataaaaagagcatcgaattaaattataaataaaatattttcataaaaaaaacaattattttccctccaaaaatgcaacaaaatcttcattttctttcattgacctaattgttttaaatgctaaaaattttgcattatttaaataataaaaaattgatttcttaaatattttaccattcaaaattcgtttttaatttttctcgcatcactcgcattgatcagattcataacattttgtcaggaaatatcggtgcaatgatttgcatttccacagaatttttttggtccaaattaatatattttttagtcaattcagcagaaattgtcgttgttgaccaactcaaaaattggtctgccattatatgtttaatgtcagtcaattgcaatggtaaaggccaattcctgcattttttgaaaatatcatttcatattcatagaaaattaataaatataaatatattcaaatttaaaaatggcaaataaatcaatagttttaaataaaccattagaaatattttaataatttatgttaaaaaattattcaataaaatattatttaattanatatatttttatccgattttttcaaataccaaattgaataaattaggaaaaacttttctaacaanaatggcacagaaacattgcccaggaatagcagaaacactttggtcagcattatgcaaatcacttgcgcattaaatggncaatattttcgtcaaaatattttttc

SEQ ID NO: 44983 - DNA, 701 bp, Heterodera glycines
  misc_feature (70)..(71): n is a, c, g, or t
  misc_feature (104)..(104): n is a, c, g, or t
  misc_feature (118)..(118): n is a, c, g, or t
taatcagcatctcaaaataccacagaaaaaaatttttcaccccccttttcaacccaaaaaaaatttcaannaattctaggggggcctagctcgaaatttttganaatttccgaacatntagtacaccattcgatagaacttaaaaagctctataattttgccctagggcaatttttggctagaaccaacccccgacgagttatgggcccgggactcaaatgtcccgcttaggccaaaaaatttttctatttcctggaaaaaatcgaaaattttctaaaaacatcactaatcgatagagctcaaaaaacgatgttttggaagtggtcttcgttttccctggaaaaatcgttaaaaaatcataaaattcaaaaacccgaaaaccgttttttaggcctagctcaaaaatttttgaaaattttcgaaattttaaaaactggaaaaatccagctcattgaactctacaataagtctgctggcaccccctcgctcagttcaaacccttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctctgaaagcaaaagcaaaaaatttcgtaacactgagactggcggcaaag

SEQ ID NO: 44984 - DNA, 157 bp, Heterodera glycines
cactttttggccactcttcaattaatgttggccaaattcagcagtttttctccattaaatgggctgttttttcgactctaaaatttaaaagtgcaaaattcgccctttctccgccctttcttttgcacaggaatttcccctctcactttggtcccat

SEQ ID NO: 44985 - DNA, 235 bp, Heterodera glycines
taatacgcgatccagtgctcgccccaacggcagtaatttttctttatttccctgcgcggcaataatttggttgatcagcgagtcgataaccgggctttgcacgccgggggcattataagtggaattgatatattccgatgaccaggaaatctgtaaatcggaactgggccacggcatcgcccgccatacgcgcggcatcatgtcatagtcgcgactgcgcatgcggttagtgatt

SEQ ID NO: 44986 - DNA, 850 bp, Heterodera glycines
  misc_feature (834)..(834): n is a, c, g, or t
atcgtattaaatgaaaaatatgccccggcgaaatatttcttaacagtttaactcaaaactcttaaaaaattataaaaatatatcaaaagccttataggggtaaaagaataaaatcttaagctacaaatgttgatgctaattcctcatcacttttctgtcgcgtaaatttgtcaaataattaccgctactgctaatccgctaatgttactaaaaatcgcattaaaaatggatgagcgaaagcaataattaattttatcattttaaccagagatcattgaaaatatatatcatacaaattatttcttctaacatgtttagtcgcgtaattatattctcattggttacatcaattaattaattatctcgtttcaccaaacttgtcgtggatgttgaagagagcatgtctgaaatgattttccattaacataaatgataaattcagattcaattttctaattgattataatttttacaaaacatatgtataataacattaagcaaaagcatagcaaataaatgaaaatgacaagggatagtaaaaagaaaagctgaaagattaccgaaatttttctgttttagtctttgctaaaatctaaaaattttcgaaatgaaaagccgaacaaagctttataattccaaagcgaaaataaaattagaaatggggcacaacaaacagacaaaattgcccaattaagcgaacccaatgaaacataacacaaaaatacacacactttgtgcttcactcgttctcctcattttggacgaggccggcagccgaagaagaaacagaagtgccattgaagacgaaactgtgctgcgcattcgggggattgngtcggaagtcaaaagt

SEQ ID NO: 44987 - DNA, 1214 bp, Heterodera glycines
  misc_feature (35)..(35): n is a, c, g, or t
  misc_feature (37)..(37): n is a, c, g, or t
  misc_feature (81)..(81): n is a, c, g, or t
tttagatttgtttcgtttcgattggttaatgttancntcatttttaattcatattcccatccggtccatctaattaatccncaaattgtgtttgatgttggttctgcgtaagttctataaaagaaacattccgatgatgggagtgcgcatttatgaccccaaattgcgtctccttttttacagaaattgtttcatggaaaattttcataatcttccatttctggaattttttcatccattttaatgtttttacatttactttttgtgcatgagcccattgttggacagcgtctttttgaaataacatttattttatatgaccgtaaccattttaaagtttgttggttacagtgtaatcgtaaaaattgtaaaattaattctaatgaacctattatttttcctttatcatcttttaatgctaatgaaactttttgtccagcgggtaatattgttaattcggttgttccactgactctacatacagaaccatttgattgtctttcacagtcttcggaagttgactgaattgatattacttcggcaccactgtgcactaaatcaggcattgtcaaacataaaaatagtaatattaaaatgcttccaagtctatatagtcttctgttttttcttttttgaattttttctttttctcttttttcaaattcatttaataaacttttctgtatctcatcgttaaattttttgtctaattttgggttcaagacccattttaacgccaaatatggcccataaaaacaaattttaataatccaccatatttttatgataaactttatgataaaacttgctatgcaaataataaaagaaataatacaagttaggccgattcctattagtatgagcgtttcggtcaacatgcattcgggatttgccaatttttctaggcaaaataaacatttaattaatttgcatatttctattggtgggcaaataattttattttctataagattttcctttctttgtccagtaatttacggaacaatagtgttctgtaatcaatatttctttgcttaattcaaataaataataatttctaaaagtcggggatcggcaatgaaccataacaacaaatttcaaatttatttatttttgggggggaatttaattccattcctttttgatccgaattaaattccacaacctttgctttttaatttgaatatgcttttccgttttggttattttccttt

SEQ ID NO: 44988 - DNA, 1101 bp, Heterodera glycines
cagaataactgggggagacttagggttagcgcatcaattatttttttcagaaagtggatcggggtacaaaaatacgggtccaaaagtgggtttaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaacgaggaaaatgaaacaaattcgcggctttgctctcgcgttggagaaagcaatgcgcagaataactggggagacttagggttagcgcatcaattatttttttcagaatgtgatcggggtacaaaaaatacgggtccaaaagtgggtgtaactccgcttggagatgcgttagaaaagaaagaaaaatatgttcagacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttaggggtagcgcatcaattatttttttcagaatgtgatcggggtacaaaaatacgggtccaaaagtgggtgtaactccgcttggagatgcgttagaaaagaaagaaaaatatgttcagacagcttttgaagagctgcattgaatgctgcagtcgccgctgctgtacgcccaccgttgctgaggtagggtcgagagcggatgaaaa

SEQ ID NO: 44989 - DNA, 697 bp, Heterodera glycines
agactttgtcaaggacgccgcgggcaaattgcacggcggccgtgcctactcggccacccatcgttttccgccccgcacgcgccacagcggcagatcgggtgagtgtacacaaaggggttgaccagacatgaaaaccggggaggggtcgaacaaatgcggggggggggggtgtaaaagagggtcgtcggcgaaaggggaaaaagggcaaaaactgaacaaatttttcaatttcataaaaatacaaaattttcccgtaggtgtctatcggcacagccggaccccagtccccctgttttccaatttttttttgaaaacacggtttgaaataccaaaaattgcgattcacatggcttgggaccccttcaaaaaatttcggttgaaccccccccccccccccttttttttttcttcatgtatggagcttggcacaaaaacgcgtttttatggcccaggaacagaaagagggcacttcatattggactgaatgcggcatccaattttcaattttaaacggaattttgcctattacaccccccccccccccaccaccactttttcaaaacatcattgcccccaatcgaaaataggtgccccctcgttgcccaccgttgtcagggggcatgccattgcgctccaacaacagcagcagcagccgcaccaccaaatggggccgcagcaccgcttcggcaccgccacc

SEQ ID NO: 44990 - DNA, 942 bp, Heterodera glycines
  misc_feature (728)..(728): n is a, c, g, or t
ttttgggcctacacctcaaaattttaaaaagtttcacattcaataatttaaacgcaaaaccgaaatggagaggccctttattgctactttaatttatgctatgtggtgaatggtacgcaattgtcacttaagcgctcccttttttgacatttttcaaaattttgaggtgtaagcccaaaacggaaaaatatcaacgaaactgctgattttcacataatttttcatctttgctaagccaattgaaatccgacgaaaactgcctaaatcattccctctcaataaaatgtctgacaaccgaaacgaagcggaggagaaaatggcgaaagcaatgtaaaattaaaacgccatttttaaaatttcaattttaaattttgttttccttttttttcagcttcatttccgccgattgttggctttgtgtgtacgatctgcttccggcttcacaacttggccttggaattgcgatgatcagccaccgttttgacttctacgtggatgaacacttcaagactcgtcgctggaatctgggatccatgaaaatcaaaatgaagttcgaagcggatggcaccaaggaaatggatgttgtcaatgccaatttggaatcgtttggaattgcgcaaaagccgttgccaaagagagtcgtcggattcaaagccatttcactgaagtgagattttgatggttttttgtttgtaaacacgatttcatcattttcacagatacttcanccaccaatgtgtcactttttccaccgctttcgtccaattctcgccgcccgtctcattcatttgaccatcgacaacacgtacttcgatgaccgcagtttggagtcgatttggcgcaacatttggcccatgatcgcgacaaaaattgtggcgtcaattgtccgaagaaagtttctaccgtttgcgcaaattcgtgccgtcaattctcgccgactgt

SEQ ID NO: 44991 - DNA, 1196 bp, Heterodera glycines
  misc_feature (289)..(289): n is a, c, g, or t
aaaatttttttgacccaggtagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggcctcccccccccccccctcccacgcccttcagagcacgacanatatttcaacaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgttacgcactcccttctcccaggggtattattttgtaaactcagaaggccccaataactttcaaaccccatttttcgcaccg

SEQ ID NO: 44992 - DNA, 585 bp, Heterodera glycines
atggcagttcgtacaatgggaaatttgcccgttataccatttgccgaaaaatcaagagaattgttacccctgattttggtaagttatataatcaatcggttcctctcaatgagagaagacgaatggtaccatttttatggcgcggcgacaacctgaacagagttacaggcccggtaccgaagtgtctaaattacatcgggactcaatcaaacaatagattttcatgacatatttatgtatcatttgatttaatttgcatattgagcagagtaaagggaatatattaacaggagataatgcctcgatgttgcacaattcttcggatattgtcctgcacgggcccctcctagcggctcagccatgtgcgaatttgtgaagccaacaaaacgacacttagctggaaaagattgggagtattatgtatggaactcgcggaatttcgaacaagaatttagaaatcttccttttttaaaaaacaccaatttggtttttacgggaagggtcccttttccgaaacgtaccaaagtatacgcactcacaatacccagcagcaaagtcctttcattggcattctgcgcattttgc

SEQ ID NO: 44993 - DNA, 1602 bp, Heterodera glycines
tataacttttttggtaattgtctgatcgcgaagcgatagcttagaaatagtttctaaacatgttaagatttcgaatgataacaacaatgttagatttggatgccaaataaaaaagtaatagcaaaaacatgcaaatttttgaatatctgcacccagatacatataggtaccaataaatgggaacaggtcgactcgccgacgcacgactctccgacggactaattttttattcgtaaatttttttatttttctatcaatttttataaaattaaggttattcggaagctttaagtgtttagaatctatcattaagcaaatgttaagcgattaaaaaattctccaaagagttagaaaataaaactcatgaaattcctgattttttctgttttttttttttgcataataaaaattataactctttggtcccccaaaaaatgggtgctaaagtaaattaagtgcatttgtattggtgttgttgcataaatgcaaattttggggaaaaaagccatttcgactcttttggttttactcgaggtgacggttcggagtcggcgaatacccaaaaatggcgctttaatgagacaagcaaaaagacaacgcattcattcgctcggttggtcggaaatgttccattttcaggaaatcactacatttatcataatgacagaacacaaatccatgttgatcagtccaacaaaaaagaaaacaatttctatgagcatgtcaataattccataattcaaattggtcgatcatttcttaacaaaacgttcattcacttctgttgatgatcactcgggccgggaatttcgtcgagaaggctaaaaaaagaaaaaacaaaaaatttgatttttgcttaatccttcattcactgacctaatcgccgatgtcatcctcaccagaaacactaatgtgaatttgattccactgatcacaaattcgccaataaatcgcttctttttcccattttgtccatttgctcgcgtctcgcgcaattggacaacggacgaacagaaaacgatggctattgttaatccttttcaatgccaattgttctcgagtcaattcattggtcagatcaaagggcacaacggaggaagcaaaaggcaaaggaaaccaaacggaaatgatgaaattgacgggggaacaagccgaggcaaaagcctaaaatatggggaaaattgattaattaattgctggtaagtaccgctttgaacgctgcaattctagacaccaaactcccatcattcatatccaacgcgcatttgaacacctttggcacattgtctggacggggagtgaaaagccattttgccactgcttgtccatccgatgccatggcattgtcatcgcatggaaattcgatgaagaaatcgtcaaaataatagacaatgcgaagtgatggacattggtttagaattgatgggacgaaatgtcgcaaacggcggaaaaatttggcggacaatcccaagccgatgaatgtttttgtcgaggattggccaaatgttgtacagaatgaactccaaaatgcggtcactgttcgagtggatgaccaaattaatagggcaggcggcgaaaagttggcgaaaacggtcgagaaaa

SEQ ID NO: 44994 - DNA, 1033 bp, Heterodera glycines
cccaagaaaatcagggaagcgaaaaaaaccgggaaattgtaacaattcaaaaaatttaaaaatctaaaaaaaaattccaattttaatttatatcaagtgaaaataatccaaaattatttggttttttatttaataattaatgaaaattttcaaacaaattttcttcaattatttcaaacaattaatcatttttggactaaatcatcgaatattaatagaaattcagatttgattttcacctcggatgaccgggaattcccggcccggtcccggtcccggtacccgtgtcactctaataaaaaagcaagagatttatggaaaattgataattttctcaaaaaaaattcaattaaattccaattttttcccagtcgtatccgaccaaaacctttaattttctttagaaaatgattctaaataacaaaataggtcatttttagacaaaatttttagcaagttgcactcaaattttcaaaattttcccggcgccgcctatcggcacggccagccttctctacaccttgttccccaaaagtttattagaaagagcgcgccgagaaaaagcgattgaaacgcaaaaaaatcaccgggtttgcatgactggaatcccttcgcaaagttccaccccccattcagtcccgtcccaaattttgtatgcatcgggattttaattaatttttatataagaaaattaaaaaaaaagttttttgaaaaatggtttaaaaaattttaaaaagacttaaattttttgaacaaatttcaaaaatttaaaaaataacattgattaaaagtgatctatacaaagtatattaataatatcatattcaacaaaattttgtataaattattaatatagtaaaattttaattgtaatttaacaaaatttaggtttatttattaaattttattatgatataatatgacattaatataaacttaggaaagaaatatttaagtataatatattaggtttaaattgcaataattaaaataatataaagttttaattcataattgtatagacatattaata

SEQ ID NO: 44995 - DNA, 1181 bp, Heterodera glycines
aggcctagattcgtgccagggcctcagaaaaaataggcgataataatttacaccattgcgttttgatcgagtgagaagtgttattctttgcaaagtaagtagcacaattcatttaactcaagtagttcgtacgtctagtcttattgtaagcagaaattctcgaatttgtttgtatcgagacacaataatttttattttacaaattatatacaataaattgttaaatagaatcacatagcatttataacaaatcgaaacacaatctttaggggtcgtattggtctttgggactgtgccttttcaaattgtcgcctttccacctgtccctgttgttgtgtgattgttttgttttccgtccgaattccgctgtttttgtgttcgcgaattaactcaatcaaaagttgctgatcggacaatgctttgaacggatggctcatgatcagatttgtgttgaaattaaggtcgttttgtgttttgcgcacaatcaacatgtaagcctggcttttcgcatcggagttttcttgcaaattattcttgaagtctcgaataagatactcaatgttgcgcattgggtccatccaaaggcgtaattcctcacgttcctcttcaactttcataaactccacatggtacttaaaattttgtaagaaaagaacaaaatcaatgttaaaatcatgcaaggaatattgtgacatgtagagcatggtattgcttttgtaaatttccggcctttttggccctgacacccaaacctatcagaaaaaatcgataaaataaaactaccagcgaaaatatgcaatttagtacgattttcataggaatgatatttagtgcccaaaattaacaaaaattcattaaaaacggaaaatacacccctgagaaacgacccgaaaagttttaaaaagcatccctaagaatcacaatttctcaaaaatggatctccaaaattcatttataaattgtttatctcaatactgctttggcttaattttgttactctgaaaaatttgtaattttataccctaaattttaggcttttcagagcctattttctttattgcctattttttgggattttttagagtataaaatatcattacctacttatgagtttttaaaatctgaccaatcttattgatttttcgaaactttgataatttttttttcgatcattttggggg

SEQ ID NO: 44996 - DNA, 1026 bp, Heterodera glycines
acgtggttcaagcgcagcagcagcagcagcaatgtcatcagtttttggcacttgaccacgacaatgacgatcagcttttgaaccaaatttttttggtagcaaaattaaaaaaataaccagcaattgacatgccaattacaggatctcaccacttccgctgaaatgcaacctatcgccttggataacaacaacagcaacaataatatggtagcaagaatttttggtttgtttatttgtctaatattccattttgttttagaatccacaaatttcttcgtcagcatcttcatctcgtcgccgaaacaatgccaatgccggacgtggccgaggaagaggaggaggaaccagacgcagagcggtgagacgattgaatgaatgaagattaaaaaaaatcattttgtgaattattattattatttgtttcattttaaaataaagaatgctcgtcaacagacccaaagcgaacgaattcagtcgtcccaaccccaaacggtccaaatactttctccatcagtggttcaacatggccaaggtttaacacgtgaacaatgcgatagtatacttcccaatctggaagtgaacgaggcaatggtccgaaatgatgagcgatgtgttatttgccaaatcggatttgacttggggtcattgaatgctaccgaactcccatgtaaacatctttatcatttgtcatgcgctagagattggcttatgcaccaaaatcgttgtgccatttgtatgcgccgttttgtgcttgactctgatgcttaaatcaatttgtcttatgcaaaaataataataattacataaaggagtgcacattatttatttaaaaaattcatgtcaaaaatattaataattcaatgacaaatcattatttgatgagacttttttgcaaaatagttttgtgttatatatgaaaaataagatgagagcgaatgggagcgccgtagcatagtggttaacgcttttgattaaatgctttggggttctaatccgcacggcgctcccaatgggtaggaattaaca

SEQ ID NO: 44997 - DNA, 694 bp, Heterodera glycines
  misc_feature (16)..(16): n is a, c, g, or t
atgaaaaaaataaatntcattgatttaaaatattttaatcatcacatataaattaattctatctgtatagtgaattgagaatcgagctcaatttagcaatttctttttgatttgttaccttatacaaacatcaaattcttaaaaaatgtcaacaatcggagtagatgaaatattcaaactgtcgcaaaaagaccatcaggttttcttcctctgaatcaaaaaaatccttcaaaattttttagcctcccgaaaaaaggagcaaactcagcgatggatcaacacaaattgtgccgtcggttgcggcagcaaaaaatggaggcgacattttggaagcattagaaaagtcggaagacacttcagaactcaacgaaattgacgaagcgtcggtgaagcggatttgttttcaggttcagtgaaataatgacaaattgacagcgaaagtgattttagttggagagaaaacaggggaaaaatgcggaattgcgcataaaatacgcggaagagcctccgaaatttatggagtcggaaattgaattgaacaacgcaattcaggcaattacaagacaaaattgggctcttatatggtttgtcccccatgaattttttgaaaaaattataattaataaagagtcgggtagaacaccttttcttatgttttagtggtcgctgatcacgaatccggcatccatttcga

SEQ ID NO: 44998 - DNA, 1725 bp, Heterodera glycines
  misc_feature (1684)..(1685): n is a, c, g, or t
aattatgataattacatacacgttcctttccgcccatgctctcagatttgatttcaatttgaatcgcatccatttgtttgtttttgagaattaaatgttccacttcgagcgtaaattgtttgtacttttcatccggttttgttttaacatgatattgcccatcttggcatgctttgtcaatgcagcgaattgtaattttaaattccgtccttacaaatagaaaaaatacaaaatgctgttaaattgccatagtaccccagcaccttaaggaattgggcctgatttttccgggatccgtaagtggctgaatttttttattgacacattttcaaaattttactcaaaaattccgtttagtgacggttggcgccagcaattggcgataaaatttgaatagaatttgtatcatgactgagatgtagtccactcggtcaagtggactacatacataccaggggtgggacaactctaatctctctccaacttttaccatttttgggactttcgcctctcgcctcttacctctcgttttttgggacaagaggcgagtggtgaaaatgcaccccctaaagattgaacctttgagcagtcagaaaaatattaaaatttacgcgaaaaaacaccataataattctccttctctgcttcctctatgttttaaaatcagagcacaattataatttatttttgcaaaaattgtgactacaaaacaaatttttcttccaaaacccaaatgacaacattggccacacattttaagcacaaacactcagaacaatacaaggaattttcagacaaatcgggggcagcaaatgagcagcaacagactttgggcaaaaacggtcaacagaacagagtacaaaacggcattatttttacttttagagctttttcctcttctgcaggagcatcgacatcgtcgaattttgatttaactgtcgatgaggaaattgaagacgatttatcaacgggcttcagccgaagtaccatattcaagtcgaaagttcttcaccgagaagatgtttcataggccatttgggatggaatgagaaatctgacttcggacacagaaatgaaggacattctctcgccaattgtcgtgatttttggtactctcacctctcgccaaactctcgcctttttggggactctcggctctcgcctaactctcgctctcgtcttttctgagacaagtcacactcctgcaacatacatcccagtcaaaaaatttttattagctccgaacatgagcacccagtcaaaaggaatgctgatgatgtgcttcaggaagggttacttccatcggcgcggcttttcactacctaagactttcgcacctacttcctccttttttgttcggccccttgtatgattggggctgccgtgacagagattgtgaatgagagagagagtaaaatccgctgcgcgaggaggagtcgaacttgaagttcctttttattgtgactgggaatgtaatccatatggctggactagattcccagtcacaacagtatctattttctaagaaacgaggcccaaatcttctacgcccttgaaatgatttcgtttttggtactatttctactcgaataggcccaaatccaaggacgcctatgaaatttttcgttttttgatatctattttctaagcaacaaggtccaattccatggatgccctttgaatnngattagttttgatatcaatttcaaagagtcgtgggcatga

SEQ ID NO: 44999 - DNA, 947 bp, Heterodera glycines
atttccgcagctcttagggtaacgggaaaaaattttgtcgcgaaaaagcggaacggattagcatcggggttacgagatagaaaattgtcctaaaaagagatagccatttttctgagaattaattcacaatttccgcagctcttacggtaatggaaaaattttgaagagtctctcaggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttatgagaattaattcacaatttccgcagctcttacggtaattgaaaaattttgaagaggctctccgcagattagcacggggttacgagatagaaaattgtcttaaaaagagatacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactctt

SEQ ID NO: 45000 - DNA, 977 bp, Heterodera glycines
actaattatgtttttgttatatattattcatatttttgtatatttatactcgtattttgggcattctgatttcggtataaaagtataatccatatgccaatgtatgtggcaacggtggtgcccgtgatgagtgtattcaatgcgtaattctgattttaaataaaatttaaaagatcaccaaataattaaattaaattattcaaaacaaataaaaagttggaatgaatctaaatttttttaccttttaaaggctttcaaatttatggtttattgatattcaatgggaaagtgaatttttaatggcaaaaagccaattcttttttattaccaataccaataaataaaataattttttaataacgcaaacaaaaaatgtgacgtaatagccataaatttttttgtttgtgtaactgatatttgacgctttcatttttaaatgccttctgaaaactaattaaaagtgcaacagttctttccgaatgattcgttttgattgcctaattaagaaaaggctaagaagaaaccaatgaaacatcaaattcaaaaatgcacattcataaatgtagtcaattagtgtgtacttctttcaaacatatcaatcagagagataaatccttcttataaatgaaatgtcattgaaaaaattctaaagaaaatgtttcgaatttctttgtcacatttgtacatctaataacattatatttttcaatgaatcactaatctttcttaggaattaatttgattaataattatgtcatcaaatgtaactgatcaacaggtaacaaaaataataataataataaagatgtgccaaaactaataatctttttcattcattgtttgtttagtcaacagatgaggctggttttgtgtccatcgaagttgcaattagtgggataattacactgatttgctttttcggaattgcgctaaatgcgtcacttgtctacgtgaccgtcaaatcaaagtgcgttttt

SEQ ID NO: 45001 - DNA, 920 bp, Heterodera glycines
  misc_feature (892)..(892): n is a, c, g, or t
ctccgcgcccctctgcccacgctgggaacatttgtatggtataaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggacattgctctccgcgcccctctgcccatgctgggaaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagatagccatttttctggcatagagaataaatttaaaaattccctgtagaatagaatggccattgctctccgcgcccctctgnccatgctggggaaaatttctcgcaaaaa

SEQ ID NO: 45002 - DNA, 964 bp, Heterodera glycines
tcggacaaatgattttctgcacaagaaaaaaaaaatttagggctcaagttcagtttatgcgtcaaatcaatgaccatcctgtcttttagtccacaactttttgcttagttggtcaatgctcgcataccttggtaccaaacgaatgcgtaaggtctcataaatttataaatgcaagaaaagagtaaaaaatgacattttgaaaaaaagatacaatgagaaaacccttaggtaattaacttttttcgagtagcaattgcgaataattcttttgtctgttgttaagcctttaatttattatgcaataaattcatgagtacttaagctttcgtttcaaaacaagcatagaccaagtaagaaaaaaagttgtggactaaaagactgaacatggtcattgattggacgcgtattttctgcaccaaaacaaaaattcatccgtgccgtactgaagcattcgtaagttttgtgcacatcatggccacatgaatcacagttgtacaacacttcaagcgccatgtgtttgcagtctgtatgtaaaatgaggggagagatggatttttgaacatatttaatgcccaaaaattttaccaaaatacgatttgtggaagcaaagcattagtgatacgacactagctgtctgacttgaaagccctgcgaggatcacaacaatcagaagcacttcaggaggaagaaaggaaagaaaggagagtattttcagatttgtggataaaagcagaatcatggacataaacgtgagcataaacaacgtgacgaacggctgggggaggggaaaatttttttctgattttatgaaatagaaacggaggcttacacaaatgatgcaaatggctaacataacccagcaacactttcgtttggcttcgtctgtgtatttgattttcacctgaaataatgtaaagagacaattttaaaaaatctgtttctttaaattttttgaccgactcta

SEQ ID NO: 45003 - DNA, 1078 bp, Heterodera glycines
  misc_feature (951)..(951): n is a, c, g, or t
  misc_feature (1037)..(1037): n is a, c, g, or t
  misc_feature (1052)..(1052): n is a, c, g, or t
aatttcccaaaaacttttcccggcggcgcctatcggcaccgccgtgccccaaatagaccattattttttgaaaatttgagcccaaaaatggaaaaattgtgatttttcggcgcaaaaccgctaataatttttgttttttggctccgcgctgaagattctctgaaaataacaccagtacaaaaaaaaatttttggcccgaagagcaaaaaaaaaaaagaaaaaaagctcttcgggtgccctccccgaaatttttttctggatacgggcctgcctttgactgttttttgtgttcctagcttttcgaaacagcaactttcgaaaaatgcatgcgggggagaggagtgaaatgttttgcatccgtggactactaaccaaccaacctcttttttaatgatttgtcttttgtccgactgtttgtcggagctggccgtgctgttcagctgctgcaactgttgctttagctcggcaccaacgacgcgtggtgttgttgggccgccgctgctgagcgcggcagacgcagtagaaaatgaacgtgtcaaccgctttttggccttgaaaattgccgagtctccgctgctcagcgcctcgttgtattcttggacaggacaacgcggcagttcagcctcagacgacgacgaagaagatggattcttgacaagggactttcagttattttgacaaatcaacggattgccaatcaccttgctgaacccacaggcacaggacaccggcacacacgaatcccaatagtcagaatcaaacggaatagtgacctaaaaagtaagggcgattggcattttaaataaaacaacacaaagaggtggggtttgttgacaattctgcgatgccaaacgaatgttttataaaaatgatggccaacatattggatttggaattttgtaatgctttttcgaatatctcgaccccaatttggacaaaagacaatatctngggaagtcgggattaaatgacaagcgctattccccatcccccattcgataccatctacaaacaataaatgtacctcattggacttngtcatgtccgctgtnggcacaaataaatgtgtatttgaccc

SEQ ID NO: 45004 - DNA, 1070 bp, Heterodera glycines
atttagttgcctttgcgatccatgtgccacaaaatcgcttattccatcgcaagatggttgtgccggttcataaccgcatgtctcttatgtggcaattcgctatcttttaaattgcataagtttttgtcataaaaaatgctttggcatacggattgccattgttaaaaatttctgaatttttttaggcaactcttttttaaatctgcgcaaaatttgctctaaatttttcaccaattgaaaatgactgaccaattttttgttgccacacaaattgagccgttggcaatgcattcgaattgtgtcatttccaaatgattggacaatcagcacttgatcaccctcacaaatgtaggacagggcatggccggagtggagcaatactgttgtaacaattaaagcaacgaaaattgtatgcaaaaagacgggccatcgatagatgggatatggtggcgatggagaaacctttcttcccatcgaaatgctaaaaattgaaagcatttcattcgtaagcgcttcatgcctctccccatttggataaatcggttcggattagcatttgggataattggaggagtaggaaagggggggggggggtggtgagtggttgtgaatggaaaagaagtgcaattctcctctctaagcacttgctcgttttaagaagtgcgcatcgcgcaggagccgtatttttaaaaaagggacaaatagggaaagttcgccgttccctggggggctgaagagcattggaagaatgtttgaatagctgcaaccgtttgaaattcactttatataaacaggcacaatgcgcatccgtcggcagtaggaggagcatcgctctcttctttagcacttatttatgcaaaatacattcattgaacttacgtgatttaacgtgatccttattattattatgatttggttgaataaggaattgtcccacaatgagactgatgattagggcatccaaaaatatggaccaaaaatcgcgaaatatggccataaaatatggaccaaaaatcgcgaaatatggccataaaatatggaccaaaaatcgcgaaatatggccataaaat

SEQ ID NO: 45005 - DNA, 1102 bp, Heterodera glycines
  misc_feature (49)..(49): n is a, c, g, or t
  misc_feature (59)..(60): n is a, c, g, or t
  misc_feature (62)..(63): n is a, c, g, or t
  misc_feature (92)..(92): n is a, c, g, or t
  misc_feature (105)..(106): n is a, c, g, or t
  misc_feature (109)..(110): n is a, c, g, or t
  misc_feature (115)..(115): n is a, c, g, or t
  misc_feature (136)..(136): n is a, c, g, or t
  misc_feature (140)..(140): n is a, c, g, or t
  misc_feature (1096)..(1096): n is a, c, g, or t
cccataatattttaagaaatagccaatcttttagcactatttggtcggnaaccatagcnnannaaagagaggcgcttttttgtgacagaaanaatcccttcgctnngannacccnaacgacccggggcagaacacngaanagcacaaggtttatcattcatcccaatttcgatggactttgttttgccttggccatcctttcctcctcttatctttcctcccaatctgtcccttggcttttcttcccaattcttcctcattagcattaattaattaattcgtttcccttcccaaatgccttttctgtcccttttctcttccgtctccgcttttgcccttctctctctcctttccttttcttcttctgtccatcacttccatcataaccatcactccgattcgtccaaaggacacaacggccatcatcagcagaaggaccatcaaacggcacaaggtattttgctttattcgcttggctttgttttgtgtgccattggtcgctttttcccttcagaaattccttccaattcgttcccttgcgcctgcggcggtcattcgtccggcggggaaaatgcgcgatggatgaacggaatgccggcgaatggagttccggtagcaaaaaggccctaataattgatcatcatcctaatgactattaatgaccaaccccgtgccttttcacagttgtttttgtttccggacaatgtcttgcgattggtcggcgtcgttctccgaagtgaaaatgcttttcatagggacaacaacgaattggcgcggcatcttttccatcttttggcccaccagttcccccgaaaatggtttatcgtcggaatcggcacaatgccatcgaatggtgcgaacgaaccgaaaatgtgggcccgcgaaggaatcgacgcactgaacgggactgtacagttgcaaagcccgcccggttacggtagcttcccctttttggacggacggcgttttcaacgagaaaacggaagcaaaatttggtatttcgtatatgcggtggagccaatgacggacaaagcaaaggacggattgccaaagcaaagcttgacaaagtgtttgtcggaagggtgagtttggcganaaatta

SEQ ID NO: 45006 - DNA, 1275 bp, Heterodera glycines
  misc_feature (87)..(87): n is a, c, g, or t
  misc_feature (209)..(209): n is a, c, g, or t
  misc_feature (244)..(244): n is a, c, g, or t
gcagaagtcaaagtgcatattttcagcgcctagtgcatgaataggagcgttttactgttttctgagagcgcctgaaagcagcttcgnaatggtatagctgatttttttggatctggaattttcgcagagatatatgcaaattagtaaccagtgtttcgtttcaaattatttctcgtattctaacgaaataattttttactatgagtgtntggtttggaaactgtctaaaatgttccgggtcgcncacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaacccaaacacagttcagcacaaaaaaattaactattcacgcttgagaacgcgaagtttgctgcggagaatggcaattatatgcagaaagtcaagtgcatatatctcagcgcctagtgcatgaataggagcgtttttactg

SEQ ID NO: 45007 - DNA, 1495 bp, Heterodera glycines
ccccggccgtccaatggtgcgggcgcacgattggcacggtggtggtcaaaacattcgtcgttggggaacacgaactggcagtcgacacacaaacgtgacgtgctcgtcccatccggcagctaaaagaaacaaatttgtgtatgtgcgtccgtgagcaggtggtagcggcgagcgacctgttcactgtgacagggatagttgggcccaaagcgcaggcaaaggcggcacaccacccgacaaccggctgggtgaaagagccggtacgctgcccgctcacagtcaacacagtactgtggcactcggaacagctgctcaattcgaccaacatagttgtagtgaccacgctccagcaccagacacaaattgaactgagctgccctcctattaacataaaactcgagaaaaaaacacaccacatacatacccatcccccttgtacacaacccggtactcgtgctctttttcgaatacgaccagccggatttggcccagtccgtgcatgttgttgagccacagctgaacattctcaacatcttcaagtgtgtacatgtgtttgtgacgcgaaatgccggcccttcgcaacagatggcgcgcctccggtccgtgcatgtgttgttgaagagcgaaacggcaaaacgaggcggcgcccccaccaccgggcacaccgcgacaccgccgatcacgcaagcccaacaggacagcccgtgccagacagagacgatcacgtggattgtgcacacggactaacgactgcaccgagtgggacacgtggtgctccccgtccaaatcacatgcaccttgatcattaattgtatttaaaatgaagtgcatgtgcacaaacccgcgcgatccgcctgtacgggctcccgtggccacaccgcaagcacctttgttagtgttgtgcccgccaaaaagtcaatgccggcggcagactgctcattcagtgctcaatcgctgccgcgagggctgccgcgttgttttgctccgggggccgaagcggcaccacgtacggtcgctcaaaaccgggcgggtgcacttgaagcccaaccagcaacggtggcggatgcccttggagcacacggtccaacaaatgttggattagtgccgtcatgagcaagtccggccgctccgcttcttcaagcggcagaaaacggacttccgcaatttccccgcgcgtgttgcgcggccggtttctcatcatagtggagctctccaccacaaaacattcatcaaccggtcgccgcatctgaattacgcaaaatgttgatcatcatcatcatcatccgtcattgcagtttggttcattccacatcaatttattttacaatgatcacagaatttaattacactacaaaaaaatacatattttacaacacagtcttacaaattgggcaaatgcgactgatcagcagccatttctcatacagtctgggtggaacttgggcagacagtcaagcacagtcaacaattcccctagcaaaaaaggcttccacaa

SEQ ID NO: 45008 - DNA, 1098 bp, Heterodera glycines
tgtgaaataaaatggcgattgtgcacagccctccgtttttacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaaagagatagccatttttctgcgataacctctaaatataaaaatcctctgtgaaataaaatggcgattgtgcacagccctccgtctcatacgcaagcgcttttgtgaggtataaatttctcaaaaaaagagatagccatttttctgggatagagtataaatttaaaaattccctcaaaaataaaaaggctattgcggccccgcccctcctaatcatgctccaaaagaatttggatggggtataaaaatttatcaaaaaaaa

SEQ ID NO: 45009 - DNA, 1307 bp, Heterodera glycines
cgcactttttattatttaaatcgaaatttagaatactcatttttggacgtgagtcgaatggtcggtgggcgaatgaaatgaaagagtgtttcgccgacggcaccttcagcatcacaccgaagcctttccaacaagtgtacgcaattttggcacggtaagaaatttaataatttaacaattttgaacttattatttaagtcggaatcgctgggtcatgccagtgtgctactgcatgctgtccaacaaaacgcacactacatacgagcgtatgtttcgtatgctcgttgctgtatggccagacttcaacccgtacagcgtgtcgatggatttcgagacagcggcaatcactgcgctgaatgtagtcttcccattcactgaagtgcgcggatgtctgttccacctcgtccaaaattttcacaaaaaatttctgaatttgggctgaaacagttgaattcatgacaaaaaaaaaaaatcgaattttcgaaaattttagcgctatcaaaatgacccgacattcgcagaaatggcacgatgtgtcacgtcgctcgcgtttctcccaattggagacttgacccctggaatcattgctctggacatggctcttcccgacgaacttactcccgtccttgactggtaaattgacaatctcaaattgtttagtatttattgttctttaattatttattaggttcatcatgaactacacgggtcgtcttaagcatgatgtaagcagaacacgcccgcgatttgacccaaacatttggagtgtttacactcgaacactgcaaggcgatgaccggacgaataaccattcagaagccgcgaacagacgcctgcaatgcgcatttgcctgttcacatccatcgatttggcatttcatttaccttttgcgaaaggatcaaaagttatccgatgatgacttcgcgaagtgttcaactggacaagaaccaccgcaaaaggcaaagaaatatcgcgaagcagaccgccgaattctcacgatggttcaaaattatttaccacttaacaacgtagacaccaacattttcccaattcatcagccttttaatcatcactttattattgcttttttgatcggaatttctcgaaattatgaaatgagaccgtgatttgaaacagataaaatgttattttttcttggatttttaatttcaatgtcttttaaacttttggtatggaaatggcctaaataccttggtatggaaacggcggcatggaaatggcaggtatggaaacggcggtatggaaatggcggtatggaaacggcagtatggaactgaccccaaccc

SEQ ID NO: 45010 - DNA, 1382 bp, Heterodera glycines
aatgggtgcgttatatcggacgctccggcttatacgcaatgagatgttaagctagcaataaatgtgactcttgtcgaactaattaatgcattcccataatttgaaaattaataattttacagatatgatttgttttttatccttttgtaataaaccaaagaaggaactctaatcaggggtcagtttctccaataggaatttcagaatttgataaacagattttcccaaaaagccattgtagatttttgaacaagttttaaaaatataaatttgggtccgatttgccggtagagcacgtcaagacaaattcagattttgagtcggtttatgaaaaatatatcaagaaaggaatatatccaacccctttaatcaaattgtatagtttggacatattggtcagtggtatttgctcctttcagtcaatatataatatgtgattttcactcgtccatgttactgccatcattgggagtttcgctgctgctttcgttctccaccggtgcattttcattcgttggatttgttcctctacccgtgtccacgacatttgatgtacccgccgcgttcctttcttctgaatttccatccgaaaaagacatccatgactaaatataggatgttttcaaacttcgtgactaaattcccaagttgggccaagacttgcctgctcgacaattgcctgaacccttttttcgtattcacgtcgattctcctgataaagctgcgctgctaatgagtttgcaggactgttcgggttgggttcgtccagcagtgattggatggaggtcaaaattgcagccacatcataagttggtgaccattggttcttaaaaaaataaatttaaaaaattccgttaaagacaagattaacctgtaaaatatccagacaaatacttccatcggcgtaaacatttggatggaacattttcgacacaaatttgacggttggtggcttgttagggtattcttcagtaaattcgagtgtcaatttgaaagttccgtcttcaaatggtgtgtcctgaggtccaaaaatgactgcttcccagcgcatgatcgattcctaaaagttggacgggtcttcctcacttcgggggatggcaaaggcaatggcaacctctgtcggtgctccgcaaactccggcagggggatcatcctggaaagagaacaaacttattaaactcaagttgcatatgagctgtttattacaaaaaaaaatcacctgtaacttcttaaaatcgcgcattaaacggcgtctcgacggagttgtcattgcatttgttattaaatgatctcaaatcagcttaataaaaaaattaaaattaatgtaaaaacacaagaggatgcttttgccgttatttttctttttttaagttcactatccg

SEQ ID NO: 45011 - DNA, 1122 bp, Heterodera glycines
attcactttttgtattgtatattggaaaatgccgcaaaacagactaccatttcattatattgtaccatttgagcgagaaaagacacacaaacaaacaatctttgcataatataaatttgcgtttttggtggagaggcataaacaaaggaggaactgattgtgaggaactcttcaagcagtagttataatggtgcagaggaaaatgtgggaaatgttgtgtgacaaacaaacggaaaaataaaatagcattaggaaaaagccggtaagaatcgaataaaaatgtctaatgaagtagggagtgacgtgccgcaaccattgatcaattctcaatccaccaatccgaatcctaacacaattagcacatcatcattattcatcactgcatcatccgggtgatgctctccaactcgtcaacatcggcgaaagggtcggccgactgttggtgctgtgacgccgcgggtgacgacgattgtcgctgcttctgctgcggctcttcacctagcgccgaaaagcgagagattggaaaaagcgcgccgcgaaaaaaggggttttgaaaagcaaaaaaaggtcctcgattcacacgcccggacccctagcaaacttggccgctgacctccttgttatgcaaaaaatttttattttgaggtaatcggaattttcattttttttatcatgcatttgaaaaaacggtaatgtgctttgcccgtcccttttttgaaatcttttttttgtttttaaaaatcatgaaacatgcttccaaggattttagggtcgctgatcacgaaaccggaatctaataaggaaaaattgccgaatacggtatcggctcaaaatcgcacaaaaacacttttataggttttcttaggtgctgagaacgatagaaaagcttaaaattgggcgcggaaaagcatttaaaccggtttttgaaccggtttaaaactcgaaaatttgagtgaaaaagagggctcctgaccttataaaatggtcaaattcggacaaatttggtatcattcgaaagctcttgacgagctaagtctaaaaatcaaagaatcaagtcgaactgacgccatctgagcattgggacaactgagtcccagtgaaaaaggacacttcagtaccaaa

SEQ ID NO: 45012 - DNA, 865 bp, Heterodera glycines
aaaattggaaaaattggctatttctttttctgctcaccagtaataggaatcccacccccattctcagaataattccgccgatattaattgttctggaatttgtttctcgccgcgtttgttgggaaaaaattggaaaaattggctatctctttttctgctcaccagtaataggaattccacccccattctcagaataattccgccgatactaattgttctggaatttgtttctcggcgcgtttgtttgggaaaaatttggaaaattggctatctctttttctgctcaccagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaatagggattacaaccgcattctcagaataattacgccgatactaattgttctggaatttgtttctcggcgcgtttgtttgggaaaaatttggaaaattggctatctctttttctgctcaacagtaatagggattacaaccgcattctcagaataattacgccgatactaattgttctggaatttggttctcggcgcgtttgtttgggaaaaatttggaaaattggctatctctttttctgctcaacagtaataggaattccaaccgcattctcagaataattacgccgaaagtaattgttctggaatttgtttctcggcgcgt

SEQ ID NO: 45013 - DNA, 876 bp, Heterodera glycines
  misc_feature (20)..(20): n is a, c, g, or t
tttttcgggtttttagggcnatatttgggggatttttacctcctatgttatgcacatatttgacatttttagtgcatacaccttataaccctaatgattacagtagatttaagaggggaaatggacgtacagaaaaattttataaaactcatagaatattttatggtaataaatttttaaaaatacagtattttacattatttcaagaataaaaaaggtcatgagaatcatgagaatgatctgtagtgaaaaattgaaaataaatttattattattgttttttatttacttaatttaatataaatgtgtctaaaacattttaaattatttaaagtttttaatattttaataatttactgggtctaatgaatccccgtggcgtttcctaccatttctggaccatgctgatcgccatcacttttctgtacaatgcgttgtccatttctttgctggtttttactgaattcattgccgcattttattggtaaaaaatatttaattatttgaaatataaataatttattgaattttaaaatggtatttatgctatggattcttctgaactttgtgactgactttctgaacatggcggatattgttatgcagacgaggagaggtattaaatctcggcatttaaaaaacgcacttaaatataaatctttagaatattttgtggatggcattttgattagaaatgccaaattgacgcagaaacgttacatactcaggtaaaaaggcaaatatttgatttgcaagatttcaattttagattcattaataaaatcacagtgactttttttcaacttttaaaatgtttaccaaaaataattttttattttttaattggtatatttttcctatttttcgtcggcattt

SEQ ID NO: 45014 - DNA, 993 bp, Heterodera glycines
aatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctgaaaaataaaaggtctattgcgcaccgccctccctatcatgctcgagagcatttgtatgtgtataaaatttatcaaaaaaagagatagccatttttctgggatagagtataaatttaaaaattccctgtgaaataaaaggtctattgcgcaccgccctccctatcatactcaagagcttttgtatggtataaaatttctcaaaaaaagagatagccatttttctgggataacctataaatataaaaatcccctgtaaaataaaatggctattgtgcacagccctccctatctacgcaagcgcttttgtgtgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaaattctcaaaaaagagatagccatttt

SEQ ID NO: 45015 - DNA, 1205 bp, Heterodera glycines
ttccttctacaatcgcctttatacatcccattatgaccgttaaaattatcagagtgccgaaaatcgcatgtgatctaagcctagaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtcttacaagggaacattccgagctgcgagtgggaaaatgcatataagctatataccattggatatagtggtctccacttgcattgccaatttttaattgtagaggagtattccctctgctatcgtaagctacccggcctcgacccccgaccatttgcgcttcaagactcatcttcgacttgtctttgctatactctttgtaggctcaatttcaccgacggatcggaaagcgactgttggggcgagtgattgtcgactttgatggtggaggatcccattcgattggacggcggcgcattggcaaaggcatttgtgcttttcaaagctgaaattggcaattaaatcattgggtccacaaacagtcgctctattcacccttttaatattgccattactttccccctgtttttctttttccctaattcgtccgtctcctctcacttttctctcctctccactctctccctttcctttctctcccccttcctctcctttccattttgtcctctctcaccactttttgcttcctcttctcacttctctcaccctctctcccttcctctcctttccctgctcttttctcccctcttcctccctcctcttttcccacccaattatcttttttcacccttcccccgtttctcttccctcttcg

SEQ ID NO: 45016 - DNA, 1120 bp, Heterodera glycines
  misc_feature (148)..(148): n is a, c, g, or t
gatggatttcaaaaaaaaattctaaaaatcgaaatgttggcacttggggaattagcggacggacggcggtaaaaaagaaacaaacaaatgagagacaataaaaaataaacccatttattgagcgagaactgctaattgcgagaacatnttccctgggtggcgctaattgggcaagggaattaacaaatgagcatgattaagcattgaatgtttgtttggcaatacagtaaacatacggaatatgtttttctctctgtgtctctcttccttacccaatgccttgagggaatcactttctgttcttactgtatcgcgttctttaccataactttttggctattcccttgcccagtgaatagatcggagaacaaagacagcgatggtcgactgagcaattgcctgaggcgcaaagcttgttcccttatcccaagactgaaaccgaaaatcaaaagccccgaaaaattttcccaaggacgagactctcgaccatcgcttttttcagagagtgttgctgctcgaaaacctggcatttttcacagattgccaaaatttcgaaattgccaggttttagcatttgccaaaatgcgcagaattcccgcgggtgtttcttcccgtcccttttttcttctcatgcgatttgcttctgtttggacactcccacaaacactcgcagttggttcagctcaaacagtgcacattgcagttcgcgtcgcagttgtgcattttccttctccaattccatgttccgcagctgcgtctcctcctccttccggcgtcgctgttcccgactctttcgtgccgagtcattgtttttctttcgtcgttctcgataggccttaaacggcaccagctaattaatgctaattaattgctttgctttgccaagaaagcaccgccccttctttttaccacaccaacagaaattcctgcgcgttatcctttgggacggatcagatcacgacccacccactatctaataacctcgatcactgatcaatttttcgggattggtaaacgattttccctactgcatccgatctttggtgggatttgtttctccttttccttacgtggtccttcttctcctccggcactgggctcggctttttctttatcgaca

SEQ ID NO: 45017 - DNA, 942 bp, Heterodera glycines
tctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaattgtccgtttggggtactcaaacaattatggggagcaaaaatccaacgcagaattaaagtacagactatagggaagctattcccgaaggattcggtctccccataaatctgggcgcatcggttcggggggaccgccccgaaaacaaaaaaatcgattatttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaaaattttttggataaaaattatttaaatgaactgactagataatatttaaaataggttatttctcttcatttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatattgagtgatcgaatttacactaaaaaagttaagcctacattttt

SEQ ID NO: 45018 - DNA, 717 bp, Heterodera glycines
ttttgtccaactttttctgctgctgctgctttttttgttgttggtcatcgtgttcgccagcagaaaatttgtcaaaactggtctggaattgtaggggttcctttattttttttgtgcctcgggttacaatttttttgtgggggggggggggtctccgatcacgattcgaacaacttttaggggccaatttcaaacgtgccgaattcgaaaatgtttatgtgagttgccaatagtacatataaaaagcattttcccataaatattaggggaggagggggggggggggtggaattgttaaattttcaaaaaaaaaaaaaattttttttcgtcggaagatcataaccattttccatttttctgccccaccaattgttcttctccgtcgtcgacgattgtttttgttggcactttgtcattactgttgttgttgctggtggtggtgaccaacgacggcggtgcattcagcgaaatttgaccctgtaaaaaatgttcagaatgaaagcaaaattgtctgccaaattttggaaaatttggttattaattttttagcaccccatgaaatcattctctcagtaagccaattaaaatttggtaatactgccgatggtccccctccccccccctttttggaaaattttttttttctgttcttaaaagtcgtgaaaacacgtttatggggtttttaggtgcgctggtcacgaatctaactttcatttt

SEQ ID NO: 45019 - DNA, 958 bp, Heterodera glycines
  misc_feature (941)..(941): n is a, c, g, or t
tctgatgacattgccggagtcattgtgcttattatgcttttagaggatattacgcggggcttgaagaagcgaaagccaaagagtgctgcggtgacaaagagaaaaacgcggaaaatgagcaacaacagaaacaggtgggaaggcgtaattggggaatcagggtaattagggaataattaattaattgaccggtcgctttgatgcattttgagtggacttcatttagcgaccattcacaaactttttggtccctttaaggccaaattgcctccgtacgatttgctcgcctgtttggtctgctatttgagccgcttcacccaaatgtttgtccagggcaatttggagaccatcggcagtccgtacgccatgatgatgttcgcctggtcggagcaaattgctgtccaagtgaccgccatcgcccaatcgctcgtcggtgccatcactttcggcacttacatcctttacatcagtctcaagtccaaaaaagagtatgcaaagctgcaataatgagtattttacggtccaatttgttcagattgaactgccgattgagttgcattttgtcctttgtcgggctgatcattttccatctgatcactttttcgtggcctttcctcccaacgcccgtcacaacattcaacgaaacacgtaagtcaattggtaattcgtcattttgatcacttttcctaacccattcattcatttcagagtcgcaaatggagccgaggccggtcggatgcaacgcgacaaaattcaggtgaagccgaaaaggcgagcgaagaaggcattccaccaagacattcccccccccctcgctgttcagctggtgccaaaacctctcccaagtgaatgtgtggttgttctactcctcctacgtcgtgtgcatcggctttggcttccccgtgctgaacattgccatgaacactctcttctcccatatncctcggccccgtcgtca

SEQ ID NO: 45020 - DNA, 1214 bp, Heterodera glycines
  misc_feature (15)..(15): n is a, c, g, or t
  misc_feature (26)..(26): n is a, c, g, or t
  misc_feature (56)..(56): n is a, c, g, or t
  misc_feature (64)..(64): n is a, c, g, or t
tacggatgacgactnttctgtgctgncgcagttggtccatccggtgcgaaaaaggnaagtgggntacatttcccacgccaggctagggaaatgacggttcgcaagagctgtttgcgcgggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtggggcgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagatcggagaggacggaaacctctcgtagagcaaaaaggcaaa

SEQ ID NO: 45021 - DNA, 981 bp, Heterodera glycines
  misc_feature (33)..(33): n is a, c, g, or t
  misc_feature (74)..(74): n is a, c, g, or t
agtaaaatcgtaattacgctcaaaaagctttcnaacaattttagcgcttccaattccttctacaatcgccttantacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcttcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctaaagcaattttagcgcttccaattccttctacaatcg

SEQ ID NO: 45022 - DNA, 1076 bp, Heterodera glycines
tttttactttggttctttgctgagacattccaaaatttcttttgttccctacagctgagaatttgtttttcccaaaatgccgttgtgtgagcaaagaaaaaatgccgactccgttcacttgcataatgagggcatttagccggtcaattaatcaaaatgcatcagaagaagagagggggcggaaagaaaaggcatggcacacatataaaagctcagcagaagcggtgccaaaatcatttctgcataaaaccaacaacgaacagcccaaattttccaaataaatctaaatttttttaaaatttttgctccaaaatatttgagatggcactaagacggaattaccgtaaatgctctatttgaatgcccccttctggtagaatacccccctccaattttatgactgtttggcgtatttataggtttttcgtgactttttgacgatttgaattaatgaaaaggggaggaggaagaaaaaggccattttatagacaaaattgattcgtttcattcattcaattcactaattgctccttctgctggcatttgaatttttcgcaaatcattgaaaattccttttttcaatttgtggtgcctttttttgccatttggttcttttttggtgttttttttgtcgatttttttttactcattgtcagtacggaaaaagaggtcagctccgttcccatttcccctcctgttttcttatgtattcgcgttcccataaattattttttctaccaactctttttctaaacaattttaaggttagccgacgatttgcggaccgacttttgcggaccgacatttgaccgacattttgcggaccgacgatttgtgactaaaaaattatcaaaaaaaaagaaaaaaaatttaaaatgaattttcaaataatttttcgtaatcaccgaattgaaataatgactaaaggtgataatttactagtgcttcttgctctaacgaataagcgatgtcgatttcgacgtactttttttttctttaatcggaaaatttacccacgaactaaacggggtggaggacgatagagtttattaggcagaattgatttaaaaaatgct

SEQ ID NO: 45023 - DNA, 1117 bp, Heterodera glycines
  misc_feature (1108)..(1108): n is a, c, g, or t
ttgatcattgtcaattcctttattatgacaattattcatggtgataaattctgttcgtgaggaagatgatgtgagaaaaaatttgtgaattataattataaattttgttaccaatagtccatttaaaattctaaaaaagctaattcttatgaaaagctaaaaattaaaaaaattaaattagtttagtgtgtacacaatattaaagtccgcgcaacgagtatttattagagaaagtgaatgcgaataaaaatttaaagaataaagaaaaacatattttttttcaggtaaatttatattcaagaaaataataaaaccaaaaactaaattaatttttgtcgttattaaaattttcaatttccctattcttaagatgaaaaaaagacataaaatttaaattataataaattttgttttttaataaaatggtaaagtgcaatcagtatattaaaaactctttatatgaaataattatttaaaattctttttttttgaaaaaggaaaaataaattaacatcttgaattagtaaatgttgaaaaaaatgaatagccctcacagaatttcatgttgatttttttcataaaaaatttaattatctaaattgtcttttatttagaaatataatggacaagcaatacataaaatttaaaaaatataattataaactaaaaaagtaaataataccagcgaatataaattaataatggtttagaccgcatctcatttggatttactgcaactcagatcaagggagtcaagccaaaattatttctttttaaactttttaatattaaaaacacgatgatattgtgatatgaagattattcattatcacaccaaaattattgatatagaataataacataaatgctaatctccgttggagtctttttgatcccaccaggcttcaatataaatttaaaaaaatttaaataaataagaggataaatttatgaaaaattcaacaaagtgttttctaacaaaggttaataacgattaatgctgccaatagttaagaaaaattatattgtaaaaaattaccacaaaatagaaatccaaagaaaaaattacaaaattgttttaattgtggtaagaatttaatgataattnttatgacat

SEQ ID NO: 45024 - DNA, 958 bp, Heterodera glycines
  misc_feature (802)..(803): n is a, c, g, or t
  misc_feature (848)..(848): n is a, c, g, or t
  misc_feature (852)..(853): n is a, c, g, or t
  misc_feature (889)..(889): n is a, c, g, or t
ttttcattgcctccacgttgtaatgcgcgcgcgtgtccgccacgccgtaaatgttcttcgcgacgcacaaatattcgcccacatgctctgcgcggaactgcgcaattcgtacgcggcacgcgccgtccggcgtattgcgaatgtccaattcgtccgacggcaccagcaaattcttgaatttttttttttgctttttttcaattcatacacattgtagaattatttcagtatttaaaattttattttttaatttattcatttaactttttaaaatttgtgtaatttcctttccaaacagggatggacgaaatttcgtttcgttttcgtttcgtcctacattttcggcactttttgagtttcgttttcgtgtttcgttttcgtctaccaaagttttttcgtttcgttttcggtttcggttttcaaaattttgtttttcgtttcgtgtttcgttttcgtcagagcaaaattggacgaaaaagacgaaaatatttacacccttaagaatgacttttttggtaagaaaaaataagatatttcttgaagtattgtattaaatctgacaggaaattgtatgtaaagtttgaaatgttgataattttttctagagagcgacatttggcgaaaatacggatcaggatcaggactacggactaggcatccatacggactacagacttacggactaaaaacccggaaaacccttactccgtataagtccgtatgcaggaaaaatacggacccgtatacggatcagggttttttgaaaagtttttaatcaataaaaaccatattttttaactannatactaatatatgtagatttcgtctaaattttattacgaacattnaacnnagagtttttggagtccggcggtgccgataggcgccnggcgggaaattttttaaatttgattgcaaattgttaacagatttatcgaacaaatttgcgctttttaac

SEQ ID NO: 45025 - DNA, 637 bp, Heterodera glycines
cagtcgattttatcattcataatcctataatacaatctgtactacctagctgggggatgcgccgaaggcgctgaccccgctagtttattttaattgatcatttttaaaatgccttcaataattcataatttttgtacaaaattttgtgaaaccaaaccgccaaaacacgcccaattcagcgccataaaacccaaaaaagacaatgagaaatgaatgtgattggttaatttgtgatttgtgttggtttaattgggagttgagagagtccgttgcgctaaaacggtacataaattagcactaattacaccgtccaaaaattgccattgcgaacttcataaatgatttttcacattttcaattcccttcccgttcaatgtgtacacacaaatcaatccatgcagaaacaaccaaccaaccaacagttgccccaaaaggagttgtgaatttttaaattttccaattttatgggccaacgattctttctttttttcgttcggttggacggacggaccaaatttaaagtgatcagagcggagggagaagaacaaataataacccgatttagcagtcagcaaatgctctgtgctgatcagcagcagcggagagtgagtgagtgatcaaaagttgcaaaaatcac

SEQ ID NO: 45026 - DNA, 1394 bp, Heterodera glycines
  misc_feature (1338)..(1338): n is a, c, g, or t
tccttatgcgatcattctcttctttgttcctttcctgtttcccttaaaatttcatttcgcacaatttcccacgctttagctgctttttcagtctgaattcttgtatagaccgaaatatcggacacaagctcatcgggggatgggagtttaagtaaccgatcagttggcaattttggctgtcgtaaattaatgataaaaaatagcgtgcggcagaatttcatcccaattattccctttttcattgaccatttgagaaataatattagccatgattcgcatagccccttcagccattccattagactgctgatgatatggtgttgtagtgacatgctcaaaaccgtatatttttgccaaatcattaaaaattcccgaagtgaactgtcttccctgatcagtcacaacaatctcaggagttgaatgttgatggaccacaatttcaacaaaaatttctgatacagtattcgctttctgatccgggattgctttggccataacccattttgaaaaactatcaatcgccaagaaaatatacaagtttcctctttcagttttctttaaaggacccattaaatcgcaatgaattctttgaaatgggccatttgatggttcgattgggacactcggagccgatttggcctgccctggctgaattttcctcacttggcacttttcacacgcctcaattagcagtttaacgtcgtctttcattccgatccaataaaatcgttctttaatttcgtgccaagttttttcgaatccaaaatggccttctgaatggaaaataatgaaaagtttttgtcgtaatgaatgagggattattaatttaggtctttccatattttctttgccttttataaagtaaatggccccatttattaggctataatcagaaacaactcttttccatttcagaacatcatttggacactttccggtttttaaaatatagaaaattttggccaattcttttacctttgtttgtgcctcaattactgtttttaaggttatttttggattttcattcaaaattccatcattttcagcaattaaattttcattaatattttttgcacttaaaatttttggctgaaggtcaaactcatctgaattttcttcctgttttggttcaggatccttttcatttcccggtatattatatcgagacaaaaaatctgccactttattcttttttccaggccgataaataatttctaattcgaaactttggagagtaacttgatatttctcaagtctcccttttaactccttagctttcatcatgcctgttaaggcactacaatccgttataagttttgtaacccccagacccaactnatatatggcgagaataacgaaaccgcatacactaatgccaatgcttccctttcaat

SEQ ID NO: 45027 - DNA, 821 bp, Heterodera glycines
tcccgtgctgttgccatgtctccagtctggcgacgttcagttcgtcgtctgtcgtcgtcgtggtccgtgtggtgttgtcatccatcaaaaatgcctcccttagcagacttgacgaacgccgtggtttcggtgccgttcccttttgtggcgttggcggtggcgcggatggcatttgccgttgccctcctccttcctttactgtcggttggtctaacggtggcgccagcgatgccaatgccaacgtttctccttctcgtgcggcacgcggttttatcggtggcaaatgatgatggggttggacattgctgattttctgcaagattttgaaaattgagccgatgccacttctggatggacaaattcatttataaaattaccaaacacagtcccgttatttataacttttcttttgtgtgttaaaatttgatttttgtctcccctcggaggagtacgaatccaaagtactcgtagaactattaaaagagcagcaccaatttccctcaatttttgcctcagtggcattgttcattcctcacccgattgttgttgttgtttttgtgttttgcattcgaaattgtcgatggacacgagctgcgcaatcagttgttgtggttgtgttgctgattttgctgctgttgttggcccttcgtcggcgtcacggccaaaagtgacgagcgaaagttgttgaagtggcggtggttgtggtggtggtcagtggtggccgggtgcgtacatcggaacagaaaggacaaaactttgccgaatttgctgcgttcagtccgtcgctttcggcccaatcgtttcagaaagcgtctgcaaaa

SEQ ID NO: 45028 - DNA, 974 bp, Heterodera glycines
aatttttaaatttatcttattatccaagaaaaaatgactatctttttattttgggaaattttatacgttacaaaagcgctcgagcgtgagaggggagggcggtgcgcaatcgccatttaatttctcagagaattttaaatttattttattccaagaaaatgactatttcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgcatcgagcgtgagagggagggcggtgcgcaatcgccatttaatttctcagagaatttttaaatttatcttatatccgagaatgatgagtatctcttattttgagaaattttatacgttactaatgctctcgagcatgatagg

SEQ ID NO: 45029 - DNA, 988 bp, Heterodera glycines
ttttttgttttcgggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccagcgcggtcccccgaaggaatggatttaattaaattctct

SEQ ID NO: 45030 - DNA, 984 bp, Heterodera glycines
  misc_feature (38)..(38): n is a, c, g, or t
  misc_feature (68)..(68): n is a, c, g, or t
  misc_feature (127)..(127): n is a, c, g, or t
  misc_feature (160)..(160): n is a, c, g, or t
gagcagaaaaagagatagccaattttcctaaattttcnccaaacaaacgcgcagagaaacaaatccangaacaattagtatcggcgtaattattctgagaatgcggttggaattcctattactgtgnagcagaaaaagagatagccaattttccaaattnttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttg

SEQ ID NO: 45031 - DNA, 1544 bp, Heterodera glycines
tttaaaacaatattttaggtttttttggcggcgccgcccaaaaatgccattttttccatttatacaaaaaaaatttgaaaacgataaataaattaatgacttgtagtgccgacaaccagcagagaaatcttcgtaaattttgaagtattgttaaaaatatatcataatttaccgtatttcctaaaatagaggcccggggtctttattttcaacctatgctttatttcaggaactacggtaatttaattgtaatataattttttgatttcggattctaaacattgctgcttccctcatgggttgggccttgcccagctctattaaattcatttgtccattaataaattttcacaaatttcctaattttccacctcttcctcaaccagccgacccattgcaaaagcgcggaaaacatttcgcagctccgagacattaaaattccgaatcattttgaccagcccattgacattgtattttttggctaataaacagggaagggatttatatgtgctaaaaaacgccaaatatgaatatgtacatatatatgtgccaaaaaactcccaaaatatgtgccaaaaattgaaaaaaactgctcaaaaaataagtgaatttctcaaaaagtctcgttttttatcaatttcgctagcacaatgctaattaaaagcattttaatcctttttgtcgtaaatttttttcgctctcaaaaatttactcatttttcggaattttcctagctaaaaatcaaattttaccttaaaagtgaaaaaaggtcatgaaaagcgccaaaaatacaaaaattgaaattgaacatttttggggacattttgccaagaatttgattgccaaaaaaggaacttttgtaaaaaaaaatcaaatttcccaaaaaatcgccaaaatatgtgccaaaaacaacgaaaccccaaaatatgtttttatatatgctaaaaactgggtctgatgtatggaaaacaagtaaaaatgctatttttgagcttttcatgcgatagcatatgccaaaaaaaaatgtaaaaacatataatcccttccctgctaataaattagtaaaataattttttatttgaatttgattttacccgcataaagcatttccgccacattttctccgttgactgcgcataaattgtccgtgtaaatgaaattcagcatggcctcgaacacatcagaagtgatgtcactgatcacaatcggattggatggatctgaaacaatgaaaagcaaatgggtaaagttatagggaaataaacgaattattataaaaatatgtttttatgatggcacggaggaaatgaaagaaaaacttaaattaaaaataaaataatttatattgttttaaatttttattttaaagaaatagattgtttaaatggccaagagatgcctttttgacaaatttaatttatcatttttgatagaaattctccacaattaaacattttagtggaaaattggttgttttttaaaattcaatgcggcacactatccaagggtaattagttaattcatcagaccattcccattttttt

SEQ ID NO: 45032 - DNA, 1237 bp, Heterodera glycines
taaaaagttgtttcatattgaatattatcacatagatctgttaaatacattttcaattgcacacgtcaagttgaacatgatgttgttatgtcggaaattactgtataattataaatgtttatattaaattttcgaataacatgtttcttgaaatcacacaaatgtcattaaatttgcgattttggatttattataaatagatatacagaattttactatttttaaatattggttttaaatattattaaattagattgtcatatatttaagcttttgttattaaaatttccaatttttataaataatttaatttcacagcatggtagatgaaaggttcaagttctcatttcgtcttttctagttcgcattccacttctccaagatggaggcctaacgtttatctacaccctaacaaatttcgctggtgctattctgcattttttaatatttcaatattcttttaggcagcattccactaagactgttgattttcaaaaaaaattaatcggaaaccactctgtcaaattaacaactagaattaattttaataaacgattgagatacaaaattttatatcccattctcttccgtccatttcacccagctcacgactttacgttgtcacccatctaatccaatccattcttcattcttcacttggtcgtttaaagttaaaagaaaaaatgacggcaatggtgataggaaatcaatttgcttcataaattgatggtataattgaaaaattattgaatggatttgttaaaacggatgaaattaaaattgtaatttaattatatagtaaaattttgtacaaacaaatgataattaaacaaatcaaaaaaacattttctgcccagttaacattttataattttttttctgaagaaggtacatgtttattgcgctttaatttattggtactttgtcttaaaattcatataatttatagaaaggaattaataaattttaacactttaataattaagagaaaattcacattggaaaaaaacatacaattaaaaggttgtgacatcgataaggaaactaacttttatgagcaagaagatctgatcaatccaaaattttaatattaaagttgttaattgactatacgcgtttaaaaatattattataaaaatcaaataattgcgattaaatataaaaatgttgatttttttatacaaaattaaaaaagttaaatttttaaaaacctatgggacaggagaatactccgaat

SEQ ID NO: 45033 - DNA, 1159 bp, Heterodera glycines
  misc_feature (1130)..(1130): n is a, c, g, or t
atttatgtattgtgccaatatgcctattgcaactgaaattattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccacaaattgttgagataattattctagacgatttttttatatctcaaagcttaactattgcctttttgtatgataactggtagatattgggagtaaaaaaaagtttttttgtgacaattgacagataaaanatttatgcagcatttctaaaaaggatcta

SEQ ID NO: 45034 - DNA, 836 bp, Heterodera glycines
  misc_feature (70)..(70): n is a, c, g, or t
atatatatatatatatatatatatatatatatatatatatatatatatatatatatatatatatatatanccgctaataaagcattctctcggttaataaagcattcttagttgttattttgcttacataagattattatcacttttttaaaagaattaagtaggggaaattaatttttttaaattttatcactcagtattttttttattataaataaagaagctgtttgattcgttcgcacaattaaagtttgattcttaacttttaattaattttcattcttcaactttatttaaatgtttttttaagtatttgcattttttattgtatcttttaaactgtagtttttactttataatgatattgctttaaattttatatcttttttattttttcacgtctcgttcgagcttaatttcttcactagcgggtgtgtgcatgctggtgtgtgaacagttgattcagggttggggaaagcgctgcgcgctttttgagcttcgctacctaggcctttgattatgttagggtcttggcgtcagccgacatgcacttggtttctttccaaataatggaatcgacacattggcatttcaaatgcaatggaaaccggaagtgccctaactcgcacatcatgagccctcctcccttccattagcccaggtgctggcacttttgtgtgtttttcgtttagattttaagtgcagataggaatgggtagacaccagcatctccaaaaagcaccaaacacactggactatagctcattgattttactgcaatttgagcatatttgtagccgacaatgttcaacactttggctcggccttgtgcgtca

SEQ ID NO: 45035 - DNA, 1279 bp, Heterodera glycines
tttttaaaattttttattcctttttaaacaggccaaaaagtttagctttactttttttttcagaaactgatcagaagcgcaccaaactttgcagggaaactccccggtaaaggactaacttacactgaaatgagcgccgagctagctgggtttaaaatttttcaaaaatcaaagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatgaataaaattttttaaaatttttaattcctctttaaacaggccaaaaagtttaggcttaactttttagtgaaaattaatttactcatttttcgagtagtgctcagaagcgcaccaggttttgcagggtaacagctgagaagaatgcttattcatataattatttaactgtcccataatatttctttaaaaattttagacattgcaattttgcgtacttttccaattttttgcaaaattaattcataattattttttcagaaagtgctcttaaacgcaccaaattttatttacaagctaaataaggctctctgatgctttttctatcaaaaaggaagatgattaaaaatttttaaaatttttaattactttttaaacaggccaaaaagtttaggcttaactttttagtgaaaattcaatcactcataattttacgagtagtgatcagaaatgcaccagattttgcagggtaacagctgagaagaatgcttattcatataattatttaactgtcccataatgtttctttaaaaattttagacatagcaatattgcgtccaattttttgaaaaattaattcataaagagattttcagaaatgctatgaaacgcacacaaattctatt

SEQ ID NO: 45036 - DNA, 1305 bp, Heterodera glycines
cccaaaaaccgaaatcagaaaaaaactcacttatcagatcttccaagtccaaaacattagattttaatataataacttattattatagcaagcaaatattttaagcagggatttgaaatgctctaaatatttacaaacgaacatgggcgcaagtaatttttaaaaaatagtaaaattaattatcttgaatacgattaaaatgagaaaattaataattaaaaaatagataattaaaaaatgtgactaaaatattccaattactattaaactaattagcaaaataatgtatttattgtaatatttaaatcagaaaattataaataaatcaatgttttcatgaatatgtaagaaaagtgattaaaaggtaaaaatagtatcaaatttataaaaccacatatatgtaaaaatagatatataaattagttgaaaagcgaaatatgaaaatttgggtatctagattgattctaattatgaagaaaacctgaaaattaccagcacctgtaataaacaattttataaagacaaaatattaaatatttgatttttaaacaaaaacgtttaaacataaatacacaaaaactatcataaaatgtatatgaatatgttaaaatattacttaagtaaaaaaaaacgagcaaaaaaatttcattattttgaaattaaaaataataaaatggccgtttgaataagaaaaataattacataaaatatttgaatttaaaaataattattctgtgcatgatactttaataaatatatttaattctcattttccacaacatcaaaatatgaatcgtgctcaccttgtgaaaaattattaagcaaattttatttataaaaatgttaattaataatttgaaaattgtttatttttgtaggcatttaataatttttgatattttgtcggtatgaatttatttctacaaatattctttttttctaattttattaaatatagattgaagttttgctttattttcgaaaattttttaatcatatttaatcaaaaattgaaaatatttattttagaaattttccttttatttttatgaaataaattaattcataaactcctaatttttacatataatttttattgaatcgttccaagacctccttccctcctggtgttaaaaaaagcgaattaatgataaaatttttaattttaataagaaaaatttaataatttttgaaattattaattatttttgctccagacattattgaggaaattaaggttttattaagtttttaatttttttaaattatattcccaaaaatcaaaattatatatttttttcattt

SEQ ID NO: 45037 - DNA, 1152 bp, Heterodera glycines
  misc_feature (53)..(53): n is a, c, g, or t
  misc_feature (81)..(81): n is a, c, g, or t
  misc_feature (1107)..(1107): n is a, c, g, or t
gagtaataaaatcggtgttatttgtatccatttttgaagaaattgcggaaatntaatgattttctttttaatcctttaaanatgtaaattacaattttattttatttataaacaacagtttctaagcactaaaaattttttaattaaaattttttttataaaatgaatacttagatgaaaagatatgaaatttttgttgattcaagcagatgcttaaaagtgctaattttttgaacttttcttcttagcttagtaaagtgccaatttttgaacattttgctgcgtaagtcattaatgtgtaaatttacacaatttttcttcgttcggccagcaggtgttaattaaaggcattaattttcttgttcacattgcgaaaaatctttttttcacctgattttttctttacttaattacttaaatctccagcaacaaaaatttcttgcctaagaattttcataaataataaatgccaatctatgtaattaatgggaattagggttttattttctcaaatctcgggacaaaactcgttattggttacaattctcgggtgaagttcttcgtcacggttctcgggaaattttgggtctcgaaaagtgcacgacaaatgacgcagcacttccaattctcctcatttcattttatacataaagataaacaaacaaatgctaaacaaattatggtaattaaattagtcaatggtcgtagtcccgacgacaaaatttttttcttttgcattcgaaaatttattaaaataaaaaagtgctgagaaaattttattaaggtattttttggcggccaaatttgtcatcaatttgcttaaaaagaatccaaatttgatattcttggagtacatattgtatctttctgcagatctaaatgtgctttctccatcaatttttaaatttcaaaaaatttcgtcaaattcaataaaggttatatatcttgacagattttaagatagaaaagcaatttgtgttatcacataaccgaggaccagtcatttgtgaaggggcatttaaaaataattttttaattgaaaaaattaattgttctctggaaaaatcattttaaaaaattttaagaaaaaaatctcgaatagtttgngtatacatttttttttgtactgaacgaactgtcagtgtttaaatg

SEQ ID NO: 45038 - DNA, 1092 bp, Heterodera glycines
tcctaaaaagaaaaacccatttttcggagaattatttcacaatttccgcagcttttagggtaaggaaaaaattttgaagagcttctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcaactcttgcggtaaggaaaaaattttgaagaggctctccggaacggattagcatcggggtacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattattcacaatttccgcagctcttagggtaatggaaaaaattttgaagaggctctccggaacggattagcatcggggttacgagatagaaaattgtcctaaagagagagccatttttctgagaattaattcacaatttccgcagctcttagggtaatggaaaaaattttgaagaggctctgcggaacggattagcatcggggttacgagatagaaaattgtcctaaaaaagagatagccatttttctgagaattaattcacaatttccgcagctcttgcggtaatggaaaaattttgaagagtctctggggaacggaatagcaatcggggttacgagataaaaaattggccctaaaaagagatagccctttttctgaaaaataaatttacaattttcccaattcttgggggaagggaaaaaattttgaa

SEQ ID NO: 45039 - DNA, 1114 bp, Heterodera glycines
gtcgaaaagtcccctcctgaattttataatatttctcttttaatgtcctttgctgtcgaaaagtcctctgtctaaaactctggcgcccgctttagccccctcagccccccccctgcctacgcccttggcgggaggcaccatatcttttgatatattgaccaaatatttatcatttacaatattgttcgagcgtctcgggaaaagtctcgggttttttagtcttggtccgaaggagaaataagtctcgaatttcatgttttggttttgtggactagttgggcgtgactccctattttgagttttttagaacctaaaactaacaaccgtatttcctgaaatacaaccctcccccctaaactagaccccccccccaaaaaaagccccctttttgtgggttgaaaaatagagccccgggggctctatgtaaggagatacggtattttggcagtgtttaacaaactataaataacatccctccctaatcatgacaccagcagcagtcagtaataattcatgttacatctctaaaatgaatttagaactttgagcgttcggcatcaacttcagccagcttcattgtgtcttataatacaatgcgctacggacggaatgatcgattgccttattctgaatttgaatcaacgtgaaagtgtgggaagaaaaatgccaaaagggcatgggcaataacttttccattgaatttaaaggtgtaaacttgcatcctgaatttccttcaggaaccgattgatattgtaaatgacaacgggattttttctatgtaatttaaaatctcggcaattgtagagattatttatcccgaatttttttttttaatattttctgaatttctaaaaaaatttcgggaccagcaatctttacaattgcaaaatctctgatttggatgtggcaactccacatttatttgttttgcgaattaattaattgaaaataatttgttaatgttcgtttcgtttgtcctttataaaacagaaaacttgaacagacagaaatatttaacagaacaaatcttaaaaattcttttcttcctcttaagtcgccgtcatccgaaaatctgtaaaattaattaaataaattagttttaagactttttggg

SEQ ID NO: 45040 - DNA, 1091 bp, Heterodera glycines
cgccattgaacgaacatttcccgaaattttgcatttttcctttgaaaaatgtggggaaaatcaaagaattaataaaaagtaaatatgaaaaatgagttattttttagggtttacgaaaaattttttaaagccctattaattgcccaaaaggctcatttgaagcaaaaattattaatgacaaaatcctttacaaaagttaggtccgtcggttgagaagggaaaaaagttggcgaattttcagtacgaaataataaaaaccattttctcccctaataattaggactttcaatttaagtccaatgactttttttctgctgactcaaaatggccttaaaatgacttaaaaatattttcacttttaaaagcttcaaacatggcacttttacgactatttcatgtctttttttttactttgtgaggcaaaatttgaatttcagcgaagaaataaacggtctgaccggtgaaaaagcaattaaaatccgacagaaatttccgcaattattgagaagaaaaatttaaaaaatgcctaaaaatgttttgaatatcaaagaagaaaaaaagccaaacttttgacttttaagaaaatctaattttatgtttgccttgaatttcgaaaaataacttacgaactctaattgtaccgaattcttaaaaaaatctttcatacaaaaaatggaaaccttaatgttaataaaaaaaggattgttcctaataattagcttgaggtaaagcttaaaaatatgggtatatattctagctcttttaaattaatgaattcctagctaaaataaaagatttattttaaaacaatattcaacaaattttgaaaaaagccacgtacctcacggttaaaggctttttttgaaccggtcgacttgggcccggtcaactgtctaagcctgagcctcggtcccggtagtttaaaaattctggtctctaggttttatggatatcagctaatttccatcttttttttttggatttttgtgactttttggcgtttttatgactttttggtgttatttcgtgacttaaattcccagccctaaagataagacattcattgtaatcccaatacccaattattaaaa

SEQ ID NO: 45041 - DNA, 958 bp, Heterodera glycines
tgatattgtatattacagtacttctatgtttttttatctccgagtaatgttactgtattttacactatgtctatgctttatatgtccgcgtctgggttttacaatacgtctaagttatatatgtccgagtgaagttactgtattttacagtaattcttggtttctatgtgagagtcattttgtctatttatcaaattcatgcagatttaaatgctttttaccttctatgtgacatcagttgttctcataaaaatacacctttaattacagtacagtaatgcccaggttactgtaccgaaattacttgacccaatgattttctcctctaattgatcctccccatcttccttcccctatatcaaggtgccatgaatggtcagttgcagcagcgaattcggcacagcggtgttgccggcacaacaaacaatgccgcgctgaccacattgtcgatggcattgtgccgttcacaacagcagccagccgtgccgccgccgccgcccgagtttttcatcgaccaccgtaccaccacgttgttgaacggtggaaacggtagcagcacattgagcagcactacggtagcgattacgtcatccaacggtggttgccatgcgaatggcacagcagtcgtcagcgctgcgcaacaattggcaccatcaaacgtgacaacgccggcacttttgttgaaggcatacgaagcagcggtgtgtgattaatttatatattttaaattaatttccattacgaatcctcaaaattaatttttgaagatggtaattataatattcaaaatttaatttttctcggttttattttaattgcttttaaatttttttttacaataattgattgatagggctggaaaatatatgtataataaaattttttattatgttttttttttgcacaaaaaatcctagaaaaacgtgaataacaattaaatgccattaaaatgacctaa

SEQ ID NO: 45042 - DNA, 1024 bp, Heterodera glycines
taattgtgccgaagatgaacaatgttttggcattttcggctgattatttgccggaattggtggcgcaacggctgaaggagcgattgggcataaaaatgccaaagaataaaaaccagcagaaaacgaagaggattttggccgaaccgatcaaagggacggaggcgaaaggcgcgcggacggcgaaaagagtaaaaaattaaattaaattaaaaaaacaaaataaatgcgatttttaagaaattaaccaaagtgttagccgaagcaagcaaaggttagccaatttaacacttcttttttaatagctcaaataattttaaagggagtcactcaatcgcctcattattcggttcaaacaaaacggacaaaaagtgatcggtggcgattcgaaaactaaccaacgattgttactatcttttggcccctttttattttgtttttttaaatattattctatttttaaacaattgctttttgcatttattgtaattattatttttattaattatataaatttattggtttatttcacataagtccattttgatcattttttagcaaatgtcgaagagaaaaaacgcctctgacaaaagcgaatcggtggcggaggggtcgcccagtcccaaattgggtttctccgcttccaattcgatggcattttgttcggtttactttaagcgtccattttcgtcaacccttctcagaggctgaatgggctgtggaaagtgatccccgatcagctgctcatttactccgtcgatggcactgaaaatcgaccgaaaattgcggcatttgatttgggtaaatggggttttgggaaacaaatgtgtgattgccttgcacagatggcactttgatcagaacaaagtccggcaacactttttgcaaaaactgcgacgattggcattttggtcgggcaaagtgatcggcgcattgcgaaagtgcacttccgagggggtcaaagtgtgcattttcaccaccaaaagggcattttggtgggaatggcatcgaactcgaaaaaaatgaa

SEQ ID NO: 45043 - DNA, 943 bp, Heterodera glycines
agtcacaattttctatctcgtaaccccgatgctaatccgttccggagagcctcttcaaaattttttccttaccctaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacattttctatctcgtaccccgatgctatccgttccgagagcctcttcaaattttt

SEQ ID NO: 45044 - DNA, 1235 bp, Heterodera glycines
tgtgacttttcaaaaatgccttaccgtcggttcccttttgtggcaattagcacaatttggccgagttccgaatgatgtcaaacaaataaaaaatcgatagttgtccgttatctgcagggctcggatctgtcctgatttgtcagatttgtcctgatttggaggtagcgacgaaaatttgttctgatttcttaaataaactcataattttgaaattttatggcataatgtcactattttatcgaggaaatataagattatggcaaaatttggtcatttttcgacaaaaatctgttaacaaatcgattaaaaatcgcaaaaaaatttttcccggcggcgcctatcggcaccgccggaccccctgtccatcctccaaaattttttgaaaaaatgcgacgcaaaaaaagcgtttttaaagcaaaaaagtcgtcgcttgacttttaatttaattgcaaaaatgtccttttttggtgaaaatctgttaataaatcaggacgaagttacaaaaattttacggcggcgcctgtcggcaccgccggaccttcccccctcacccatttcccaaaaaatttttggaaaaatgtgccgcaaaaaatagttaaaaatctgattttttgattccgaatgcgctaaaattgatgatttgttaattttctacccaaaattgttaaaatcgataatgggagacgaaaaatataatatttgatacatttttgatcgaaaaattgtaaaaataactgatttgaagcaattttgcaaaatgtcctgattttcgaccccagaatctgattttttgggcttgatgttctgattttgaaaaattttcgatacgcgccctgcattatcccatggattaatttaacaatttggcacttaatttgttctcatttgtcagccgatcttggcgagtcgttcatccgatggaagcagcacatggagcgttgggagcaggagtacatggcggactgggaagcggccatgaaccgatggtcgcgtttccaatcgtaccgcgacagagacatcgccgaaagcatcgatcagcaggggacatgcgttggaggaggaggaggaagctgatcagtgatcggagaatagaaaagcagaggaggacaactaacaatctgtgatcggactgcggcggagtgctgagttttattgcttggtttacgcaatggcacttggtcatattcccatttaaagtcgggtatttttattttcattttttttattttgtgtca

SEQ ID NO: 45045 - DNA, 715 bp, Heterodera glycines
aaaaatttgggtgcaatttgttaacagattttcaacaaaaaatgctcgtttttgggattattaagctcaattggtaggattttcatttaaaaaatgataaaatatgtatcaatttaaaaaaaactatgagtaatcatattttctctataggaaacccacgagtatacaaaaaaaaaaaaaattgaaaataatccaatttctgtagagggattgaaccaggtgaaagaagaagggaaagtcaaggagactagccattaggccatttgcacacttgggcagtgctacttttaaagaatatattaattttttaatttttccctttgactccaattttcttcactaatttttcactcagaccccccattcttaccagtgcttgtttttcccggttcccggttgccctaccgggaccgggacctgagcttttcaaaacccgggaccgggaaccgggacctcggatgaccgggaattcccggcccggcccggtcccggtcccggtcccgtggcactctactacatacgattgtgcatgtctccgcttcggagcggatacacccgcatatgatttgcacaagggaaggggaatcatatgtgaccggcatcatatgtagacagggagataattgaaatgcgcatatgattaaccatagggaaaatcgtacgccgcgcatgagggagtcccacatacgatttttcatatcggagatatgatacc

SEQ ID NO: 45046 - DNA, 1155 bp, Heterodera glycines
  misc_feature (73)..(73): n is a, c, g, or t
  misc_feature (1099)..(1099): n is a, c, g, or t
tcccggtctcgatccgtgcagactcaaataagtttatgaagtgaaatgtgaaatatgttttcaccacacgggnatttttctgaaacccatcaggaacctaaaaatcttagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaattttttattattaattcgaaatcgttaatttatttgacaaatccaagacttaaaattgggagaagcatggggctgtggctgaggacccaaaatggggccccattggggaattaaacatgatttctgaaaaagtccctggaatgtcgattttttctttccatatcttcttgtaaagctcgagctgttctttccaatggtcttatcccggtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgactttcaatttttcccagtttgattgggttntcaatagtagtttggtcagaaatttccctctacaaaaaaaattataatagaatttt

SEQ ID NO: 45047 - DNA, 650 bp, Heterodera glycines
attatttatttagtaatcagaacgccaaaactttgcacacccccaaatttattggggattttcccttgtaaaaaatggaagagccgatctcgagttaaaaacttaactttcacaaaataaactgtgattcgatagagggggccaaaatatgggcctaggcaaaatttcaagaaaagttacccacaggaaaaaattttttcccagggcaaagttttttctttttctctcattttgacgcactatttccatgtctctaacatataaaataacacatggttcatttttttgccaataaacaattttttaaacttttgactaattaagaaatattcttcagaattttcccttcaaaatgagcacaaaatggttttctttggtctattgttgaaaaagttataagctaaaaaaaattcataaaatcaagggtaaaataaaatgtttaccttttattgtttgtatttgttcttttggcgttctgtttttattatttttttttatttctttgctttaaaaaaatgaaatttatacacaaacacaaagaggattcgaacttgagaccccctttttggtgactaactcacagaccactaagacgaaaaaaccaacttaattgtacttggagcccaaaattgaatcgccgtgtattgtta

SEQ ID NO: 45048 - DNA, 919 bp, Heterodera glycines
cgatactaattgttctggaatttttttctcagcgcatttcttccgtgaaaattttggaaaaatggctatctctttttctggtctacagtcaagggaattccaaccgcattctcagcataatgacgccgatactaattgttctggaatttttttctcagcgcatttgatcgtgaaaaatttggaaaaatggctatctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcattctcagcataatgacgccgatactaattgttctggaatttttttctcagcgcatttgatcgtgaaaattttggaaaaatggctttctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaattattttctcagcgcatttgatc

SEQ ID NO: 45049 - DNA, 1006 bp, Heterodera glycines
tacaaaatttctcgcaaaagagagatacacatttctgtgacatagagaataaatataaatattccctgtagaatagaatgcacattgctctgcgcccctctgcccatgctgggaacatttgtatggtacaaaatttctcacaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctgcgcccctctgcccatgctgggaacatttgtatggtacaaaatttctcacaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctgcgcccctctgcccatgctgggaacatttgtatggtacaaaatttctcacaaaaaagagatagccatttttctggcatagagaataaatttaaaaatcccgtgtagaatagaatggtcattgctcctcgcgcccctctgcccatgctggga

SEQ ID NO: 45050 - DNA, 1005 bp, Heterodera glycines
tgtgttggcgttttgttttttacgccaattattttgccttttttttcgttttttaccatccatgcttaaaatccggtcctgtttattataaaagattaattttgattaaaattgcaaaaaaaaagatatgcatttacaaatttgtcatagataaaactaattcaattgtccttataccaaagtgtaccatgaaatttatatgcgcatataattgacatgcctaggtgatgagaaccatttttaatccaatctctttttattgaattcatttttcagttggaaccaccaccatcacaaagtgtatgactggacgttttgagagttgcggatcgatcacaaacggagcagcttacggctacagacctgctcatttcactgtttcacggaggatttgtgcaacggcgtaatcgccatgaagccagccgccgttggctgtgccgttttggtcccattgatcattagtaaggctggaaatctcctagattctaaataatctataatttgttattttacatatttgtgttcaagatttttaattttcttaaaatcaaaaacaatttttgaaaagtatactccaaaaacgcagaaaagtttctttttaaaattagctaaaggaaatggatattttttattcaaaataaaaataaaaaatcatttttctttatttcactttatgtagctgcacttggctttttgttctgattgaaggaagaaggaaggaagaaaagaaggaaagagaaagaaatgtcatagaaaaagcaaaaaaataataatcaaaatgacaatttatgtgattatgaccgcagcaacactcaaaaattaaacttttatttttttaaattcatataagaaaaaaattaaaagaaaaatttaaataaaaagttacgaaatatgtgcgaaaaatatttaaaaaattcaaaataaataaaaaatatttacaattttaatatagaaaaaccggaaatatgtaaaaaaaaataagtaaataaaagtaaacttttttca

SEQ ID NO: 45051 - DNA, 969 bp, Heterodera glycines
catacgcaagcgcttttgtgaggtataaatttctcaaaaaaagagatagccatttttctgggatagagtataaatttaaaaattccctcaaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctaggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggataaactataaatataaaaatcccctcaaaaataaaagggcgattgcgcacagccctccctatcatacgcaagagcatttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaat

SEQ ID NO: 45052 - DNA, 1127 bp, Heterodera glycines
  misc_feature (89)..(89): n is a, c, g, or t
  misc_feature (981)..(981): n is a, c, g, or t
  misc_feature (1102)..(1102): n is a, c, g, or t
atccaacattcagtgtacaaatttgttaaacttctcacattttaaaatcaaagtcctaataaaaaatttcgttgaatttcttcgcctcnttatttgtgcaaaattttcgaaaaagtaattttctatgtaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcaatgctgtgcgaactctttgtgacccctctctgactctgccaatgcagcagtttacaatttttaccactatttttctctcactcatcgtctgctcgtctctcctttattataagctatttttccaaagccaacaacgcccttttctccctcttttctgttagtcatttctcattggtgttgacgatccaacattcagtgtacaaatttgttaaacctctcaacattttaaatcaaaatcctaataaaaatttcgctgaatttcttcgcctcttatttgtgcaaaattttcgaaaaagtaattttctatttaaaattaaaaaattcagaagcaaattcaagaattttttttatttataaatgcattttttaccacatgaattatgtttaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcanacttgggtaattaaaccgaagaaagaagtgcagtggggaagaatgacgcccaaaatgaaggaaatattcgatgctgtgcgaactctttgtgacccctctctgactctgccaatgcagcagntgaccatttttacactattttctct

SEQ ID NO: 45053 - DNA, 953 bp, Heterodera glycines
aaatttattctctatgccagaaaaatggctatctctttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagagggggcggagagcaatggccattctattctacagggaatttttaaatttattctctatgccagaaaaatggctatctcttttttgcgagaaattttgtaccatacaaatgttcccagcgtgggcagaggggcgcggagagcaatggccattttattctacagggaatttttaaatttattctctatgccagaaaaatggctactcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaaggcatctcttttttgcgagaaattttgtaccatacaaatgttcccagcatgggcagaggggcgcggagagcaatggctattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaaggctatctcttttttgcgagaaattttgtaccataca

SEQ ID NO: 45054 - DNA, 1019 bp, Heterodera glycines
atcaaaaaaagagaatagccatttttctagggataacctctaaatataaaaatcctctcgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgatgaataaaaatggcgattgtgcacagccctccgtctcatacgcaagcgcttttgtgaggtataaaatttctc

SEQ ID NO: 45055 - DNA, 624 bp, Heterodera glycines
atttaatgtctacttctagatttttatgtctaaaatttccatccctactaatagcatattagtttaatgatattaaaacataaggttctatccgtttttgcgtggcaagaaagccgacggcatacaatctaacaaaaagattggatggaacaatttgtactgatgggatcaataaaacccaatttgtttttcccaattcgatcaaatttgaaatgggcgatgaatttacagttaatgctgcgaatttggacactaatgagggtctgaaaaaggctatgttattataatattttaattaaaaaatacatgagtgaatttaaataaaaaaccccttttaatttttttacagctggagttttgacattgacttcttatgacgagtctgcactgattcgacacaacgacaaagcaattacttatgaattaacagaaattgaatatccataatatattctcattctttaaaataattcatgttaaaatgatttatcacagcagagttttcatcaaaaaaataatttaattatttttaaaaaactctgttaaatttttttatttgtgttttttaacacttgattccattatggaattttttttttgtatggaataaaccatttataataa

SEQ ID NO: 45056 - DNA, 855 bp, Heterodera glycines
tttactaatttttttttcacccatgacccacggattggcacagtgttgcgcgcacatgaaaaagcgggtgccattgttgcggcaattagtgccctcccattgcattggtggcacaccaaattggcatgggcggcgtgctcacttcataccccgttcaggtacaattaataattcgactttttcctttcattttttgccccaataaatttgagaaaaaaaatttttttaaatggtgcgcccatctgaggcctaacattataattctgaaatttcagtaaaagttccattttctttttgcataagaaaatcactgacgcttgctgctacgcgtactccgaccagcacaaaatgcgcgtgcacaaaactgtggtgaccagccatggatgggcctggtgaggcaaaaataaaacaatttaaattaaaataatgaattttcaaaataattttgataccaattttttagatagtttttggctgaaaattaggtaatacttccgatggttgccccccttttttaagaaattttttttgttttcaaaagttgttgaaaacaggttccaggtgttcggggtcactgatcacgaatccggcatccctttcgaccaattccgaatcccggacccaaattcgaacaaaaagtttaagctcaaattttcgaattttgcaattttgtttcaaattttgttcaaatacacagaaacattcccaaaacataaatattgcaataaaagagcatttaagtcatgtttgaaccaaaaatgcgaaattggaaagtattaatttttcgactttttgttcgaatttgggtacttgggagagtttgggtccaccatttttggttaaaattttttcaac

SEQ ID NO: 45057 - DNA, 1141 bp, Heterodera glycines
taacttatttaattatcattcataatcatgaaattcttttaaatgggttaatattatctatcagattaataagggatcatataaataaaatacaaatttttgtccgtctgattcacattaaataaaaacaaattatttgacgttaacaaattcatttattgtttcaattgaattatttgtcttcttaattaaaggaaataaattaaacgactatatcaatttaggtaataaaataaatattagatattaaaaaaataattaaacaaaggtaattcaaattcaaccaaatatttattcagcaatatataatataacatcaatatatatttatagcaacaattctaataaaaactaaatttatatatttcaaacccgataaattactactagttaatacagggattcaaaagaaggagcatgggaaaaataaaataattaaaaaattatggaaatgtaaaagtattagaaaaataaaaaaataatatcatattgaatttaacgatgtttaaagttacccaaattaacgaccaaaataataattttcttttgaacacgaaagatattgtaattaaattaaagaattaaaaagaaacaaaattaaaataaattcaataaataaggacaataagacaacatatagaaaaaatgattaaattaataaattaattaaaactcttcatatgatgcgataaatgataatgataaaagggctctttaatcaactcatattcagtaattttcaaaatataaatcatctcagaaaagtaagtaatttaaaaatatatatataattttatgtaatttaatttaagaaaaagtagtttttcctttatcatttttcgtcatcatgttatcttttttcaattagattcatataaattttcgaccttcgtggcagctttttttaataggttttacactggtctaagtccgatacaagttctctaataaaaccatttgaacattctgggtggattatctattaattttatattaatttcaatttatattcattgtattttattaaaaaaatttaataatattttttataaaaaaagttgtcgaattttgtaaatcaatatattttggacgcagctaattaattgatattttaagattttccagggagtttgttttaata

SEQ ID NO: 45058 - DNA, 1577 bp, Heterodera glycines
  misc_feature (43)..(43): n is a, c, g, or t
  misc_feature (113)..(113): n is a, c, g, or t
  misc_feature (1424)..(1424): n is a, c, g, or t
agtgcgtttgtgccttttcagtgtgcacatgttacagacgcanctgttcaagcgggtgtcatttggcactcttacctcatcttttcgctcgattacacgtgacgaaaggaggntggtggaaggcaatataacaaataaatatagccaaattgaaaataaacgcataccaattccaaggggttgcccattccgagaagacgaaccaccaagcggtacttaaccgactggcccgcaactgttgtgaagcgcttgcctgtttggccggctttcgtccggacacgccggacaatgatggagtacaaaaaaggtggttacttacaattaggcaaaaaattgctgaatttatctccattatgataccgtttaaagtttgcgtgccatgctaacgccattcatttgccgtcaaatgcaattggctcggattgctttgcccgttaatgttttacaatttggtgatgacgatgaaatagcacagaatgtaaagcagaaacaacagccgaactcatcagccaaagctcccaacggcggtggtgaaagtgcaaaaatatacattatatttttaaaatttatcatattaagggcaaaatggggatgaggacgaagagggaatggcgaatgccaagcccaatgttgaacagtgccgtaatgattttgtgttgaaattactcaacgcaaacaccgaagatccctatctgatttgggacaactccactcgtgctgaactgctcgattttgtggacaaacaaagaaactcacacgagaacgtatttaatttaatttaattcaaatttagtaattcatctttttttatctagagcgaaatgtttggtgccgaattcaaactgagtatttacgcaacagaattggtggttggcgaaatattcgtgcgtatttacaacgctcaaccggaattcagactgctggtatttttttaaaagtatttatttattgccttaattacggtaaaggaaccaaaacggacgtgcatggactttttggactatctatctaaacatgtggaggaacttcttatcggtgaaggcgtcgttcgacctgcggcagtgaagcagaaaccgattaccaccccgaaacccttgaatttacccgcaagaccagcagggtcctcattaaacggaaccaacattgcaacactgtccaggcccaaggtacgtttagtagtaagaattggggaaaggataggaccatcaatttaaaaaattaaatgaggaaatgatcaaaaagcatctagtattttttgtacgggcggcagggcattagcgaaagcgaaaaaacaaatcaatgagaatttggtattgactactatactaacctgtttatttaagccggcgaaaaccgaagaggccgatttaatagatttgacaaccgaatttgtggtggaagaagagcatccggctgtcgattgnggacggtttgccaatgtcaatgcttccaacccggaaataacgacgcattcttccacttttggcaccgttaatccaaacggtgctttccggggggtcgctttctctccagggatcgggtttcggatggtgctcgaggcgttgcgtattgtgctg

SEQ ID NO: 45059 - DNA, 761 bp, Heterodera glycines
gggtgggacaagtgtcattctgtcaagagagccgtttttacgatttaagcatcaaaaattattattccaaatctcaccggcattatgccgggcaaatccacgtattgcaactcgatgttatatttgcgcaaaaagaaggccggcatggacaagcgctcgggcggacggccattgtcactgtccatgtcgatggtcaactcactcactggcctatcggtcagattgccgagctcaaaagtgcgagtgcgacggtagttcaactgtgacagtaaagtatttcaggatatagttttttgcataattaatatacaaaaaggaaatagatttggtacttttcggtttcgtgtatacacctcaaaattttcaaaaatatgcgaacaaaaaatgcactgagttttttggtcgcgcaaatgaataatttgccacaagaatacatgaggtttttgcaattttaagggtaaattattccatttgtgcgatcaaaaaaataaaattttttgagagtccaagatcccgaggcctttttggagtagtaagcttttttagaccttcggttatcccaatgtatgaatcaccataacccaaaacagacgaaacctcgacgcgaacatctttgatcaccgtctcgacctcggaccagtccttgggagtgaagtcgcgcatcgacggacgcccgccgttgcgacgctgcggcagtatttccatgacagtgtccaccaaattctttgactcgaagaacgccgcaactttggctaaaaatg

SEQ ID NO: 45060 - DNA, 973 bp, Heterodera glycines
aatgttcccaataaaataatcgcatcgcttgaattcctccctagtccgtccagagatctcaattagcaaaacaaatgaccttcaattaatgttattttccatcgtaaaaaagggggtcgtcgtggagggaggtgttaacgaagggggaaaattgaaaatttgcataatttccttagcgaaacgcatacaaaattcaaaaattttcgcccgcccgccaccccttcaccaaaagtttttggaaaaaacgcgccgcaaaaaaaaggtactttgaatagcaaaaaaaaaaaagtcgacgccggatggaaaatcggtcccgagacacccccctgtcccaatcgtccggcgtatggcccttgggctgagacaccccttgtacatgtatgataattcctcatacccattacattttagtccattctctcctacagtgtcaaatgccaaacaaaatgaaacaacatgccattggcacggcacgcgcgccgcaactccgtctcgcccccgggggcggaaacgtcggccagccaatgccattctttgccggcggcgtccacaaaggtggagtggtcctgttgaagcacacgctcaatggtctccataacagactctgcaaaaaaagagaaaacaaaatgaaataaattgcaaatatcgtaattaatgatgtttgatcaatggacctgccgatgaactctgatcagtcgattgcccttgcatgggaaatgcttcgacagtgatcggcggatggttgtggccaaggctctggaagatggcccgttgttggcccacccaaatggcacggaaacagcacgagagagaggcgccgtaaaaggcacagcccaacaaaaaatttctgaaaaatatttgaattttttaaacgccttaactgcgtttttggctcccgaacatgcatacagtaaaaaatgcgtcagtgatacagtatttgtaaaatagtacaaaggtcaaaattgtaaaagaa

SEQ ID NO: 45061 - DNA, 1000 bp, Heterodera glycines
tttttaaacaggccaaaaagtttaggcttaactttttcttcactagctgatcagaagcgcaccaaactttgcagggattcttaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtacttttattctgcgttggatttttgctccccataaatgtttgagtaccccaaaacgacacttgaaaaatcgatttttttgtttcataatatttttt

SEQ ID NO: 45062 - DNA, 1580 bp, Heterodera glycines
  misc_feature (146)..(146): n is a, c, g, or t
gggccatcccatttttggggtatttttttggagtcctcccccgggggcttttataccgccgaagcgcttttacctctctcagcaggcgcctcctcagtctccctctttgactcacctccgttccattgctcctttgtccgcccagnccgatgaaaagtctacaaattgcagaaccatccggtgctaccagtagcgcggccgtgcgcggtggacgtgctggtgttgggactgggcaatttgggagggcagatggggaacattgggaaggaactcataaactcccgaaggaagggccccatgggatgatcaagcccagggatcccatcccgcctttgatggacacactgggataagtggctttattccggagagactgaagatacttcgcttgaaatggcgaacattaaatacacgtgaaaaaggaaatgtgatcgatcaattatcgtcgggaaaggggcgacaataagcaaaagggaaattaaatgcgaaatgaaataaatgtgagaatgtgaaattcatagggcttcggccggcaaacaagaaaacccggatctaccttacatgaattagttttgttgacatatcagcagagcagggagcacgacttttacgggacgccaagcaccattatttgctcggtctgtgttgtaccatcctattctgtaacaaactacagaacgggtcttaaccccgagctggtcaagaaaacttgtgacggcattgttgtcagaaatggcacggaaagaaggagtctccgactggttttcaggaagtccggtgatgactacagagcgacgtctttccatctccgcagcgtagtcaatgtctgagacagagttattgacgatggagacggcaattttcagtagattgttgagttgtgaaatgatggcacgggcagctggtgaaatggtctgttcgtcgtcaagtgtgctaatgtccaaattcattgaagtaacttcgtcgacgaactgttgacgtttttgcgggatttgattaggggaattagaaatcaaggggcgtttaagaaaggactgcgacatatttgaaaatctcaaacttgggtaattaaaccgaaaaaaaaaatttggaacgcttcacgaatttgcatgtcatccttgcgcaggggccatgctaatcttctctgtattgttccaattttagtatatgtccatttggaatgaacaaaattgttgctaatagtgggcgcttctgcattgagcagccatgtgcctcagaacaataatctaaaaaaaaaaatttggaacgcttcacgaaagccggcggaggggactgataaattaaaaatttttttttttttttgtcaatcgcgtgtttatttttaaaaagttttgtgctgttataaaaatgcaaacacatggatggggcggggcaggtggtgggtgggtggtcattattgtctaattaacattgcttttcgagctcctcgaaattttcggtctcgaatagcgctactaatttgcccgcatgattgggtgaaactgcaattaatttcgatcccgccaataaaaaaaagtacgctctgatcttaaattttatttgaaattatcaaatgaaaa

SEQ ID NO: 45063 - DNA, 1044 bp, Heterodera glycines
  misc_feature (29)..(29): n is a, c, g, or t
  misc_feature (58)..(58): n is a, c, g, or t
  misc_feature (1019)..(1019): n is a, c, g, or t
ttggtccgatcagtcattaatcaatcacncgatcaagaaatcaatcagtcctcacacncctgcctgaagagggtttgggtgagaggcggcggacagcggaggatcaatcagttcaagccgaccttctccatgctgactttgaacaccacgtccacgcacgactcgaacacctgagcagaagagggaaggcgcaaatgagaagaaaaaggtgcattttgtgcaaagaaaattcccataaaacttcaattaaacaattaatcaatcactgatcagtcaaataatcaatcactgatcggagtcactcgcaccttcaatcaaaaatacataatcaatcactgacaaatcaatcaatcactgctctttcatttaataatgactcacccaatgatcattcaccattgactcattaagcactcaatcacatcattcaatcactaaccaatcaatcagtgataattttaatcattaatgaacatttttacggtaattaattcactttcgttcataagtgaacggtcgttagactgatcatcgttcagcaataaattctcgctgatcaattggtgtgttaatctccacatcaatcattgactgaaattcaattagtgattctgatcatttaatcatttatgatgattcactcactgattaccatcattggcaataatcactaagcaattatcattaataatcactaattattgatcattaggtcaatcaattaccactgatcaatcacgattacttatcattcactgatctccaatcactgatcactctttgattattgttgttgttgcccctcatgccttgtccacgttgcgcgtgtctgttgcgtttgtgaagtgcgtgtagatgggcctgtgctgctgcaactccgacgaaacgatggcgtggaagcgatcggacacgtaattgcacgaggcggcaaattcatgctttcctaagccatcaaatggttgttcgttggttcgattgatctgtccttttgacccacagaatatcccttgaagcaaacngtcaaaggaaagacggacaatcgct

SEQ ID NO: 45064 - DNA, 993 bp, Heterodera glycines
  misc_feature (21)..(21): n is a, c, g, or t
tgcatattttggctttgtgcncaccttgtttctcaagccatccctgcttctccgactgttgaaacaaagcggcagagaactgctcttgcaaattgtcgtccggaaatttgaaggcttcggagcgaatggaattataaatgtccttaaattttagaattaaaacatacagaaaaggagcattaattctgttttttaaacaaatttgcgataatttttatagaatcagccatttattttttaaatttttatttgttcatattaaatgcccagcaacaaaaaatattgccaaccgtaaccagtgccggcggaagattcaatgaattggtaatgtttagaaagttgtccaaactcatgcgctcctttacgctcggattgtgcagcgaagtgtttagcattattatggcgtagcaaagggtgtagcaattgtctgaagaaaaagcaaaaaattatattctgctcgtagtatgatgccaatcttcaaaaataggtttttatgctaacattgcattaaaatagaagttaattgcaatttatcaattttgaaactttttttaccaaccttgatgctcaaatatgcccgggttttggacatggtaatgccccgaaaaatactccatgatgcgttcaatttgctgtgattcgcctggcaagcggaaacgcgacaaaaacccacgcattgcctgcaccaatggcagcgaccgaagtggttggagacgcacaaaatgttgtaggacttccaaattgaaatcgtccttctcgccaaggaaatcgccaattgcggactgaaaaaggaaaatttataaaagatattgggctaaaaatcagacattcaatatatttacttttttgattccatcacaggtcagaaagaaatttgcaatgtcttcagctgaaccgttgaccagcccagctttgaccaagtccctcaatccctgccgttggttctcattaaacttcttcttggccaattctcgggcttttcctttgtacttg

SEQ ID NO: 45065 - DNA, 1030 bp, Heterodera glycines
  misc_feature (66)..(66): n is a, c, g, or t
cgagaaattttggcgaaaaaatgattttttttgaaaaacttttaaaggctttgggctcaaaaaggntaatttagctgctgcgtgcccttctcatagaggtttttttgaaaaatgctaaaatatggaaataaaatacggataaaaatgccaaaatatggaaaatatggaaatatggacataatcgcgaaatatggatatggaaacccatcctagaagcttcaaaccaagctaaaaacatgtttttcgtgcgtttcagaccctcaacagtccaggaaaaaatatggatatccatatgattggcatccctaataattagagtctcatcgacaagattatttcaatttgtcttccttcttcttttgatctttatctttcataattcgtcattatctatttgacttcttgtcaaaatttgccgaatgatctacaacaccactaattttatcagtagcatttttgaggaccaatgtgctaagaaatcgcttaaaattttcaactatcaatttatattgttgaaaatgtgaaaagcaaaaatgactgaaatagtgcttatggttttttattaacattaaaatgaagaagcaaaaattaatgtttttcgagcctttaatttagtcctttattaatgaagttttcacaaaattttcaaaatacattccaacaaatgaaaaattcaattttggcagtttttactccaaattttggttcatatttgagtttttagcccataattttatgtccacatttagcgtttttttaagtccatataattcacaaccctatgtataagcaaaaaaatatataatatttaaataaattcttgtcccatcctaaaaattttcaaaaaacccaaaatatttgagtttgagttcgggatagtcagattctgatcatcattctcgaaaacaccccggcggatagtgatttttaaccaaaatataaaagttaaattagggaccacaatcccgcaccattgtaaagaaaatgacatataattatctaaaatgaaaggcaaattaaaattttggtg

SEQ ID NO: 45066 - DNA, 1116 bp, Heterodera glycines
taattaaagaaatttgtttgaaaattttcattattttaattttgctttaacttttggattttattaaataaaaaacaaaataaaaattttattttgtattattttcacttgaaataaattaacatttgaatttttttttaatttttgaatttttaaaatttcccggttggtcccggttcccggtcccggcttctcaggtcccggcaagtcccggtcccggtttttgcaaaaattcccagtcccgtggcactctactctaaattctatggagcagcgagggccaaattgaattttttggccaaaaaataaaaattaaaatgatacaactatgacatagtttggcagtgaattccctcaggaccaataaatacataaaggccccccccccccccccatatagggggaggccgctggggctggcggaattggtcttcattttccacaacaaaagttcatttttatgcataagaaattaaaaaatttatttttattttttttcgaaaaaagggtgcattaaatttaaaaatcaaaaattttcaaactttattacctaaaccaaccatcattttttcttttgcatttttgcactttttactagcgacaacaccaattcaatcgtttgttgttgtgtttgctatgatatgatgtccattatatttgccagtctttcgcaaatatattctcctctgctgggggtgaaaatgtgtgggaagaacaaacagcattgtttatgcccaagggcttacactggggttttgctgtgttgctgggatgggatgtgcaccccaaaattttgaaaaaatcgctaaaaaaattttcaaaatttttttttcttgaattttgtttcgaaaaattctgtctgaaaatgcagaaaaatttttttcagggggccagtgaccggttggaagaaggaaacgaactgctccccgcctccccccccccccctcaaaaataatttaaacattcttggtgttattccatagctccatgtttcataaaaaattatgaaatagtactcaaaaaacttattttttcaaaaaaatctttttttcgtacatcaacaattttaatttacaggctcttcacctcctttcctttggagctattttaaaattt

SEQ ID NO: 45067 - DNA, 907 bp, Heterodera glycines
  misc_feature (550)..(550): n is a, c, g, or t
  misc_feature (580)..(580): n is a, c, g, or t
  misc_feature (590)..(591): n is a, c, g, or t
  misc_feature (606)..(606): n is a, c, g, or t
  misc_feature (608)..(608): n is a, c, g, or t
  misc_feature (614)..(614): n is a, c, g, or t
  misc_feature (636)..(637): n is a, c, g, or t
  misc_feature (683)..(683): n is a, c, g, or t
  misc_feature (692)..(692): n is a, c, g, or t
  misc_feature (695)..(695): n is a, c, g, or t
  misc_feature (697)..(697): n is a, c, g, or t
  misc_feature (703)..(703): n is a, c, g, or t
  misc_feature (709)..(709): n is a, c, g, or t
  misc_feature (719)..(720): n is a, c, g, or t
  misc_feature (731)..(731): n is a, c, g, or t
  misc_feature (746)..(746): n is a, c, g, or t
  misc_feature (749)..(749): n is a, c, g, or t
  misc_feature (766)..(768): n is a, c, g, or t
  misc_feature (775)..(775): n is a, c, g, or t
  misc_feature (780)..(780): n is a, c, g, or t
  misc_feature (782)..(782): n is a, c, g, or t
  misc_feature (793)..(793): n is a, c, g, or t
  misc_feature (795)..(796): n is a, c, g, or t
  misc_feature (799)..(802): n is a, c, g, or t
  misc_feature (805)..(806): n is a, c, g, or t
  misc_feature (814)..(814): n is a, c, g, or t
  misc_feature (816)..(816): n is a, c, g, or t
  misc_feature (818)..(818): n is a, c, g, or t
  misc_feature (835)..(835): n is a, c, g, or t
  misc_feature (846)..(847): n is a, c, g, or t
gggaataaataaatgaaaggcaaaaatcggtgccgcattttcccattaatttgcaatttcattttatttctcactttccgataaaaattatgaaaaatgattcatttaaaaaaattaatttgagaaagtcaaagtgataaaggaattttgaaaaaatgccaaaaaaaaattgacggaaaaaggcattaaaaagacataaaatatttcgaaaaaaaaatcagaaatattgtgaagaaataaataaataaaatattggaactttctcgttgaagaactaattttgaaccttaaaattcatttcaattaattaaaaagggagtgatctcgaattcgatttacaggcaattaatcgcatggatacaaatatttgtttccgtatccgccgtttttatacgtgccaagttgaggccgaatccatccggtgatacccgcggatttatccgtatccaaattttttatttgtctaattttgtatttgtaaccaaaagcagacttttcatagttaaaataaatcctgaattttataaaaaatatttattaatcgaaattnttttcaaatccacttacaaattaattatcnctttctcttnnaataaaaactttctnantatttncttaaaataattaaatcctttnntaattaaaattaaatcccataaatccaattttaaaaaaacattttnaaataattnatnanaaaacnaataanaaataatttnnccataaaaatnaataaaaattctttnaanaaacgacatccaaaatnnnacaaatnctttntncactataaaancnnatnnnntcnncttcttcncncnttctcctccaagggccncccctaaaatnncatcccttttcattttctagtaaggatggcatttattctgatcacttctgtggtaacatg

SEQ ID NO: 45068 - DNA, 902 bp, Heterodera glycines
ggggatctctagagtcttcttctaattttggctaagtcatatggctggcctctactaagaaaagctgttaaaccctgagaggattaaaagagagggataaagtgaagatctccgccgttggtcatttaaatctccaaatttgctgaagtaagtgaaaagaaaaggcaaaggagctttgaaataagaaaaagaataattaaagaaaagtgtgtatttatttattatcaaaataaacttcaaagggacgcaaaagtgcgggcggcgggtggcgtgagaaaaaaggacggacgcagggcgaggggggggggggggggggaataactaaccactattctcaacattaaaaatatcattaagtccgtgttaacttgcattgcaatagtgattaaatttacttattctttacacccatatttttgtcacttcatcataacaccattatggatgatcgggagagacaaagtgaatggaatacgacaaattttgaataacatttccctgaattagagagcgaaaaaaatgttgaaaaaggaaaaaaacggaaaacatagacggcaaacgagtatgattatcctacacttacagcgaaataaaaaattgaatttttggtgccagtacattttaataaatattgaaaaatgaagcgcgaaatttataaaacaataatagcgcgagggccataaaaagatcaaaaaatcccgcccgtttaatcggtttatgcacttcggcattttatgtctcgaaatgttcttacaaaagtgccaaaaagccatttacaaattatagcaggtagaatgccattgttgtgcttttcaaaatgtacattgctgcttcttttttctatccatcccattttacccaatttcaaacttacacacataactaagtaacaatttgttaca

SEQ ID NO: 45069 - DNA, 641 bp, Heterodera glycines
caaatactttctctttttggttggtctcatcctttctcgtagaaataaaatggggtataaatgcaaaagaaaaatggaaagagaaagagagagaaattggaagaattttgtattttaaatgaatgccaatgccaaagtcaccactccctttcctttgttcgcttcccctcccccctccccctcgagatgttgtcattaacaggtgccggaattcattatttccactaaatcattagcatatccatcaaagaaagtgccacactcactcaatcggcggtgagtgaatttggcattttcagagagggcaaagggaagcggaggaaggcaaatgggggggaacggtggaggagggggggggggagagggaaaagcccgaggggagagggcgaacggattgaaaaacgaaatgcataaaaaaaggaaaaaacggaaaaaagtgaataaataccaaaatgaacataaaactaattagaattaataatttgtatccataggaggaaactgacgaactgaggttattttacacttgctgatagtaattaactagcaattaatttgatggattattggagaatgaaaacacgcagaatgaaagaaatgaggagccattgtttacatgggagaacgaaagcgttgatgtg

SEQ ID NO: 45070 - DNA, 488 bp, Heterodera glycines
ggagggggccgaaggccctctacgaggccgcgaagcggccgagcgacttccttaagcactatgccaaaggcccgtacgaggccgcgaagcggccgagcgagtaccttaagcgcggggaaaccccaatggccccggctggccccggtgttgaaagcggccccggcgctttcacagggccccttggggccctggttcactctataagggaaaaatgtaacttgaaatgactttttttgaataactctcttcaagttggtcggatcggctccgaacaaaagagtacaactattttttaaggattctctatcgaatggtgaaaaccattttttgaaatttttacgtaaaaaaaagtttcttcagaaaatttttgaaaattttcggaaattttttgaacgggtcacggtcgtcggcttctagcgcgatggatgttaaagatagcgtcttgggcaaggagaaagggcacaccttcacattttggcgcttctaat

SEQ ID NO: 45071 - DNA, 736 bp, Heterodera glycines
tttattctgcgtggatttttgctccccataattgtttgagtaccccaaacggacacttgaaaaaatcgattttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttccggagtagcttccctatagcctgtactttatttctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttt

SEQ ID NO: 45072 - DNA, 1280 bp, Heterodera glycines
agcgacaacgatcgcatgcctaaccaactgacaaaattggataattagagaagcaccgacagaagaatgaccttggggtcggtgtaccccgaacgttggcagggcaattcgaacggacaaatgccttagagggaaaagaggcgaaaaaagggggagggaacatcgtcgaaattaaaggcgtactgtgacagtatgccaaattcatctttttgacgtcgttgaaggacaattggaagcgttgtccgatggtgttttggtaatttgggttcaccgtttggaagagtttcctaattcgatcggttcgcgaattttttgccaaatgactgaccgaaacgtcaaaggtggtctcttgggattgggaaaagcgagtgaattggttaaggaagccgagctgaatgtttttgggctgaatttggacgaatttatcacggtcaaagcgcgactgttcatggaaataccgagagaatgagctgagaaagaattgccggattaaaaaataaattttaatttgcccaccgatttcatgggacacaacgaaaggattgtcacaacgcggcccaatggacactttttgggggtgtccgtcgcgcaattggccaacggtcgaatagcaactaattttgttatatttttgttaattatgcccctcattagattaacaaatttctcttcttttattcctttggaaatgacttgccccggcccgaaaaagaaactcagtccgtgccgatcgcttctgagactgtgcacctccttgaaggtcaagcaggtcgctcgtgcccaattcgcaattccctcgtggaccgccgttcgattcactgatcagaaaagggggcggggcattcaatcggcggagaatggcgccgccacccttttggccgatggcgtagggaattgggaaggaatgccatcgttcgctcagtgccgaagtcaaagtgcgtcctttgcgcagcctttcgcttctcatcagacggtggtcggtcagttccgtacaccaaattgtacttccattcagacattctctgctgctgctggccaaatccaattgcattttggcatttcttgaaaaatgaccttccaaagttgcattttttcttttgccattataaacgcccacttcagcagtccctccatttgtccctccgacagtacaatgtctccctcgaacaaatacggaatttggtccgccctttgagtcggcgcttttgccaccgcatcctcaaaatgttccgcggcgcatcgttcgtcccccgcggcacattcctccgccactttcagcc

SEQ ID NO: 45073 - DNA, 1332 bp, Heterodera glycines
  misc_feature (74)..(74): n is a, c, g, or t
ttcagtatcctgcaaagttttgtgcgcttctgatcagttctgaaaaaaagttaagcctaactttttggcctgtnaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcaggaatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaacgcagaattaaagtacagcctatagggaagctactcccgaaggattcggtctccccataaatctgggcgcatcggttcggggggactgccccgaaaacaaaaaaatcgattttt

SEQ ID NO: 45074 - DNA, 1031 bp, Heterodera glycines
gggaaaaaagactttttacaaaataatacccctgggagaagagagtggaaaacatgatttcgaaattttcaatttcttgtactctaatctactcaaaccggttcagaattcaataaaaataacattcacggtgcgaaaaatggggtatgaaaagtttattggggaaaaaaagactttacaaaataatacccctgggagaagggagtgggaaacatgatttcgaaattttcaattttttgtactctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttaaattttttgtactctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttaaattttttgtactctaatctactcaaaccggttcagaattcaataaaaataacattcacggtgcgaaaaatggggtatgaaaagtttattggggaaaaaaagactttacaaaataatacccctgggagaagggagtgggaaacatgatttcgaaattttcaattttttgtactctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttcaattttttgtactctaatctactcaaaccggttcagaattcaataaaaataacattcacggtgcgaaaaatggggtatgaaaggactctagaggtccccgaaaaaaagactttacaaaataatacccctgggagaaggaagtgggaaacatgatt

SEQ ID NO: 45075 - DNA, 1345 bp, Heterodera glycines
tttgtcagctcctcaggaggctatatttagggaatcgccataaaaagaaaaatgatggcatttttatagacgccggggggggggggtcaatgatcgtcatttgttcttacttttgtttgatttcccatccattctttcccccgcatcatttgatcaaaaattttgggtctgatcagcaggggttgatcacctgctgctgctgctgctggttctggcccttctcccccacttgttcggctcgttgtttgctaaacaacagcaggaggaggtggggacgggcgagaacaccacagcaggagacaatgaatggaaatcgcacggcgccgccgccgggggtgcgcgagttttccactccaatcggcgggtggatgggttagggaagagccatcgcaattcgtttttttttgtcagcattttggatttgattatctttggtatttaaaaaaaatcttatcaatttctgatcattaattaatcaatgttggactaatcaagaaattagttgaatttgatcaattaactgatctaaatctaccttctgatcacttcttcctagactggccataccatttattgcatttatgaatctcaattacgatggctattgtctgatcatgcccaaccatttattagtaccttttatctgtttgaacaaataccttttttagcgaacacacacctctagttcaacgaatactatcgtttctatgttttgcttagtcattaatttattacactggagattagttgaatgtgacactagaccctttgggtcactgatttgattctaattaactgatcaatcatttccgttatttttattcttagggttttttaaattcttggttaggtttttcatcatttgtcaatttcgcgattattgtagtcatttctcgattcctgacaattttgcattattttatgagcccgaatcccgagtttttggcattttttggctcctagatgcgccctcgacattttcaatcagtaaacagtaatctccgtaatttccggcttctttggttccctttctaacaaagcggcacagatcaattatttgtgggcacatttacgtcattccccaaaagccgtaggtcggtcggtcactgcgcgctatggctgctgatccttgcataatcccgtatcccatcaatgatcaaagcgcttcttccttaccaacactgccaccactaattatcccatcgcccgccgcagcattgatcaaaagttaacagacagacagagagagagagatggctttcgttggtcccgctgatctgatgtgtcctgatcagggatcaccaccactccattctcctcgccttttcttagaattaaaaagcag

SEQ ID NO: 45076 - DNA, 804 bp, Heterodera glycines
ccccccccccccccccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgcggcctcgtggtgggccttcgcccccc

SEQ ID NO: 45077 - DNA, 1280 bp, Heterodera glycines
ccgttcgccaatggatttctgacaacagcggaaacagtcacagctggcacatcaatgccatcatcagcagaagctgcagcagcagaaagggggacgaacggagggacgaaaaagagacagccgaagggggaggggaaaagtgagcaaaaaaagggggattaaagggaaggcgggattttgattttaaaagccaacgaaagcattgaattgccaaattttgaaagggagcaaaagagcgacgcagagatcggcacaacaacaacagcagcagcaacagcagcaaatgcaaccgccacaactgtcgattgagcagcaacaacagtacaaatggatgcaagtgaaaagagcgacggcaacgccccggggaatgccaacttcgccgggaggtaaaaatttagggagggcggaaaagaatagccgaaaacttgggggagggagcaaagaataacatttgacacttcgcgtccccctaatgagtgtatgaacggtcgtaaatctttctgcttgcgaagggaggggaaggtcaaactcagcaccccccaaaaaatgccaaggcaaaataaaaatacgaaggattttcagtggcggaacagcgagaggaacagtcgcgccaccggggacgaattcgcgggactgaaagtgccgtggcgggcggaaaccgaacgaatttcacttatcaacagctaacggaactcgaaaaggtaacgaacggcacaaacagagagagaggcaaactcatgaaaatgcattaaggaattccatacgaacaaatatttgaacaaaacgcgacgggcggagatcgcaaacacattgcaactgcaggaggcacaaatcaaaatttggttccaaaacagacggatgaaagtaaatcgaatggcattttgggaggggggggggaaggcattttgataaattatgggtttaaagtcgagaaatgggcatggatgggactgagcacttttggcacttttttgggtcgtcggatggaaagtccgcaggaaatattgtgctgacaatttaccgatttttttagatgaaaaagcaaaagaaggagcacgactttctgctttcctcctcctcctccaccgccgccgcttcgctttggccaaattcggcggcttttgccaacccccacccgccctcaagcaatgccaacaacagttccgatggtctctctacggcacaactttcgtcgtccgcctcctccgccgaggggccgtcgccgtcgccaaaacggcactgacaaaagcattcattttggtgccgcccattctctctct

SEQ ID NO: 45078 - DNA, 992 bp, Heterodera glycines
  misc_feature (171)..(171): n is a, c, g, or t
  misc_feature (178)..(178): n is a, c, g, or t
agatgcgtcacgtcaatcggctgctcggcattttgcagaaacaaaagaaagtggcggcggcgcattagttcaaaaatgatcagttgcgctgtgattttaagggaaaatatacaaaattgaagcgcatcgcttaaaaaatgcaactcccaaaaaaaaagacttttaaaaacncaacccncataagtttaatttttctgaaaaatttttaaatatattttttcgaatacaagccatcataacagatacagaaaaattggttaattttaagtgcaatttgttctaaattgaaaaaattgcctacttttcgattttaattagttatttgaatattttacgcttatttcctgtctattttagggtggttttcttatgtttttttgcctatttcgctatttttgtgcctaaaaatcacagcccttatgatcagtcattgttataatttgccatatttggcggttttttttaataaatttatttaataacaaagaaaacaaaaattttcacacgttttgccattctaaaatagcataacttaattaagttaaatgtcacaactttattttattcatgcgttctccccccccccggcaattcttttttttgtttactccggccgctcgacttcaattgacaaaaatggaaattgcctctctggcacttcccacgccattcattccatcattctgaatttcggcaaatttgcgcatatgacaatttaaatgttttccggcacaaaaataacacacaaaaaatgccaaaagtgaaccccccccccccatcaattagagaagcgaaaaatgctggaaaaggggcagaaaaggcgaaggaaacaattaaaattagcagggaccaaatttaatgggtttataattgtatgggtttcttaatttaataattttttacgtggttccaaattgccaaatagtcttaaattaatgcatgacatttattcttcgccataatggtaattttgcataatataaatttaactt

SEQ ID NO: 45079 - DNA, 1014 bp, Heterodera glycines
tttgtagagcccatcaaacacattgtgctatagggaaaggcagaattatacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggtgaattaagtatagaaggcgtcgcagaaatacattcatattttctaaattcgggtttcagaaaattaagatttaaaagaggctgaattacagatgcttttcaaattttgggtgtatacgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttccaggtgggggtagagaaagataggttacacacgaacattttatag

SEQ ID NO: 45080 - DNA, 464 bp, Heterodera glycines
ttttttttttttttttttttgtttttttttttccccccccccgcggcaaaaatattttttttttccccccccccccaaaaaaaaaaaaaaaaaaaaaaaagaagaagaagaatagatttttttttttttttttgccccccccccccccccccccccccccccccccccccccccccccccggggggggggggggttgtttgttttttttttgtttttaataaataaaaaaaaaaaaaaaaaataaaaaaaatattatatttttttttggtttgtcttcgccccccccccctctctctcctcccccccgccccccccccccccgcggcgggggggggggggggggggggggggggagggcaaaaaaaaaaaaaaaaaaaaaaaaaaaaaaaaaaaattttttttttttctcctctccccctcccccctccccccccccccccccccccccccccccccccccccc

SEQ ID NO: 45081 - DNA, 496 bp, Heterodera glycines
actcatattttttgctaattgagcagaagcgtaccaacctttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggggggggggcgg

SEQ ID NO: 45082 - DNA, 1613 bp, Heterodera glycines
  misc_feature (1566)..(1566): n is a, c, g, or t
  misc_feature (1584)..(1584): n is a, c, g, or t
atcactcatatcagtctgaacatttaagttgagcaaaccgtacatcgcaagaaaaagcgaagggatcgaaacagcggagaaaggcagcggaatgaccgtaagtacgccctcgtgatatactgtaccaatataaaaataaatgtaaaaaatgccgaaataccgaaataccgtaacccgggcaaccaaaaaagcaaaaatataacagtaattaattccctcatgagcagaacagaggagaaaaaatgttggacggaatttcgatgcaaaagcctctgaaggcgccgctgtccaggagaataacgcccgattttttgcgtgctgtggtgcaagacgggtgcgagctgacgcgttgccaattgatttggtaattcggcacaatgccaaacgatgggaaaagcctttctacttttgaacaaattcacaagaaacaaataataaatgggctaaatttgtaaagaaatcccggggaatgctttttccgcgttttaattgtgaaaagtcagttcgcttttcttcagttatcgcgtcaaattcgatgcaaaatgcggcggaagtgcgggcgctttgctctccgaagcgtttgtccggccgatttcccaggcgcaggaatttctcacctacggacacatcgccccttttatgggcgcttttctcccacatcagtccgtttttggggagttaatccaaaggcatcattcaccgattattgctcatttgtcagatgcgactttatggtgaagaaggaagtgctgaacgaattccgaattccgcccgaattggacgaagcactcaaccgaaaatacaatgggcaaaagggggagggaggaggagaaagggaggaaaaggcagtctcgagaagggcaccaatggtcgagaaaggccaacagcagcagggggagggagaaggtgagcacagccgaagagcaaggacaaccgctaattatggctatcagtttataaacatttgggtcgaaacggatcacgccttagtgatcagaaactccgaaaacctattaattgacgtttttttaaaagtgttaaaaaatttggggcgtaaactgtaaaagggggagccgattctaattgccaatcacacacaaagaaacagaatcagccgatgagaagcagccaaatggaaaagaaaaagtgaccaaagaaactgggataagcggtgaaagcaaacgccagaaacaaaaagcgaaaaatgttagcgcaacgaacccgggggatcggagcaaagtcagacacgtagtgggaagcacaaaacaaaagtaagcattgatcagacaaacaatcaactgacaaatatttatttgaattggaattattttgcatttaaaaccagggtggccaagttttttttatcaaaataaggacaaacgaggctaaaactaagatttggaccccaaaaatttttacgttttgggggcatcttgggcattcacactaaagaaaaggaagtaaaatataatttatttgaaaatcgaattaattaaaagtacttcaataaaaaaaataaagttattcattgtagatttttattttcaaatccaaaataagaacganatatgcacgtcgagccanaaataagaaaaatctttagaataaggaca

SEQ ID NO: 45083 - DNA, 149 bp, Heterodera glycines
ttggccactttttgcaacaaacattcggcatttgagctttcctaatggcgatgatttggacaatttgcttcgtttggtttcaccgacaattctcactgatcttgatcaattgaattcaatcgattccggttatctgtcttccagtgcga

SEQ ID NO: 45084 - DNA, 895 bp, Heterodera glycines
  misc_feature (25)..(25): n is a, c, g, or t
gtttccaaaatattgagaaaaacantttgtgtatttagacttccctagacacaaaatatgtttccaaaatatgagaaaaacacttttgtatttagacatgagaaacacaaaatatgtttccaaaatatgagaaaaacatttgtgtatttagaaaacatgagaaacacaaaatatgttttcaaacattgagaaaacatttgtgtatttagaaaacatgggaaacacaaaatgtgttttcaaaacattgagaaaaacatttgtgtgattagaaaacatgggaaatacaaaatgtgtttttataagttttttctttctttttctgttaattaaagattttttttaggtttttcttattatttattaataaaacagttaattatttttgagatacatcaaatcaaaggacaccttttcaagcgttggcattattccttaaggaattcaatatcttcagcggttgcaccaaaatattcattgaccaaaaagtccaatcaaatttcattcaaattagccctacgagatgaccaatgtcggctgcaaccatttaatttcatgattaatgcaaataaattttgcattcaatatgataggagaaatgggatcaattatatcataatttgaaaaggaaatcacttcgcgcggcacttacggcattttgcactctttcagtcagttctttgccatcattttgccacaattctttttccgagatgactgaacagccccaaaggatgaattggataatagtcaacttgagaaaaaacaaatttttagcttttttaaaatttgtttcatttgtgtaagcatgcaaaattcaagaaatttagtccaaatagaaaattgatttcaccaaatttcacacctcatagcgggtacatatcagggatggcacgga

SEQ ID NO: 45085 - DNA, 1365 bp, Heterodera glycines
  misc_feature (816)..(816): n is a, c, g, or t
ttaacttttttagtgaaaattcgatcactcatatctacctgcgaattgagcagaagcgtaccaaactatgcagggatcttccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgngttttcggggcagtccccctgaaccgatgcgcccagattctatggagagaccgaatccttccggaataaattcactataatcctgtactttactgctgcttttggatgtttgctccccacaatagcttgaggaccgcagcaatccacttcgtgatcctgatgattcccagtcctcagtcccgcattcttgggaatttccggatataagggattactccgcgggatcccgggcagcaacattttgagttccaatcccgcaacgggatctgcactaatttccgcgctctacccagcaccaacgctgttccgggttacccgaaacccgaaacccggtctttttcccgacccgaaacccaacccgatgattttgtgtcgaggtttcttgatcgaaatctgcactggtaagaaggggggaggggtgaatataaatcaggacaagtgataattttcttttgaaacgattgcgaccgaatggaatccaaaaattttgtatttgatttcgttaactatcatccaatttctaaagatatctcttatgaattacttgaa

SEQ ID NO: 45086 - DNA, 863 bp, Heterodera glycines
ctgagtctttcgtttttatttattttttgcaaaattcattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataacttttatccaaaaaatttatttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaatcgatttttttgttttcggggagtccccccgaaccgatgcgcccagatttatgggg

SEQ ID NO: 45087 - DNA, 794 bp, Heterodera glycines
aatcacataatgatttatattttttacaagatcattttacaagttttaagaattaggcgcagaccatttatgtaaaccaaactagcttataataaatacagtatcgcaaacactgtaaaattttgtaaccattttatcaatcgttggcataattaaattttaaatgtcaccgcaatgcaaaaaattgatctcaaaataacatttggctaataatcaatttaaatattttttatagtataatagtggtgttatattaataatttagaaatattcaaagtaatatgcagcatttagtttcatttatatttgaaatattattcattgattaaaataaattttactaaaaattttattattaatttcaatgatattctagctaacccttgtttaaaaataagtttaaatttgctagttttttacaataaaaacaaagcaaatactttaaaagtataaaattataaagttatacgtccacgaaattcactgttgtcacctatcgagcctagaagtaataaaaatatgataaatgggtttaaatattgcaattaaaatcaaacttaaaaattacatttttattatttattctataattatttattttgtttaattagaaatactatactatcataatgaatataaatctttatttagattaataaaagatataaaatacaaagtttctttaacaaaatgttaaataaaatttaaatttaagcattgttttcattatataaatttaaatttataaatgaaatcgcataaatagccaaaaaaaatatttaaagaatttacac

SEQ ID NO: 45088 - DNA, 1011 bp, Heterodera glycines
aaaatcataagtaagaccaaaagagggattttagtttcagccggaatttctataaaaatgttcgtgtgtaacctatctttgtctattcggataagtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccttattgtttaattctgcctttcctataagcacaatgtgtttgatgggctctacaaaatattgcttctgcaaagcaattattttcttggaggctttaattttctgtagtcatttgatatgcatctgctatttttctagtcacaaacaccaatatttttaggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgctttctatacttaattcatccataatgggccaaaaatcataagttaagaccaaaatagggattttagtttcagccggaatttctataaaaatgttcgtgtgtaacctatctttgtctattcggataagtaagaaattgaaatattcgtattacttttcctcccttaaagctttataatgaaagcgtcgtggtgtatttaggatttcccgtcgcaattctgtaattccactgtggaatccaaaggaagatgattcgcttttgcaaaatagacaatgcggaagattggtagatgggttagacgttaactggatcataccatatcagcgagtcgccatgctgactgaagtaatcataataaaaagtcccct

SEQ ID NO: 45089 - DNA, 1000 bp, Heterodera glycines
  misc_feature (142)..(142): n is a, c, g, or t
attaaaataaataaataattaattttaaacaaaacatttatttataaaaaaaaaattaatttcaaataaaaaaatgtattttattattaataaaataaaaaatatttgaaatgaataaaacaatgaaaacacgaaaaatggngtagttattaattaaaaacaacgttggaaattattaattgaatattcatttaatttgaaattaaattaatttttttacaaattcaaaaaataaataattaaattctttaattaaaaaaataaataaatttaaataatttataaaaaatatttgaaattaataaaacatgtaaaagtaatcaaaaaatgcacagaaaaataatgtacaccgatcggatccgaacttcgcccccccccaaaaaaatgatgctcagaatccccaatcacacggggattctgaggccttaacgatgtcaaaagtaaaatctgttttcaaattttaacccaaatttccaaggaccaaaaaattaaaaatatttttgaatttttaaaaaattccaaaaattctgaaaggtaaaagaaacatcatattcgtgctcagcacctcaaaataccccagaaaaaaaatttcacccccattttggcccacaaaaaaaattttgaaaatttctagggggcctagctcgaaaatttttgaaaatttccgaacatgaagtacaccgttcgatagagcctataaagctctacaaatctgctctaaggaaatttttggctaaaaccgacccttgacgagttatgggtccgggactcaaactgtcccgcttaggccaaaaattttttctatttccggaaaaaaatggacattttttcaaaaaaaattccattcgatagagctcgaaaaactatgtcttggaagtggtcttcgttttaccgggaaaattcgttaaaaaatcataaaattcaaaaacccgaaaaccattttttaggcctaactcgagaaaagtaaagaaaattttcgaaattctttaaatttcagaaa

SEQ ID NO: 45090 - DNA, 880 bp, Heterodera glycines
gctccccataattgtttgagtaccccaaacggacaccttctaagatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgt

SEQ ID NO: 45091 - DNA, 813 bp, Heterodera glycines
cagtgtccgtttgggggtactcaaacatttattggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagggtatagggaagctattcccgaaggattcggtctccccataaatctgggcgcatcgggtcggggggactggcccgaaaaccaaaaaaaa

SEQ ID NO: 45092 - DNA, 862 bp, Heterodera glycines
taaactttatgtaaacaaaaaaaaaatgcattcccatgaattaatctattaaaaatattcaaattacatttagactatttttaaagccaaaaatgtgctaatagatgaaatcggagtgtgggaaaaagtgtggggtgggcgggataaagacaagggggagaaaaacaaataaaaactgctcaaaaatacgtgaatttctcaaccatttcgctagaaaaatcgtaaaccaaaattatttaaatgatttttggcgtaaatctttttaacccaatgtcaaatgaaagtaaaatctgatttgagatcttttggcatctgtgagaataaaaattaagctttaagtttgactcaattgtacatttattttttaatttcaacacactatcgatgccgatatgaatcgacgataagttttgatcttttacaaagatattaattacaaaaaaaaaggtgataataaaaattttaaaaatttttaatagatttttaggtatgcctattagcttaggtttatattttaaaagttttatcgaacttagcagataacgacaaacgacgtattacgacagctttggcgtttgtcgtttatcttttgtcgctcgtaattgtgattggcccctgctggggtccagtggtgccgaaacacgctgccgggggatttgaaaaatataacacgcaaatcgtctcacgtcaaaacgagattttgtttcggtacgagtttaagagtggaattagcacgaacttagttagaatttcatttgtttcggccttcaacttttattgagcttattgtctctacatacaaatgaataaatactataaaatgtcattagcgtaagcagagagttaaattgtcacgcaattt

SEQ ID NO: 45093 - DNA, 1138 bp, Heterodera glycines
agtttggcgacagaaggtttctgactaaaatgtgagaagctaaataaatgaatgcccatttctaattaacgacgacttacgaaatactcatattcccggagactagcaacgcccggtagcacatagagtgttgccatatatttattatcatcgttctcagcagcaaaacaaaatgccgaggaccggaaggaaaagaagaaggaggtagcatttaaggcaataatatttcctaaaaaaatttaaagtgataatttgttggaaatcatttccttttaagatgcattgctttttcctcttcaattgcgacgcaaaacgcagaaaaaattatgtcagagggttgaatttattgcgtggctattgacttttacaattggtagggcatatagaatatgcaaatacgtaagaattgacagagagtagattttattgtgatggttattgccaagacatatagaatatgcaaatacgtaagaattggcagagagtgggatttatttcgtggctattgacttttattaatggttattgccaaggcaaaaaaatattttacaaacgtaaaattgagtcaaattggattatataatataatgtttgaaaatataaatcatagtcctcaaagtcaaaaccgctcaaaaaggttggaatcggttttagaagggcccaaaacattgagaaaaacgcaaatttgggagcgcttgccatttttcaggaaaaaatcgggtgctgaattgtccactaggtggggcgtgcgttaaggtacttgcggcccgaacatttgcgcctcagacatttgcggcacgacaaatgcggtcgggcatttgcgcatcagacaaatgcggcccatttcttaagggccatattcggacacggaacgccaaattgtcagacgagtggaggtaagaaaaaccattaccaatacatcaagaacaattcacataattatagatcatataacattttcagcgaattcgtaaattcttaaaaacaatgttctccaaaaaattagtgaatttcggcaataagttcgaattcgggttcggaatttcgggaaataaaggtcggtacttgtgtggtttacctgacagatttcacatacaatggaaatgcctataaatgtattaattttacattgtttttt

SEQ ID NO: 45094 - DNA, 1107 bp, Heterodera glycines
tgcggtacgtcaatactcaaacggactcattttacaatggggtttgtgttccgttttcaatccgacatttcattttttgataataccatgtttttgttcctttcccttgccttgtgcttcatatatcaataatgtttttcaggactttcttggagactcgcactcgtccattttcgacgccggcgcgtgagttttgccgttaataattccattaaatttatccctcttcccccccccccatttggctcagttgcatttcgttgaacccgcactttgtcaagctggtcagttggtacgacaacgagttcggctactcctgccgtctggtcgatctgatcactcactgtgcttccaaggcatagaaagacgacgcgcaaaagagggaggacggaggaggaaaagagaaatatgctaattttgactctgcgtttattccatttctcttttttggatgctgtccaatgacttgtttctcctgaatttttttaggaattagagcgcacttttaatcacgttatacgtaaataaagttttgtttggcttttcatttgttttattgttatttttatcccatgattgcgcatattttagccgaaaagtgatgttagatttaaaaatatcacaactatggaaattttgaaagattttgttgaaatttcttaatagagttgcgtttttagaggtttaagaagccattatttttctgatcaactctgttccatgcgcacgaagagtacaaattttgtcagacacaaagtataaaacataacgataatcataattttacaagaaagaattttaaattaaaaggcgaggtaaaaatgaggctgttaaatggaaaagctttgccattcttttcccgatttttaatcagcagatggcgctttaatgaggctgttgttgttcggccgggaggcccagttgaagctgcagttgatgtaattgggtgagtgctgcattcacacgaagaatggcagtgccattatctccctgccccaaatatgttagggcttgccggatacattcaattggagtttctagggaaaacaatcctgggatggagttttgttgtatgccttcgaggagagtgataatacccccgagggg

SEQ ID NO: 45095 - DNA, 1142 bp, Heterodera glycines
  misc_feature (54)..(55): n is a, c, g, or t
tttgatggtcgacaaaaattccggaatgctttttttttttttattttattattnngatcggaataaaaacaaggtatgcagggaaaaatattttttatatttaccagctaaatagagaataataattggggctactccaaaggcttctttatattgaaaaaaattacacaaattgattgacaaaacgtcaagtacaatgaattgcgttaatgattttcaaaaaatttcgacatcacccaattgcgatggtcttttcaatatttattactacaaaatttttaaattttttcaattcctctcaacatacttaaaaatttatttgtaggagataaattatttattttaatttttatcaatgaactgtgaaagtgatagaaaccctcatggattttaggatgaccgaaaaataatttttgaccaaaacaaaaatcatttgtgctttttcatgaaacagaaagaaatgcttaatcgttaatattagaaacaaaatgaaaaagtgtaaaaaattttattcataattttgctaaaaaaaactaaattcttaattcataatattatgacacggatacaacaaagccgtgcaggaaaggtatcaccggctttgactcatgtgctccgctttccaccatttcaacgaatgtatttgaaaataaaatttattattatttaaaaataaaaaaacaatatgtattaagtggtttttgatgtgttaattaagtaaatttaaaagaaaatccgacaaacctcaattcagatttaaattttcaaaaattttgtatttctatttttttcgaaaaattatggcaccgatcaaattgccaatatccgatgatagtttttgcaaaaatgtgctaacacaaaaaactagaagcatatagatttggtagggttctggtcatttcgttaaataaaagaatctttgaaaatgaaaatttgcctgttttaatctcataaagcagtaaattaaattaattaaatggtactttccggttttggggccgcacccaaaaaatttaaaaaatcaacaaaagagcgcgcaaaataaacaaggcgcgcgtaacactaatgaaaggcataaatgcagcaatttctgacaaaatttcgtcacatgatcagctgcgcgctcttttgttgattttttt

SEQ ID NO: 45096 - DNA, 570 bp, Heterodera glycines
ccttggcattctgtcttcaaatgttgtcggcaattcggcggcgacgaccaatgcgaatgattgtgaggcaacagatgatcagcagaaggcgcaattgctcaaaacattcgcaattggtatgtttttcaattatttttaaaatttattttaatagtttatttgaattttgtatatatataaaatttttccataagtgtctctctattcattttttcattacccccccccccctacccggacagatgcgttggtaatgatttatgtgaacacggtgtccaagtcgttcgtcagtccgcgcaaagaggccgagctgttcgaaagcgattctggcgacattggtggactttaaattctatttatttcaaatttgattttaattattttttttaccaccccccccccctccttaaagatttgcgcggcccgcaatatctgatggacatttttgagtttttaattcgctgtttgctcaacgaggacaacgaaagtttgcgagagactgcgcacaaaggcataattaaggtgaagttcacatataataaatactactgtattgcggtccgacttttg

SEQ ID NO: 45097 - DNA, 1012 bp, Heterodera glycines
tctttctctgttttaattgtttaaaatgttaattgccataagtgtcacttagtgattttgtctgtttgctgactgatgactaatcattaacgctttctgcacgaatcagcacttcctccggccacaaaacgtccgaaccgaccaaacgaatttcctttttaaattatggggtaattaagcgtaattaaataggcctaatggcacctctgtcgaagtgtcagttgccgaggtgaagtggaagcggcgaaacagttgggaaattgccatttccatcacttggttggccagcggaaggccaacacaatggcgcgggccgagcccaccaaagggcagccaatggaatttccaatccgcggggagcgaaccgtccaaccatcttttgggaatatgtttttaattaataggttgatgattattttgaaaaagctttaaaaattttttttttatattttttctgaattttcttttaaaaaattcctaacataaggttttttctcgaaaaatttcgttttgaaaaagtttttttaattttcaggagaggagaaacggcggcgtggaaatggctgctcccgtcccaatttcaaaaattagatggcggaaagggattaattttgggaaaaaaaacaaatccaaggtttcccatattgttatcggacaaaaaatttgtcacaataattttcatgttggaaaactcaaaaaacaatgacttttctcgagttaggactcgagaaggctctcgagaagcactacagtgtagtgagccaaaaagcacagtaatcaaaatggtaaagcaacgggacaacaatttgtcgtttgctgtttcatgtaccgttccggacggaactgttcagcgtcctcgccccacacggcacggtttctgcccattgtgaacacatcgacctccaccgagtcgccgacattcaacacgattttttccgagttgagctgaaccccacccggcgacgatggcgtcggtgtacagcgacgggaggacgcgcttaaaagcgaggca

SEQ ID NO: 45098 - DNA, 761 bp, Heterodera glycines
aaagttttttctaggctaaaaaatccattagattttttatctaaaaattctaatttttagttgaaaattcttacaattagaattttttttgtacgagttgccttttgtacgagttgccatgacaccctcaatcaccttcgcctggcaatgggaatggcatagattcgtcctttttgccgaatgtgcaattgcacgcccatttccattgtgcgtcgggtggcggggtaaacgcgtggtatgttgcaagatcttcgagatctttggcaattccagtaacagagcaaccccaaacctccaaaacttctttgtctaaacaaatttggaagtgtacatattgagatagggaagaagaagcttcggctctaatgcactttatgagtccaatcgacttttatgagtcccattaaaatatttatgagtccaatgatttttaataaagttttgaggtaaatttttatttttcaaactttcaacgcacaaatgcgctgtttgagctcctttcttcaaaacaattgggcaaaataaaagtttttcactagaaatcccggctttaattattttacaccggctaaaaattataagttacactttgtttttcgcaagcgattactgctgggaaaagcagtcgaaggcacttcattgatccgaatgacttaataatgcagtttacgccgagatttgggcccgacatttgtgcttatgtctaaaatcgggtctgaacatatatttttctcgatcccagctaaacaatctctgtctat

SEQ ID NO: 45099 - DNA, 150 bp, Heterodera glycines
ggtaatactgaagtttatcccccccccatttttcgaaaaaaataagttttaaaaaaagccgtgtaaaacacatttccttggggttttctgggtcgctgatgagcgatcaccagtctggcattcattttgactaatttccaatcccggacc

SEQ ID NO: 45100 - DNA, 637 bp, Heterodera glycines
ataatttttaaaatcaaaaattattatcaataacataaacaaatatattttcatatgaatttttgagaagtttttcatttcttaggtgtattttttgaaaaaaattttggctcggttcttacgggtgtacttttcgattttattgcatttttgttcacaattttgggcaaaaagccaaaaaagttttttttaattgtaggcttttaggctttaataaaaccctaaaatagattttataaattcgaaaactagcttaataacaacaacaaaaacattttttcgtgcttttcaggtcgcaggaagttcaggaaaaaataggtaaaaactcaaaaattgaatccctattgataacaataccattctaaacaactttttcaaaaatcacttttccaaaattgaatattgtaaagtttttgaaattttagcatttttatggattgatcttgcaccttatttagactccttaaagaattgaaaatctctttgctttttttaattaaaaatatttgggacgaatcgaattttttcctttataaaatcatgacataaattattaaagatacatataatttatgtgatattagagtttgcgtcagtaacgactggtcagactgatcgtcagaactgattttaaagt

SEQ ID NO: 45101 - DNA, 1232 bp, Heterodera glycines
ttggtttggcatggaaaacccattaaacttaagtatccttctcagtttaagttggtccgcgaatggactcagttggaccataaccatttcgaggcccgtctcgacatggaaacggcgagaaaatctttccttttttcctaatcagctgattaattggatttttagctaacccatggaatgcaagaacacacagtgattgtctacacaaaagtgatgtgagaagtgatcaaagcaatcagtcagcagaaaatgttataaattatcaataatcaccgtgacaattatttttattattttaaatacattgcttatttttggaaaaaaaggaatttgctaattggaataaatagaacaaacattaaaaccaatgaagagcgatgcccaactcatccacagcggcccgcgtcgtggcaattcttatcatggataaaatgattatactccgacaaaactgcttattttagacagtaatatctgaatacgaaacccccaaatcagacacactttccgtacatttccattcgagccctttcggtccaagttagcgcgtgtcctcgttttccaaatcctttatttggccaaatcaaataaaagtaacaaaggccgtctcaacatcggttgatgatcactctccccccccccttttcaatgaatttgtcgcgtcttcggctgattcgttctttgctgctcatccaatttcagtctctccactcgaaataattgtttgttcgccttcttttccttccgccgctctctccgttcttccttcaccgcaattttacgaattcgccgctcttccgtcgtctcccccttcggtcgaattacgctaaccatcgaagtgcgcgtgcggacggacggcgccggtggcccgtctctttggtctccgtcaacttccatttcctaaagttgggagtgaatgaattgtccggtgtttttggtggtcattttgtccgtcacctccaaattggccatgcccttctctttggtcgtcctcccccttcgcctcccaatgcctttcatcggctccctaatttcagtcggatgattgtaaagctgaatgaatttgaaaagtgggggaatgtcggatgattggcaaatgttttgtttacggtggaatgcatggagagaatggactcgcaatcccagcggcttctcttcgcactgtccaccaaaatgtcctccgtcggctcggcccttcctttgccaatttccatcgcttttgcataacgcaa

SEQ ID NO: 45102 - DNA, 1016 bp, Heterodera glycines
cttttcagattcgggattaggaattggtcaaattagattattgacagggaccccaaaaacctccgagaacaaatttctacgcgttattatccctaatttgcagccaaaatggttccccttttggtttttcataaaatccaaaatatacgaaattgcaagtagcgccagaattattttctttagtgtattgatatatttcgttttggtttggggaacttagaagcaaatttgagagtttttcaccattttcttttccgttttcagttgatcatatgtccatcaaattgatcgaggccaatgagtccattgcgctcctgcggcgccagttggagtcacgcgacgaggaaattgaacagttgcgacgcgccgagtcggtggcgggcgaacgcgtcgcggacgcgcaacgggaggccattcggtggcgcacggaagcggaacgcggactgcgacgcgtcagcagcggacgaaatttggcggcatccgccgaaagcggagaatttgtcagtttttgaacgtatttttataaaaaagttggaaaattcacaaatttttacccatgctaaaattcttttggatttatttgtacaaattcgataggtgtcatattgttggctttttgtgggttgtcgtcgagtcaatttcctctaaaaaatggtcatatggatacatttggtcatgttacgaaatatttttcaaattttgaaggctggttttgacaaactgttgttgagcgactaccgtagtgcgctgtccaaataccgtacatggtcactgtttgcggacaaacagctgcagaccatgaaacagttgttggaggagtgcggcggatggaccgagccaaatcgttacaaggttttcgttcactctctcctggaaaggccgataagcaaaaaacaggaaaatatggccgtttttcgccaaaaaaacaaacaaatttgaggtcaaatttcaaaaaataatggtaaaatgggctccgggcggtgcagtggtgctagagaaaatttaggcagtttaat

SEQ ID NO: 45103 - DNA, 1174 bp, Heterodera glycines
ggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaagttaattttagcactctgatgctttagtatcaaaa

SEQ ID NO: 45104 - DNA, 552 bp, Heterodera glycines
actgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacaattttggcatatttaaaaagcaattaaaaaatccccctaagataataattttcctgcaccgaaggtactcactcggcctcttcgcggcctcgtggtgggccttc

SEQ ID NO: 45105 - DNA, 1129 bp, Heterodera glycines
  misc_feature (103)..(103): n is a, c, g, or t
cccatttttcgcacgtgaatgttattttatcgattctgaaccgtttgagtagatagactagaaaaatgaaaaatttgaaatcatgtttcccactcccttctcncaggggtattattttgtaaagtcttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagaagattagactagaaaaaattgaaaattttgaaatcatgtttcccactcccttctcccaggggtattattttgtaaaaagtctttttttccccaataaacttgtcaaaccccatttttcgcaccgtgaatgttatttttattgaattctgaaccgttttgagaagattagactataaaaaattgaaaattttgaaatcatgtttcccactcccttctcccaggggtattattttgtaaaaagtctttttttccccaataaacttgtcaaaccccgtttttcgcaccgtgaatgttatttttattgaattctgaaccggtttgagtagattagactacaaaaaattgaaaattttgaaatcatgtttcccactcccttctcccaggggtattattttgtaaaaagtcttttttccccaataaacttgtcaaaccccatttttcgcaccgtgaatgttatttttattgaattctgagccgttttgagtagattagactagaaaaaattgaaaattttgaaatcatttttccactcccttctcccaggggtattattttgtaaaagtcttttttccccaataaactttcatacccatttttcgcaccgtgaatgttattttattgattctcaaccgtttgagagattagactacaaaaattgaaaatttgaaatcatgttcccactccttctccaggggtatattttgtaagagtcttttttccccataaacttttctacccctttttcgcaccgtgaatggtatttt

SEQ ID NO: 45106 - DNA, 888 bp, Heterodera glycines
ccccataaatctgggcgcatcggttcggggggactgccccgaaaacaaaaaaatcgatattttcaagtgtccgtttggggtactcacacaattatggggagcaaaaatccaccgcagaattaaagtacaggctatagggaagctattcccgaaggattcggtctccccataaatctgggcgcatcggttcggggggacttccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggacttccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaatatttttt

SEQ ID NO: 45107 - DNA, 845 bp, Heterodera glycines
  misc_feature (6)..(6): n is a, c, g, or t
gtattngctctaattatcccccatgggggattatttttcaacctcctcgtagactgggggataattggagactgggggattaagatagagggattatttttcaaacccatcctagactgggggataattggagattgggggattaatggagattgggggataattagagaaaatacggtatccctcaaaagtcggtctctagcagggctgttgcaagtttcgcttttcgcctttcgctttttttgggcctttcgctttcgctttttggctgaaaagcgaaataaaagtacacccctaaagattgggtttttaaaataaataattaatataaacattaaaggagaaaatctatagaatttatcttttaagcttttttatgaaatgtctttaatttggaatttcttcaaactttctgggcgggttgctttctgcaaatcatgtaattataaaaaggattttcctccgcgatcaactggcattccgatttctttctgcaccggctacttcagccgaaagcgagcgtcttttttcaacggcaggattaatcataaatgacttgcgaaaaagcttgacacccgaaaatgctgaaatgttattgtttttgcaccacaatattcaaatttatgatttcaattatgaataatttttggaaaaaaaaattcgccttttcgcttttgttaggcatttcgctttcgccttttcgctttttattttggtttcgcttttttcgcttttcgccttttatttttccctttgcaacagccctggtctctagtgatcatacatgaaaaagggggggggtcgaccaaaatttttgcgaaatggtctggagggggggggggggg

SEQ ID NO: 45108 - DNA, 734 bp, Heterodera glycines
ttcttttttgctgtttttgcttttttctcctttgctcatcaccataaaatgtctaattcgttcgctattttctcgttgtaattattcgttgatttcgatttggcatttttcatctttccatggatttcttttatgatgccaatttctcttttaattggcgacactaaacactgaaaattttattgttttttttactatgagtcaatttcgttttttaacagaaaaaatattttttaattaattaaatatttgtctgctttaatttttaaatatattttttattgtaaatttttacccaaaaaatatataaaaattttaataatattttaaactaatttatttgaatttttaataaatttcacaaaataaattttctgccagttacgtcttttgattttcgttttaaaaaattgaaaattcctttttaaattttattcatcaattagacgttacatattatttctgttagttaatgtatcttccctagaagtattctgtatctttcctttttccgcattcgtcgtctcgcgggtattcatcagatagcaaacaagtcgatttttttagagtgtccgtttggggtactcaatcaattatggggaccaaaaatccgttgcagaattaaagtacaggctatagggaagctattccggaaagattcggtctccccataaatctgggcgcatcgactcggggggggtgccccgaaaacaaaaaaatcgattctttcaagt

SEQ ID NO: 45109 - DNA, 1067 bp, Heterodera glycines
tttgaaaagcgaaacttctgactcaaacaccctcaaaccctagagaagtgtcgttcaaactccggccatttttgctatggtgcgctcttttgccgaaaacgtacgatcccaacgattttttgaaaagcgaaacttctgactcaaaacactcaaaccctagagaagtgtcgttcaaactacgccatttttgctatggtgcgctcttttgccgaaaacgtacgatcctaacgagctttttgaaaagcgaaacttctgactcaaaacacctcaaaccctagagaagtgtcgttcaacctccgccctttttgctgtggtgcgctattttgccgaaaacgtacgatcccaacgagctttttgaaaagcgaaacttttgactcaaaacacctcaaaccctagagaagtgtcgttcaaactccgccatttttgctatggtgcactcttttgccgaaaacgtacgatcctaacgagctttttgaaaagcgaaacttctgactcaaaacacctcaaaccctagagaagtgtcgttcaaactccgccatttttgctatggtgcgctcttttgccgaaaacgtacgatcctaacgagctttttgaaaagcgaaacttctgactcaaaacacctcaaaccctagagaagtgtcgttcaaactccgccatttttgctatggtgcactcttttgccgaaaaaggacgatcccaacgagctttttgaaaagcgaaacttctgactcaaaacacctcaaaccctagagaagtgtcgttcaaactccgccatttttgctatggtgcactcttttgccgaaaacgtacgatcccaatgatttttttgaaaagcgaaacttctgactcaaaacacctcaaaccctagagaagtgtcgttcaaactccgccatttttgctgtggtgcactcttttgccgaaaacgtacgatcctaacgagctttctgaaagcgcaacttctgactcaaacacctcaaaccctagagaagtgtcgttcaaactccgtcctttttgctgaggtgcactattttgccgaaaacgtacgatccctaacgagctttttgaaa

SEQ ID NO: 45110 - DNA, 938 bp, Heterodera glycines
aaatggggtatgaaaagtttattggggaaaaaagactttacaaaataatacccctgggagaagggagtgggaaacatgatttcgaaactttaaattttttgtactctaatctactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtagtctaatctactcaaaccggttcggaattcaataaaaataacattcacggtgcgaaaaatggggtatgaaaagtttattggggaaaaaagactttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaagactttacaaaataatacccctgggagaagggagtgggaaacatgatttcgaaactttaaattttttgtactctaatctactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaagactttacaaaataatacccctgggagaagggagtgggaaacatgatttcgaaactttaaattttttgtaatctaatctactcaaaccggttcagaattcaataaaaata

SEQ ID NO: 45111 - DNA, 786 bp, Heterodera glycines
  misc_feature (27)..(27): n is a, c, g, or t
taatagatcaggggcttgccgcccacnggcgatcttcgtttcttggtcttctccagcttctgggcgcgcacgatggcggctgccatgcccatgacgccggcggcgccggccatcttgagcagatcacgacgagtgactgacatgtgttgtctccttgggtgcggggatgccgatagcgccggtctgcgccagcttgtcgatagccgctgaatcataccccagcgatttcaggacttcctcggtatgttcccctaatgacggaccgatccagcgggtcccgcccggggtttccgagagcttgggcaccaccgccggcagcttgaccggactgccgtcggcgaactggtgctgctcgatcatgcggcgcgccaggaactgcgggtcggtgaacatgtcggccacgctgtagatcttgccgaccggcacgtcggccgccttgagggtgttgagcgcctcttcgatgccgcggccgtcgcaccattgctggatggcgccgtcgatttccgcgacgcggcgggcgcggccgtcgttgcgcaccagatccgggtcggaggccaggtcgtcgcggccgatggccagcatcaggcggtggaagatcgcgtcgccattgccggcgatgacgatgttctggtcgtcgcgcgtggtgtaggtgttggacggcacgatgccgggcagcgcgccgccggtgcgctcgcgcaccacgccggcaacgtcgtattccggcaccaggctttccatcatgtgaacaaaggctcgtacagggcgacgtcgaccatctgcccctgc

SEQ ID NO: 45112 - DNA, 1366 bp, Heterodera glycines
  misc_feature (41)..(41): n is a, c, g, or t
  misc_feature (134)..(134): n is a, c, g, or t
tgctgctgacgtttcgctcgttcaagatgtgcaaaaaagtncaattctgttaagcaaaaatgaaatgatttgaattcatattttcattttaattatatattttatttttttatttaattcttcattgctctccncgaaagaatttggcccaattttgaacattagccagattttcttctcttgaattcgtattttcgccatttttctttaccattttgtgccatccgattgtcgttgaagcgttcaatccctctgcgtatgtttatgtcgccgttatgattgtgctgtacacgaccaatttgatcaacgcctaattatgattttttaatcggaaatgggcgccttttattgactattttttggcattttctttggccaaaaatatgccaatttgtcttgacccattccaacaaacggatttaaattgaaatttcgattaaatcactttaaaaagagagcaactcacttgagtcaactaaatgagcaccatttgcaacagcagcagaaaagaggaaaaaaacaactccaataagaaaaatgcaaagaaaaagcagctgattcccaaatattcgttgttgagtcgtcatttatttttgtttttttaatttcacaatttgtcggacgggaaaagggataatttaattgctttcgtaagtaatcaacaactaattatgatggtcgatcggtcggtgggaggtgagaatgggtgcgcgaaagatgtgatttattaggctgactaatgagtgaacaaagtaattagatgagagatttcaaaaaaaatatgctgtcctaaataaaataatacgtcaacggataaagtgattggtattttaaatattcttaggtttaatcaattcgaaaacagacatcaaatatgtaataaatagggtcgcaacttttagtgacgaaaaatcccgaaatagttaactaaaatagtgagtaaaaatgccaaaatagtgaagaaatagtgtcaaaaagtccgaaatagtgacataattttcagccaaaaattgagcaaaaataatttttattcactgattgcagttgcaaatgagtaggactgggatttttaagaccaaaaaacccaaaatagttacctaaaaaaatttttaaaattaaaaatttttgccaagaaagtaaatttttgagaaaattttttttcatttcataggagtatattttgaaaaattttagcttgattcttaggggtgtatttttttgaaatttttttaggtcgattcttaggggtgtattttttggtttattgcatttttgttaatgaattttccaaaaaatgtcgaaatagtgacaaaacgccaaaatagtgatttttaactattttagtgacaaaacgccaaaatagtga

SEQ ID NO: 45113 - DNA, 964 bp, Heterodera glycines
  misc_feature (43)..(43): n is a, c, g, or t
  misc_feature (858)..(858): n is a, c, g, or t
gatcgcgctgatcagcgcgctgaccagcgctgtggtgcgacancagcgcgccaccaacgcggacgcatcgaaaccggaaccgaataaccaaaagccaggtaaaaaaatgaatttattaaaaataaattaataatttggtccaggaactgtggactcggacaaaggaaacgcggacaaaagccagggagcggacacggatggaaagaacccggaaaagccaaaggaaagccaagaagtggaagaggatggaccaaatccgaaggagtcaacgaaaagccaagaagtggaagaggatggaccaaatccgaaggagtcaacgaaaagccaagaagtggaagaggatggaccaaatccgaaggagccaacgaaaagccaagaagtggaagaggatggaccaaatccgaaggagccaacgaaaagccaagaagtggaagaggatggaccaaatccgaaggagccaacggaaagccaagaagtggaggaggatggaacaaattcggacgaggacgagctcactgaaagacaggaagcggaagttgatcggatgcgtgtccgtgccggtgccacctccatgcatgggcttgacaaacttgcgccaacgccaccgccgagtgccacttctacaaatgccatcgcaatacgagtggctaccactcgctggattagcgatacccattggagaaattgtgataccattcgtcaccaacaaattatgcgagcatcgtacccaatattgttcttgtgggaggggaaggtgcgtgccggtaactacgtacaaggcggacaaatgttgtgacagcaactttgaatggaagtgttgccccgatgtaagtattaagttaaaaagaaattattatncaaaattctgcattaaaatagtcccgggagtgagaaagcagccgtgaaaatttctttgaaaatttgagtgtaaatgccattgtctgttcttgagcccattagtttt

SEQ ID NO: 45114 - DNA, 939 bp, Heterodera glycines
aaagagatagccatttttctgagaattaattcacaatttctgcagctcttagggtaatggaaaaaattttgaagaggctatccggaacggattagcatcggggttacgagatagaaaattgtcctaaaaagagatagccatttttctgagaattaattcacaatttcagcagctcttagggtaatggaaaaaattttgaagaggctatccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcttaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctatccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctagaaagagatagccatttttctgagaattaattcacaatttccgcagctctt

SEQ ID NO: 45115 - DNA, 1244 bp, Heterodera glycines
cgtaaatggtttggtgtaatctttcatagacggtgactttcccataacaaatgaatgaaattagtagaaaatgaaattacaaaatctgcgtcagggtttttgctgtacgccttttgcagaaatcgcagaaaattctcattcagaatggacagtttttcacgaaatcgtcgctcattttcggaagtcatttctgtaaaaaagaaaggaaaaaatacatagaatttataaatgcttttccattttcaatgaacaaattgctcttatatgcaaagtttagactctttagtttgcaagaccatacaaattacaggaccttaaaaattaaaaaatagactttttttgtgtaattttctggctctaatatgaacaatataaattagagccaggcgcgggattttgtgttttgtggaattccagttcgcaaccccgcaaaaattttggggtttgagggattatcccgcgagacctcgaaaaaattgagtttcatcccgctacaggatccgcaaattgatttttttttgaattttacaaacagaatgccaaaaattttctgaataaatttcaaataaaacgaaaaaagcgcttcgcaaaaaagtcaggtgaagagcaatataaaaactctaatttggtggaatggttaacaaatttgaccgtcgctcttcaaccctcagaccccttctaaaaatcttgatcaacccaccaacccttttcatgtattctgccagtccctaaaaagtcgtgatcggaagcgaaggccgtactaatgtttttatggttgattttggttcatttttcgtgatttaaaccgattaaaaaaccatttttttattttccgcgcctagggactattattgtgatgcttagaggtcattagagattgattgcaactagttttaggcggtttttagcggaccaattctatttgtttagaaattatttgcggcaaaaagaagtgtaaataaaaaagtgaagaatttattacattaaaaaaataacagaaaaaaggattcacaaaatatgaattacaaacagtataaaacaaaaaaaggcaggtactgtaattgtgctactatcgactgtattcccaaagtcaaagggcattatttgaacgcgtttgctgccgttctgctgatctattctacggtgtctcagtgctttacgttagtgtatacggtaataaatggtcgtttggcatactgtaactctctctctctctcattctctttctctctctctctcatttg

SEQ ID NO: 45116 - DNA, 1320 bp, Heterodera glycines
cttcacccgcccggcaatgatccgctcggctatgagttttcgtccgagcgttggaatcacaaccgtactgtggagtccattttggtgtcggtccaacttctgctggcggagccaaacttcaacagtcctgccaatgtggatgctgccgtaagtgattgattcgtccgtcggcacgtttttcattgaccatcatcataatttttgcgtctaaatttccagattttgttccgcaacgacccggcacaatacagggaggaagtgcgacggcgcgtggagagggcatcagcatcgacaccgcgagcgaggtcgtcatcaacaccaccgccggtagcgcaaccgccgggagaacagcagcaggggacgccgccacaaccgccggacggacaggggatgcaaccgccgggagaacagcagcaggggacgccgcaaccgccagcgacaccgccgcaagggcaagaagcgccgcagcagggcgaatggtacctttgatgtgacgtgatgccctctgcgtgatgatattattatatacttatgtatgtgtatatgtattgtattgtatgcatgtgtctgtcgtccgaccatttcattaattaatggtctctctctctctgtgttcgtttgccctgcttttgttcgctgttgtacatattatgtgtattgtcattatccaccaattattgtatatatatgtgtgtacatatgatggtgtatcgagcaataaactttgaaattgccttgatcctttccaattatgtatggattttgggctaatactggagaattagtgtcccggcgaaaaataaattaaaaatttaggtcatattcgtcgtcagcgaccctgaaaaccccaaaatacatcttttcaagttatccttacatgaaaatatatatttaaaaaaatctagttgcttgatgaaaatcataggcaaaatcaatgatttttcgaattctggactcagatccgtaatcagtgtattttttattgaaaattttttgcatgtattttaaaaatgctttttcaaggttagagacattaaaatagcacgccaaaaagatagaaaaagaaatacaatttcatgtttattttataataactagggatgggaattttatgtagagtgacgcgggaccgggaattttgggcaaaaccgggaccgggacgtgccgggacctgagaagccgggacctcgatttttcttcgggaccgggagccgggaccaaccaggaaattttaaaaattcataaaaattttaaaaaatttaatttaattttatttcaattgaaaataataaagaattaatttttaattttgttttttta

SEQ ID NO: 45117 - DNA, 1375 bp, Heterodera glycines
  misc_feature (50)..(50): n is a, c, g, or t
  misc_feature (65)..(65): n is a, c, g, or t
  misc_feature (101)..(101): n is a, c, g, or t
  misc_feature (121)..(121): n is a, c, g, or t
atagataataaataatgtaatattagatttaattgaattgttcatgttantaaaaaatcaaattngagcattgactaataatcatttaattattatgactntaattaatagattttaaatntaaaatcttgtaatgttaaaaaataactaactttattttcaaaaattttacaaaaatattaatatattcacaaaaagtattgaattagaatttttttatttgttagaaattattaatcactttttaatgtttgatgaataattctaaatctaaatcatgacaatgaccgcaggttccatgacaatgaccgcaggttcgaagactttctgatgtttatctttctcataaatatattgttctgactatttaaggcaactttttttaattatttttatataaaaagtatgcctattttttgatattatagtaagaaaaaaataattatttaaattcattaatattttaaataattaaataattgaatgggccacatttttatatttaaataataattaaatttaaatgttttatcattgatactttttttggttcgaccgagcacctttaaattcattaatattttgtaagtgattaaaaaaataaataaattccataatggatcttttgatgtgtttttaaattattttgctttttggcaatatttttacaaataaattttatttaaataattgtgtcttttttgaaagttaatattttcttgtttaaaaaaataaatatcaaaaaccttggttaattaattaataaactaatgtttgataataatctgtatttttattctgaattattttttcatatttcaatgaaatataaatgtatttcatgaatatattaatgaaaatatttttattttcttataaattctaatattttaatcggtttcatgttagggttatttaatcatccttataaaacagtaacagattgcttttgcaaaaattccatatttcgtattcattcattatttttcacattacacatttatatacaagagaatttcaaagtaaaatttatccatttaataaatatatttaagttaaaaaaacgaacaaaggaaaaaaggcaaaatttttaattatataattaaataaaaaaattaaaaaaccttataatgcgattttgaaaagataaattcaatcaacaaatgagaacaataaattatatttgtaaaatttgattaattcaggttccgtaaaatatgatgaagaatgagtcaacattgaggcgtgaaaaaaatacatatggcaaaaaccatttatagtaaattataaatattaaatataaaaaaactattctttgaatcaaatgagcgttaatgagaaatttaattaattgatttaaaaaattaaaagaatt

SEQ ID NO: 45118 - DNA, 1095 bp, Heterodera glycines
tttggcaaggtttgttgatataaacaataattttgaatttgaatttgtttatggtttttagagttcacgcgaggtcagtgccccgccgtgccccaatttaaacaataaattttataattacctttgccatttgccctccggcactgacttcctccttttgttccttccctttttgaatttcttttgtgccattctcccgtccccttctcctttcctcatttttctttctcttccccctccattctcacacatttcatttcccttttcctcatcagttttttttttcaaatattttccctttttccttcgttcacttaacaattaattaattaattaattaattaattgttcgttttccgttgtcaattaatcaaatcgtttgaatggcacttaatcaatcaaaaaattataattatgtataaacaaatgatgatgatatttgaggacatttgtgatgatttgaatttaattaaaatacacagagttcacattcattcgtttcttcttttcttttgtttatctttttgatttggtcacatcggagggatttacaatgtgaaaatatatttacaaccaattaaataatagggcaatttcctcttcatttcctacctaaataataaactgaaaattaacaaaatccggttaaaacggtgaaataatccaattttttaacgttgccattggtaaaaacgaaaacagaaacaaattaattgaaaaagattaattgtttaataaataaacaaaaaaataaatatcaaattatgatgggtatctgcaggaacggtaacggggggggggggggggctatagcatttccatatattgagtttattattttacgttttgttgctgttctattctaatttttataagaaattctgcaattctttctcaatattacaagcgaaaaacatttaatgtcgccgcccacaaaaaaagaaaagattttccggcgacgacaattctctgcaacaattagtgaaaacagcagcaatcgacgagttcactttgtgaaaacttttttggaaagcgacggctttgttacactgacgaaccgcaattaaaatttgccatttaatggggaggatcaaa

SEQ ID NO: 45119 - DNA, 884 bp, Heterodera glycines
  misc_feature (566)..(566): n is a, c, g, or t
  misc_feature (613)..(614): n is a, c, g, or t
aattcgcgtagcaacagcgaatgttcggaattgaatttttacgaattatttcgaattttcaaaatctccaatttcaaaattgttcattataaaattattattatttgccagttaaaaaattatgcgaataaacacagaagaaacacagataagcatgggacaaattaaattattaatttttttacatattcattctaatttcatttggcaattatcgggtattcatataggtacgaatattgttcgttataattggttgacgttgcaaattctgtaccggtgccacttggttattgtttgaccaaaacacggattgatacgcttttcggtacacagaactgtaggcaattaaattagttaatttatttgccaaataaaaaatagaaaaatttaagtaaatctttaattaaaaaaatgttttggacctggtaaagaaaagaaccggcgcactgctgcaatgccccaatacatagaagatataaccagcgggacgagcaatgtggtaaagcgtaaatgcactcaaattgaaccacccgaaaacaaagttgaagcaaatactcatcttnaaaaataaattttttaaataattaaaaatattttataatattgaganntttaaaacccaaacatactgcaatggttaagatgagattgatggacataattaaagttactgaacgaatcaaccgttttccttgtaagtccgttaaagctaaatgtcaatttggtaaatgaaattgtcataactttattctaggactttttacatattaataatgcacaggtttttgagaaattccataaaaaatttacaaaattttagaaggttttttttgttgtatttttgggtaagattttgccaaagaattaaaaaaacatttttt

SEQ ID NO: 45120 - DNA, 1528 bp, Heterodera glycines
cttcacataaataaagcagtccgtcgagcagcgtgtactttgtggacgtttccttcaaattttgcgcctgtcttggatcgttcgggaaaattttcttcttcaaaaatgcatatatgtgcttcatttcactttcttcggaggcatggctccatgcttctcttttctccacaattgatgcttcaacttcttccgctgtcaatacttttatcattccaattaatgctttgtcctcctccagtggcggttcggcgattccttcattgtttggttgaaatgagcgcgataaaaggtctgcaatcacattcatttttcctggctggtattctactttcaacataaatctcgaattcaattacatgagccatttgtcgactcgcgcatttccagtctccgccttgcttttgaacatgggcacaagagatttgtgatccgtgaggactctcgtcggcagcattgttataaactgagcaaatttctttgctccgaatctcactgctaacgcttctaattcagttgcggcataacggctctcatatttactgcattgtcgagaagcgaaataaattggtctcaatttcatctcatcgtcgtgttgacataaaatagccgaaattccaactttgctggcatcggtcatcatgataaagcaacgcgatgggtcattttacgctttttcaaagttggggaagtacaaaattacgtctttcaggactttttcttttaggctttttattgcctctttttccacttcaccaatggaaaatttgacattttcctgcaggagtttaaaaagtggtgttgcattgtaattggctgcactttttcgacgtccatttttattccttctcgagttagaatatgcccgagaaatggcaattcgttggcacagaaatggctttttgaaagcttcaatttaagctctgcctcacgaattcgctcaaaaaccagtgcaaagtgctgcagatgagtttcgtatgaatcggaggcgattaatacgtcgtcaatatagacaaagatgaaatcatttatgtacccatcgaagagatggttcatgaatcgctgaaaggttgctacagcattgcccagtccaaatagcataactgtaaattcatgtagcccaaattcagtgacaatgccgtcttttcaacggaatcttcatccattcgaatttgccaataacccgtcatgaaatcgagggtcgtaaaaaaattccggcctccaagcattagaagggtgttgtcgatgtttggtaaaggaaaactgtcttttctggtgaccgcgtttatggccctgaagtcgacacaaaatatcaacgttccgtcgcgttttggcacgagaacgatcgggcttgaccatggcgaatgggatgggcggatcacacctcgttgcaaatagtcttgtaacatggccgcgactttctccctgtaggcatatggcacaaaacgcatcttacagcgaattggttccgcctctcccgtgtcgatttgaggtttgatcaggattggttttgtcaattcggcatcactaa

SEQ ID NO: 45121 - DNA, 893 bp, Heterodera glycines
aacccgctttacacggtagacaacgagacatatctccacctttttcgagaaaatttgctcgaaataatccatcaagcccaagaaaattcaaaagttaacagggaaaagatgaaagagtactacgacaaacgaacaaatgtcagcaaaagagacaagcacaaagtcggggaccgatgtatggtcctttacccaggagcaaacgcgcgatccccgcacaaaaagttgctttggaacaactacggtccatacaaaatcgttgaaatgagtacttcttcggcaaaattggtacccgttgacaaaacagcgtcagaacctataaatgtacctttggaacgattggtcaaagttccaagtgaaatcccgaacgtttcaactctccctaagggcaagaacatgtataagaatactttgaaggctattttatgtccaaatgattggtctgaaaaaggtggccagaacgacggggaaattctagaaagagagcaaaattcaccaaaaacagtgtttcaattgaggacaattgaaaatttagacggcggaatggagacggacgacttttgcgaactgagttggctaatgagttgccaagggaaggaccatgaaaagtgcgacaaattgacgtgcagtgaacttgacccggtcgtggatgcctcgtcagagctcggaatgacttccgttcgttcgccattacaagcgcttttgactgcatttctgttgaaatcaaacgccgcagtctcagcttcatccggtcgcgatttggcagagctcattctcgactctgaacctggcatggagttggtgatctacgaaggagaaagacgggacaatgtgcgaagcggcaatttcccaacaaagcgaaagtgtcgaggaaatttggacaattggtgcaaaaa

SEQ ID NO: 45122 - DNA, 775 bp, Heterodera glycines
tgctgttaatgcttaatgttcattattctgtatcaaactatacaaaaaaattttagaccaaaaaaaagcgaaaaaatttcaaaagagtacgcttttagactagcgccaaattttctttaaaaaatttttctcgcatttaaaaaaatatatctatttgaatttttttttttcttattttaggagtgaaaatggtatgggggaacggcggggagggaaacaagctagctgctgctcccaagaatgggccatcgccggtcgtcggagaaagggggcagggaggagacggacgcccagccaattcattcattctttcatgccattgttcgcttctcttttttttgcgtggactcaagccgccggaaatgttttttatgggaatttgtgtaggggaacaaaacaaaacaaaacacaaataaaataagagaaaatttgaaaagaaatgataaggaaagagaagagaagacgagagataaaaatgtaaagaaaaatggccgtggagagaaagaacaaaaagagaaaatagtaaataaaaggaagagagagagagaaaaacaaagaaaatagaataaacgaaatagatgggagaaagggcgagagaaagagaaaacaataaggaaaaggaagagagagaaataaagaaaaaaaatgagagaaatttgaaaataaaaaagggagagaatgacgagacgaaaaaatgtaaaagaaaaatggaagggctctaggaaaatccgacacaagcggcagggacggtcccaggattttggcttgggggggg

SEQ ID NO: 45123 - DNA, 714 bp, Heterodera glycines
atggaaaaaattttgaagaggctctccggaacggattagcatcggggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattctctatttcagcagctcttagggtaatggaaaaaattttgaagaggctatccggaacggattagcatcggggttacgagatagaaaattgtcctaaaaagagat

SEQ ID NO: 45124 - DNA, 979 bp, Heterodera glycines
  misc_feature (42)..(42): n is a, c, g, or t
  misc_feature (66)..(66): n is a, c, g, or t
  misc_feature (98)..(99): n is a, c, g, or t
aaaagtcccagaaatagctatttttctttccataccttctgntagagctcgagctgctctttccantgtcttatcccggtctcgatccgtgcgactcnnacaaagtttatggagtgaaatgtgaaatattgttttcaccaccaaggcattttttctgaaaacccggattcaaaaatctggggtttggtataccgtttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttataacgatttcgttttgttttggcattatgataccgaataactttcggaaattatgaaaacaaaattggagaaattcgaataattttttgactgcaaatttttttccttttttgaattgggttcaaaaaaattttaagagaatttttgattattaatttgaagtcttgaatttatttgacaaatc

SEQ ID NO: 45125 - DNA, 864 bp, Heterodera glycines
tccagaaaaaaaaattaaaaattattttatgtggcgtaaagtgaaaaagtaccgaaaaccttcggtccatttgttttgctgtgcaatcgcgcagcaaaaagaattctgacatttgtcaaatgctttaacttttagcgtgttcgcgttctcaccaacaggtcagtcattgtcaattagcagctgcctaatttgtaagtgaacatcaaattattgtcgatttgttttattggctgacttatagatcaaaatctgaatttttatacaattttccaagaaaaaacagaccaaaccgtaaatttcaaggattttcaagccctgatagtctaaacagcattaaaattaagaaaaacagtcttttagtttattaggagcattaattctgccgtttggataattgatgattttttcaaaatttactgactgtcgaatttcaaaacaatcactttctatcacttattatgatgctgtttagcgattaaagattgaaaaaacttaaggcgcaaatgtcggggcatggtttttagcacagcttgatgcttttaaggttactttatcatgctttatttttgcatttcggattttttgtgcttaatgcttaggcgccctatttttgaggcgcaaatgtcggataacctttcttacttactactgctgttttttgttaattaactgtcatttttcactgctgtccccatatctttcgaggttcgacgactcggacgacgtgcgctcgatgagtcagctgcagaaggaagtccgcgccattcaggacgcgtccaccggcgcgacgccggacgtcgtccgatattatggcctctcgttccatgaggtgagcagaatgtaaaacatttttctgacccattt

SEQ ID NO: 45126 - DNA, 800 bp, Heterodera glycines
aaaattggacaatggaaggaatgggttaacattttacaaatcggcaatgttttttctcttcaaaaggcatttggtccttttgcgtaaattaccgtactcattttccccatttttggattacggtaagatactgtggagtggggctgcattcccaaccaaacagttaaatggtgttgggcgattcgcccagtggtccccgcccgcgttgctcacttcgtgcgcctccgctcggcccctgccctgctcctcctcctcctcttcgtcctcctcgctctcttcctcctcctcctcttccaactcctccccattctcgtcttcttcctcctcctctttctcctcttccttttttatcgttcctcccaaatgggccaacattttctccaactccgattggagctgcaaagtgtcactgttcatttgtcgttctcctttcttctgctccttttcattcacttcgctttttcgttgcttctcttccttcacaaacattgagctgaaacagaaaagtgaagaagaaatgacaaaagtgagtatttgcaagaaaagtcgaaatggcaaagaaaaatgccaaaaaatgaattcttttgctggtcgattaagtgaaaaggaaatgcaaaaggaagggaagtgatgcgggggaggggaaggccgtataaaaggcgaagagttgggggattggacgacggatgggattggccggactggaaaggaattaggaggaggacaaggcacatttggcgatcgatcgccgccaaaaggaaaagttgtgggagcagaaggaagatgaatgggggcgggga

SEQ ID NO: 45127 - DNA, 1387 bp, Heterodera glycines
aagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaggtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagcaaaaaatggtgtaagtaaaaatcgtaattacgctcaaaaagcttctcaatctattgtatcgctttcaaccgccggccccccaaaaagtccaatttttttgcaaaaaattgtcccaaaattgcaaaaataggtatttttaggaaaaatctgttaacaaattgcaaattttcaaaaaaaaaattcctcgcggctcctaatggcatcgtcgcccatcccccttctggctgttgcctaaagtttttttgaaaatgagtgccgcaaaaaatggtggtgaaattcgatgttgagacgggtgcgcaaaaatttcggttaaaccccctcccccttgtcaagtattttaaaccagggcttccacaattaacaccaagcccgaaaaaataagattttaggctcaaaaataagaacattttacaacattttttcaaatcagttacttttacaatttattcgatcaaaaatgtatcaaattttatatttttagtctcacattatcaattttaacaattttggggaggaaaatgcaaacttgtaaatttcagtacattagggatcaaaagatcaaaaaaatttgcgtaagaactttaaattttttgataagatagtgacattatgccataaaatttcaaaattataag

SEQ ID NO: 45128 - DNA, 1325 bp, Heterodera glycines
ccccccctcaactaatagagaaaaattttaatgatgtaccttttaagcggcacaaattattacgagagcaaattttgtgatacatttaaatgtttttttttattataattaaaaagtgggaaagggaaattaataatttcattttaaattttaaaatgcggctttagctgtgcacaaaaattgtttaatttattaaaccatttaaatattgctcttgcctttgaattgtttaataatataaaaattttaactagaaaaaataatttaattttttttaattttaatttttttcttgaaaaattcctcttttcatttttgcctaattgaaaataaaactcctatttaaataatttgtgttttttaatcctatcagtcgatttgtatggcaaaatttgagcgcattaaaaataaatccgttccctggtaataagttactgtaaaatttacttattttaaaattatttaattttctctgagatttgagttggcaatttgaaattttaacactgacattttgcaggcattttctagtgatgggggacaagagtgcttaagtgtaagcagaatgcgtacgcgccgagaaaaatgccatattttgatttatgccgttgcattttccacatttgagaccgcttgaaattggtcagtaaaaataattcaaatttccaacatttttgtttttgtagtcattttgcgattattcttttaagctgctgatggtgccaaaaatttaattttgtgtgcaagtggtgccaaagtcggtcagctgctgatggcacattatcacgtaattatcatttggcacttatgaaatacgtggctttaatatgttttcgaaacaactgaaaattcaattttttaaatatttgtttttggattttttttgcagactgaatcaatttttttgataatttcttaagaattattattttttatagtctctgagttcgtcactttttaaagtaggtttaaactttgaactttatatctaatgaattaatatttgctctgaaattaaacataatttttgctataaatttattaaaaactgaaatttgcaggaatttcgctgatttgttaaatgatttggaaaagtgatggtggacaagagtgcttaagtcaagcagaatgtgcaccgagaaaaatggcggatttggatttatgccattgaattttcccgccattttacaccgtttgaaattggtcagttataggccaaaagaattaaagtaataatttaaattaaaaaatagtagtaaaaatatttttgttattaacctttatttaattactttcaattattcagtcaatttctgatgcgcaac

SEQ ID NO: 45129 - DNA, 1062 bp, Heterodera glycines
  misc_feature (8)..(9): n is a, c, g, or t
cttgcatnngcgctgcaggtcaaaaaactggtttataaaaaaaaaatcttccaagaaatccttttgaaaaatttaatccaaaaaaacttaattacggatcaaacttacggaaaaatcaatcccaaaaatccgtaatgcgtaattaagctcagccctggtcctggcgcactcccactgcgccaatcttataatctgtgcgaaatcccattttattttttaaactttttttcagtggtcattgtgtgcaatattttccatttggctggtgctcagcacattggccgatgaagaaacatttggccaaccgcaagtgtactactcaatgatttcacgctacaacagcgacattgtgataatacttaactacgtgctgttggcacttgttttactcaccatgatggccaacattgccatcatggtacagaaccggaagatgcagatgcgcagtcggaaacggtaaacaaaacaatacttgaaaaattgatcagaggcctgttcaagaacaatcttgacaaaaaaattgttatcaataggggcctagtcgtttcctaaaattgccagtttggataaaaactgcaaaaaaaatctaaaaaaaaaatatattttttatttcataaaatttttatgtcagtttttgaaaaaattataaatataatataaaaattttaactatatcgcaattatctattattgtactgcttaaaaaatactggtgagaaaaaattaattttgtaaatgtcggtatgataattaatactagttgttttctaaaagtctgaaacgtccatttggcactttttgaggaaacgtacatttagtagcttttaggaaacgcctattaggcactttttagtaaatgctctggcaaatttataatcatttctttgtcagatttgccaatgccacggtgtcgccatcgtttagtcatgcccaaatggcattcggaataaacttccgcaccagcaccagcaccactttcacggatgaccaaaactcgtatagtttgagccgtgcctatcagctgaacgagaacattgtgacgctgcagcttttcctcccact

SEQ ID NO: 45130 - DNA, 932 bp, Heterodera glycines
tgttgtagcgctgaataaagcattaatagtgtgtttgaaaccgcacgaaaaatagttattgacaaaaaatggctatctctgaaagtcacgattaaatccctacggtgaattggacaccatcttttgtcttctgttgtagcgatgaataaagcactaatagtgtttttgaaaacgcacgaaaaatagttattgacaaaaaatggctatctctgaaagtcacgattaaatccctaccgggaattggacaccatcttttgttttctgttgtagcgtgaataaagcactaatagtgtgtttgaaaatgcacgaaaaatagttattgacaaaaaatggctatctctgaaagtcacgattaaatccctaccgggaattggacaccaacttttgtcttttgttgtagcgtgaataaagcactaatagtgtttttgaaaacgcacgaaaaatagttattgacaaaaaatggctatctctgaaagtcactattaaatccctaccgggaattggacaccaacttttgtcttctgttgtagcgtgaataaagcactaatagtgtgtttgaaaacgcacgaaaaatagttcttgacaaaaaatggctatctctgaaagtcactattaaatccctaccgggaattggacatcaacttttgtcttttgttgtagcgctgaataaagcactaatagtgtgtttgaaaacgcacgaaaaatagttattgacaaaaaatggctatctctgaaagtcactattaaatccctaccgggaattggacaccaacttttgtcttctgttgtagcgtgaataaagcactaatagtgtgtttgaaaacgcacgaaaaatagttcttgacaaaaaaaggctatctctgaaagtcacgattaaatccctacccccaggaagcatcaacttttgtcttttgttgtagcgctgaataaag

SEQ ID NO: 45131 - DNA, 1028 bp, Heterodera glycines
aattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaaattaattatgcaaaaaacaaaataaataatgaactctcttccttaatatttttcctgcaccgaa

SEQ ID NO: 45132 - DNA, 684 bp, Heterodera glycines
gagatatccattgttgtgggataacctttaaatataaaaatcttctgagaaataatatggcgattgtacacacccctcggtatcatacgcaagcgtctgtggtgaggtataaaatttctcaaaaaaagagatagccatttttcggggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtcttttgcgcaccgccctccctatcatgctcgagagcatttgtatgtgtataaaatttatcaaaaaaagagatatccatttttctgggatagagtataaatataaaaatcctctgtgaaataaaatggcgattgtgcacagccctccgtctcatacgcaagcgctttaaggggtataaaatttctcaaaaaaagagatgccccctggtagatagagtataaatttaaaaattccctcaaaaataa

SEQ ID NO: 45133 - DNA, 1031 bp, Heterodera glycines
gtgaaatttttgatggcaaaaaccatgtattagatttgtatagtgtagtatcttgtttactgtagtttcgataccattcaattgtttgcgtactgtcgaatatattccaatttcaataactgtaattttgtttatctcattccttaaggcataaatcggtgtctgttgctaataaaaattattgttggaattgttagtacgcagaaatttccaaggacgtccttgaaaaagtatattagccagcgcctagttatttggcgccaaggtcttaatttttataggttgatcaaaataatttatacgtatattaaaaaatgcaaatattttaaatcagccctatctgacaaatgaagagcttgtcggcaccgccggactcaaaatgtacttattattcattcagctatgtactttaaatatgggacttagttttttataggatttcattttttcaatttcataaattattttacaaataagatttcgtaaattatgaaattttgaacaaagtcttcttaacaaattacatttaaaaaaattaaaatttttcctcggcggtgtctacaaaacccctaattttctcaaaattgactcaaaaaacaaaatttggtcatttttggacaaaatctattaacaaatcgaattaaaaattacaaaattttcccggtggcgcctgtcggcaccacaaaacacagcttttgttcccattgaattaagaacacattttataattcaaatttctatatgttgaaagcttccaatattaagtcagttaaaatttttagatttttggaatgttgaaattcagtaaattggaatttttttttaaaattttatgtatttcctgttttgacgggggaccatcggaacaaccctacttaattggaattgaaaaatttatgacaacttccgctatttttttttattatgtcaatgacgtgtacattctgtcaatttttttgaatgcgcaaatataaaattataaaaaaaaaacatgtattattatttgtatatttattttaaatttttttttt

SEQ ID NO: 45134 - DNA, 998 bp, Heterodera glycines
atttgtgtagttttaaagctgcatccgatggcgtttcagattttgaaaatttcaaaattttcgagctaggccccctcgaaaatttttcgtttttgaattttattattttttgcagatttttcccaggaaaacggagaccactttcaagcaaccgtttttcgagctctatcgattggtggcatttttgaaaaaatttcaaaattttccggaaatagaaaaattttccggaattgagctccccatttcagtttgaggcttataactcgtcaggcgttgattttagcggaaatttgtcttagagcatttttgtagaaaattttaagctctatctaatgtactttatctcatgtttttaccatgagtttaaaaaaagttataaaattaattgtgattttgaaactcaaaaccataggggggaccccatggttttgcatttcatgaaaaatttttttgctcctaaattagccaaaatgcatttttatggcctaatttatggtgctgaatacgtatatacgctttattttgcgtttcagactttttggaaggtggttaaaattttttgaaaaatcgtcaaaatttgagccccggaaaatcctgtgaaatttcgaaaattcataaatctcttcgtttttggtcaaatttagtggaataaagctttaaaaatagagaaaaattgggagaattttatgagatttatttggaatttctatcttccaaaataaaaaagttattccagaatttctggaaaaattcgatttttcagaaaaaaaatcagaactcccttctgaaaaagtattttataaaaataatatactcaaaaaatccgcaattttttgctctattttataaattttaatttagcttattatcacttttttgaaaaaagttatagaaataaaagtgattttggcattcgggaccaaaggggtgtaaccatgatttttgagtggaaaatttttttcaccataaaatcttccgaaaaataggattttaggggt

SEQ ID NO: 45135 - DNA, 1263 bp, Heterodera glycines
tttttttgaatttagtgaaaatccgtaattaggttctctccttaattgttttaaataattaaacttatcacttatgaatatttttaaagtttttaatttttaaataattttgttacatttgtgaaatttttgattatatgtatagcattttgtttaaatgatataatattattaaaaaattaaattaaattctaattaggcatttttaaacaattaaattttattctacaaattgtttaataattcacatttaaaactgagaatattaaaaaaaattatccctgtacatacaataaactgaaatctgagcaaaaggcagtcaataccacacaaaaaaacttctgatcagtaatgagtaataaatgcttcatctcttcccctccccaaaaaatattacgtgaatgagtgatcaattgctttccactggcattaaactcgcatttggccaacatatccaccgaatcccccgaggggctatgtgttggattaagctatggatggatgaatcacacaaatccgcacttcttcaactgacgattggatggatttggtttctgtctcggctcatctccgaacctcctctctcccatcaatccattcatctttctgtgccacagggggacgaagagatgaagccgcttcatccattcactcattcattgccttggcccccatcgggccaatgctttggcggcgaacaaatgtttagttgagtgggtctccctcgctccctccctgctgctgttgcttgctcagggccaacatttgctggcatatccgaggagcgtatgatggcccatgaaatatctgcggaaatgcctcttccaaaacacacccatcccaaacttttataatggcaatgatcaaacaaatgatttgcttttgaatttttacgtttgatcaagttttttaaataaccctcattaaagcatttaatttttttgaataggttatttcggcttttaaatgattgggactacaattgaagaaatttttatcttctattttagttttaaatttttctgtttcaatcgttttttttttgaattaaaaattttatttaaaattattctcaaaaacaatttttttaaatttaatatttcattttttaaaataaaagataattcttaacattttctaaaacttttttttctaaaatttttgttttctttgaatttaaccgcaatcactgaagagtaacaggtgttcttcccatttcccattgctcccactctcccaccccattaaaataaattttgatgt

SEQ ID NO: 45136 - DNA, 1660 bp, Heterodera glycines
atttgagagctgaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagacagagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagttccgatccacgaactcatagggcttgtcaaccatggcaatacgccactcactcgtataccaacaccacccaccaactttaggttcagcatccccagtgctgagttccccacagcatttgtgccttaggccacatttacacaagtcaattaactcgccaaatttctttaacacacagacgagctgcatgtttattcatttcgacagctgccaatcgctggagaaactgaggccacgacaaaggtggcaccccagcagcagccatcaccgttcaatgccgagcacaagcgcaagcaagcacttgaacccagacggccgcgctccccatagcgaaatcgcatcttttttccagccataatatcgcaaaaacggcccaaccaccacagtcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcaataggcgattggaataaatggacaaaaaagcaaagtcaaagacaaaccttaaagcacta

SEQ ID NO: 45137 - DNA, 1447 bp, Heterodera glycines
  misc_feature (1280)..(1280): n is a, c, g, or t
  misc_feature (1289)..(1289): n is a, c, g, or t
  misc_feature (1308)..(1308): n is a, c, g, or t
  misc_feature (1318)..(1318): n is a, c, g, or t
  misc_feature (1362)..(1362): n is a, c, g, or t
cccgttcgaggccgcgaagcggcctaaaaatcccacattttcttttaaaattccaaatatcttcataacccatagcttatctaggtagcgaagctcccaaagcgcgcaagcgctttttcccagctaaatagccgacggttcacgcacccgctagttactatatatgttatattgacaaggagtttcgtctgcaaaaacaaaatctcccggccgaaggccgggagcgccctgaaagtagtggaagggtcttacaactttttgaggcgcatccgggaaaaatataggttttccggtccaagggccaactgagtaccagggactgatttctcattttttcgtgcgtttgacggcccataactttttttctaaatcccgattcaaaaactttccgctggtaggaacctaagttgaagtgttgtctaaaagtcaaaaaaaattccaggcctctacctatagtaggaagggctgcagaaaataggagaaattcagtaccaactttgtccacttcagtcccaggtgaataccgcgtcagcgtttgatctgagcgagggggctccagcggacttattgtagagctttgaaagctcgatttttccaaattttaaaatttcgaaaattttcaaaaattttcgagttaggcctaaaaaacgtttttttggtttttgaattttatgattttttaacgatttttctgggaaaaacggagaccacttccaaaacatcatttttcgagttctatcgactggtaatttttttggaaaatttcggttttttcccggaaatagaaaaaaattttgggctgagcgggacatttgagtcctgggcccataactcgtcaggggttgattttagcgaaaaattgtcttagaacatttttgtagagcttttaaaatgctatcgaatagtgtattatatggccggaaattttcaaaaattttcgagctaggccccctagaaattttcggaaattttttttgggttgaaaaagagggtgaaaaatttttttctgggtattttgaaggtgctgagtacgaatatgatgtctattttaagtttcagaatttttggaattttttaaaaattctttattttttggcaattttttggccctcgggattttggcctaatatttgaaaattcatagctcacttcaatgtgggactattttaatgaaataaagctttaaaaatggagaaaaatatggagaattttatactatttatttcaaatttatatctcaaaaaagaaaaaacttattccacaatttctacaaaaattcnaattttcanaaaaaaattcaaaactcgnttctgaaaantcactctagaaaaataaaatactacaaaaatccccaattttttnctctattaaagaaattttccttcacctttttatcacattttaacctatgtgggaaaataaaagtgattttgggattcgggaccaa

SEQ ID NO: 45138 - DNA, 937 bp, Heterodera glycines
agaaattcttcaaaaagtcgttcctccgcagattcggggaccgttttcctattgctagagacatcacgcgctcaccataaaaatgtcgaaatcatttttcgaaaatttatctagttcgactcaaatctgctaatcgatttcacggtgtacaggatgtttgtcgaaacataactcgtcaggcctttaagatagacctgccattgctattcctcgcaaattgtgcagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatgggttggggtcgctgggacaaacagaagtagtgctacttcttgcgcataagacttagccaactgtaaacagcaagccatccaaatgcttcaatgtaaaaaaaaattacatttgggatggaaccttttattttacctcacctctcttttcgaaaagaaa

SEQ ID NO: 45139 - DNA, 1401 bp, Heterodera glycines
taaatataaaagtcgaaagcgcttagtgtaaaagactcccacccgataatatagtaataccaaaaatcaaatagaaattcgttagtttttttgatactctctaaaaaatacaaatgcaaaagctgcattttatggttgtcatgctgtaagctactttttaaaatgtctagtgctaattgcaaataatagcttaatggttggctcccaaacatgcaaaaatttcaaatgacaccaggtttttgctggatttggttttccaataaagcaaaagatcatgtcgcgccctaatcttgactggtacggggtttgtcgggacgaaattgacccagaccaatctcggaaattaaaaaatatggggttttcccataaaacccgaaaatgcttttacaaaactaataaacaattcaaaaagtagtagtacaaacacacccgagtcgccggggaagaagggctgaccaagcaaaagttcagcaagcactgaaaatttaataaaaccgtagaaacaaaaactttttttaatttttagtttttacctgtgcccgcggaccaaacatctgaaaaaattgcaccctttttatgtgttggtaaaaaatatatgctaaaactacaataatatttggtttgcttgtaccaattttggtcgtataatcggtggcgccaaaaatcagttctggcgcgcgataatacctgaaatttagcagaaaaaatagctaactattttgatttttttgttacgcaaaaacccaaatcttttccctgtggctctatctcaaataaagctgaatcccatccatttttgaaaaatatgagaaattttcggaaaattcattttttgcaattataacgccaaaatgttaactgaccgtgaacaaatgtaggcgacgttcggctcaccctggaccaacgtttttgcggacccgaaatcacaaagctaaaaagtagtgaaaaattaaaaataatttttttttaaatgccccactttcaatactgatgtttgcggattgagcaacaaattctgcggttttatgtcccgatgacaaatgccaatgctgtgaatgtaactaaaaaattgaagggggatgatgggcaataaattaaaaataaaaatgaagaaaaaaatgtaccccaatgcccggaacagttgatacatgtagatctgaaaatgaatcagttaaattggttaaaaaaggaaggtttttatgattttataaattggatatataattgtacccaaacacaatttcagggtaagcaaaaccttggaactaattagcaacacgcaaaattgggaatttataattaccgaattcttgacgaaggtcaagttccttacaatttcgggtaagtattttttaaggattaaaataaagcaaaaatgtaatgaccaagaaaagtctaaac

SEQ ID NO: 45140 - DNA, 705 bp, Heterodera glycines
tttttattttttcgaaaagataatttatttttaaattttacataaaattaagtattctaaattgaaactcttttaaatgtttgataaatatggctataaatcaatgatgcactaaaaatccaacgaatatgccctaaaatataccttaaaaactgaaaaaatgttttttaacctcaaaaaaatgacgaaaattgtgtaaaaatacaaaacatacatcaaaactttggctaaggagcgttttttggacaattgcgaaaaaatttgattttcaaaatttatataggtatgcaatttcgaaatgtttaatatatgctaaaataaaatttacatttttggccataacttttttgaaacttaatcaaatttttgaaattttgcaggctaattgaggacagttagggctatctaatgtgattaagaattaaatttttagttggataaaaaatcgccaaaaagtcacaaaaaagtcataaaaaacgcaaaaaagtcacgaaaagggttttgaaaaaaatagctaaaaagtcccaaaaaaatccaaaaagcatgaaaaaatgcaaaaaagtcgtgacaaattaggcgatattaaattatagaataacattttgatcagatttttagtcagttaattttaaaaataggtacctaaaataggcataaaaaagtgattcttccaacaagtacgaaaaatttcatccaggtttcatt

SEQ ID NO: 45141 - DNA, 929 bp, Heterodera glycines
ccacgacaaaggtggcaccccagcagcagccatcaccgttcaatgccgagcacaagcgcaagcaagcacttgaacccagacggccgcgctccccatagcgaaatcgcatcttttttccagccataatatcgcaaaaacggcccaaccaccacagtcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacgacatcactcacgatgcaagcggctaacctctcaacatgagcgcagctgtaaaagtctgctctactgtctaacaaccaccctgacccagtaatctgagccgtatacaagccgattttgcgctcccaacattccaccatggtacacgagtgctacgcctttggcaatgcgcgacgaattaagcacgaactatcccgcctgatgctgtggcattcgtgctgcaccgcaagcggcgcataagtattgcctccctacaccgattagcgagaatattgctatcttgactaggcgcgattctgacttacaggcgttcatccataatccctc

SEQ ID NO: 45142 - DNA, 1574 bp, Heterodera glycines
cattttttatggtactgcctattttgcttttctcaaatttgttttttcactatgttatacatattctcaaattccattaagtaggttaaaaaatcgataaaaaagtttcaacttatggtaaatgttaaaatgctctcagaagttcatgtattaatttagcaactttctttctcattaatttctgattcatctttatccttatctctcatgcttgcttaacaaaattcttaatatttctcctaacgccaatttagcccaaaacaaatctgctaaatattacttaatcggaatcgtacgaatattcataaattgagtctttgatcaaaaattacgaataatacaattccaaaaattaaggatatgaaaaagttatatttaataaaaattgtaaaaaagagattcaacgcaaaacacgataagttttcataaacaaaatattttatgtctttaaaagttaataaaatcaagtaatatttttagaaaaatttttaaataaattctgcttacatatttatactaataaatgatttaatgacatcttttaccaatatattaaaataaatgttttttcttttttgtcgataaataattatattttaaataaacagacattaaaatggatcatttattttatcaaaccattcaattgttagttttttgattattaattattaatttccttttgaattgtaatttaattacaaatatttcgttgcatcgtttatttattcaataaaaaggataaattaaaaatcttaagagtaaaacctgttagtttaaattttgaaataataaactttatttaattgatataatatataattattatttttcgtttaaaaattctcaaaatttatatgaattttttgttttatcgtcaattacgctcaaaatgagagtttcacaggaccatttcgatttttattaatgatacgattttttatacaatttttattttcatttattaattttttacattaatgcaatctttttttgcttgctttattaatgtgctttcgaaatatcattttgaaaatgtttatttctttgtttattaaaattatttttgtaacaacttaatatgattcttaagaaaaaatggtttatgaaaaaatatagtttgatattgaaccttttctcgcagaagaacaaatttaaatcaagaatatttttttaataatttatttatttttattccttaaaggtataaatgaatcctttaattgattccgttaactttcaaggctctttggtttagaactactaaaaactaaataataattgtataattggtgaaaatttacaaaatatattatgaaaactaattaaatttaaaataaacgaacacatgttaaactacccgtttttatagctaaataaattgattcgaatacaaattataatccctatactttaatttcatatatgatataataattgtaagaataaagatatttaaaaaaaattaattgtgattgaatatgaaaagttaaaataagaacctttttatttttgagtttatacaaattaacacaaaaaaggacaataattgttaaatctaaatttatttatat

SEQ ID NO: 45143 - DNA, 1387 bp, Heterodera glycines
taaccctttttggtagaaaacacaatcactttacttgttttctgctgacatgagcaataggcccatcaagtgacaaatctacagggacagcatggtctaaatggggacaaataggctttggctgtgcgatttcttcacccaagtcttactcctcgtgctgcgcccaataagcactttgtcatcccgaatgtcataagtcgttgttcggccaaacaaaattcccatcgaattgggcgacatgttcggaagtgaagtgggcactcccgttattgcaccaacgaatacattctgccaatcattcgtctctctttcagtgatcaatgctgatcgggcaaactgtcgttcctcaacatccaacggcaacaagtcggccgggtcaatcccgacaagtgagccaaggtcatagatacgctcgagctaaactttccgttgaaacatttattttgcgatagttccgtgattacaaggctttcttcttgcgtgtcctctttttgtggggtttggtcaattaacaaccgcacattcttcagctctcgccagtgttcctcgacagctttcaaagttcggctgtgatgaaatacctgttggttctgctccaataattggtcaatgtgcaattggagcaaatgttgttgaacatttgaagggatttgccggatcaaatgttcttcctcatgcgaaaagggaattttggattgaattgctcggattttctccttgctgatctgttccatcctttttcttgtcaaagtgcttgtctgttcgttgtaaagcatgtcgtaccatcgctcttcaatttcagccaaggaatagcgcttcgaaaatttcatctgattatgaaccacattcaggtcggaaacctgaaaaaggcataaattgatggggaaaaaacgcaaaacgccttacatgagtgaccgcagcaattagcgcaatatctggaaaatatatcatgtctttttagcattacaacaaaaaatcccagaaaaattcagcgatgccgtcgtggataatttagaaatttccggcttgctaataaaatcgactaaaatccaaattagtttattaatctgagttttcgagagggtaaattcagaaagatgaccaccacccgttaattacagaccatcctcgacattccatcgtttaagtgattcaacggacgaaggacatatcgggacaacccttgctccctcgccatttggcatttgaacgtttgtctctgggaaatcattcgtcatggcattatttgctccttttcctgctgctgtggtcactttcctcagtttgctacccgttttcccggaacaaatggtcgatttccttttacgcggtgcttcttgaacacaaaagcaattttcatagtacaaaattcattttaccttgcggg

SEQ ID NO: 45144 - DNA, 898 bp, Heterodera glycines
aagtgtacaacaaatatgtggcgccggtccctcccgagacagcgacgattgggtgtttaacaaatgagacgaacctatccattggtgttaacaaaaacagtgctaaaagggcaattaagtggcgattgaaatttaaaaaaatatttgtggccatccaaagaaagacaccaaaagaaacactttggaccaaggcaaaaaagagtacatacacaacaacaattcggagacaaaaaatatctgccaggaaaaaagcatcgattcagacaagctttttggcctcgaaaaagcccttcaagtggcgcatttgccaagcaccggtcaaaaggaggacaatcgtttgtccgacggaccaccaaagcacgcgactctgaaaccgaaaaaggcaatttaaagcgtgaaggcaggaaaaagcgaatggtaaatattttggcaatccgttcactttcttgtccccgttcttacgttggtactttcgctggtctgtcggaaacgctcttcgcgatagcgctggtaattctgctctttggtgatttgttccacttggtccaacaattgccgcacacgcaattgaagttcgttcaatttgtctttggctgccacctcaagttttttttttgaaagggattattaagtgactcgaaaaatcaaagtaaaaaaacaaaatgagattttttgggccctttacattgtagccccaacagataatattaaaaatattatgaacccgaagaaacaaaaattgctatttccaaccaaaattcgttcaaatttactggcaaaccattttcccaccgatctcgatgtcgacttgcgcgaagcctttttctcgtcagtggtggtcgactgtgatataattttttgattttgcgaaaaatgacctatggtaaaaaccatcaaa

SEQ ID NO: 45145 - DNA, 1314 bp, Heterodera glycines
gatgccgccggactctacaaaagacatttaccggtgtaaatttaaaattagcgcgcaaaaatttacgccaattacgctatttggcgttatgagaattttgtctaacactgggcttgacccatagtgagaaagttataaacgaaaatgatcagcaattacttatgtgattggtaattgcctaaacgctgcgattttatatatttcaacttctttagactttgagctgctctaaaaccccggataacaaattttcatggttttttatcacaaaaaaattttgcaaaacaaaagggccctcccttattgtttttaataaaattcaaaaggttcttctttaaagtagcgcccaattttcataccaatttaaatactaagtattatttatttgtatttatttttaaaggaaatggttaattttatgaataaattacgtggtgaaaacgaccaaacgatcaaacaacttcgttccgttattgccgaattaaaagatcaagtggccaaccagtacgttcgcattgacgaattaaaagatcaagttgccgaccagaacgtgcgtattcacgaccaaaaaaaggttttcctcacaaaatcgctaagagtttattggattcttgaaatttaggagattcgaaaactaagggaagacaaccaaaaaaatgcaacatttttccgttctacaaaaggcttgttgtgtgaaatcaaagggcaaaaccgtcggatcaactcagcaatggcaatgttcagagaacaacactttggttctgagacttgccaggaacatccatttccattggtcggaaaatttatttttgcttttataataatagcatcttatgtgccctgataatttgtgtcggtgtcggataatgtcacttccaaatttaagggggggggggcttcaatatcccactatgaaaaaagcaatacagccaaaacttcaaaaatagaagaatttgcacccaacaggactggtcgttcaattcggtccgcggcgtggtgaccgacttgaccaacaaacagcgttgctctctaattgaagcattccgtgctcgcatcatttccaaggaagattggatggtttgggacgatgtcggcggacgggaaattgagtttatggaggcagaaaaaatgcgcattgtgagcattgaggaggacttttacaagacggacccgaacagtggtgaacgcgtcacgctggcgaacgcggcaatgtttcaaaacatttggccaatccgttgcggaatgaaaaaagttagtggttttcactggttagatttccgaaaatttgggtttattttaaaatgaccatccttt

SEQ ID NO: 45146 - DNA, 1387 bp, Heterodera glycines
  misc_feature (1248)..(1248): n is a, c, g, or t
  misc_feature (1282)..(1282): n is a, c, g, or t
  misc_feature (1330)..(1331): n is a, c, g, or t
attcaatctaactaaataaaccactaattacacaattcttcccataaaatttaaagctatctatttgcatataaggtcaatttaatatttcttttgcattttatttgataattattatattatctatatttccataattaagcaaatagtttaattcgaaagtaaaacaatgaaaatattattgaggtctgttaacattcttaaactgtgtaaaattagctgacaatgataaaattgaataaaattaataaaaactaatttattaaaatcattaaatttgataaatctaatccaattactttgttgtttaaacaactaaagaaaattaaagcatttcgttttatttcagtaaatgtaaaattaatttaatacattaacattaaaataaatttaaactgccattgaaagaagtcaaaaaatgagaatataagtaaaaaagcttgtcactctgtgcatgttttatttcatttttcttacctttttcttaatttcagtcgtactgtatcatcaatgaaaaaacggcttgacagctaatttttgctaaatatttaaagaatacaacatagttaaaatttaatacaacaaatgcaatattttgaagtgttttttagagatgattttttaattatgaattatttttataataaattctctgaatttaatgctcggattaaaccatggccaatttcgataaactaaatggtgattagtttacctttgtttgaagttattttattataattattttatcagtatgacatattatttttcagaataaaatatttcattattgttttttacttatttgaaatttaattccagtatattcttctattactaatgatttctaacatattattatgtaatttcattttaacatgtaattgattaagtttggtctaggaattattatggacaatctttatctaattctcaattatttttttaagcaattcacttctcatttttaaattattattgtccaagcttttcatagcattcataataattattttcttcaattaatgctttaaatggttaaaacagattgtaatgaatctggcaatttatattatgacattttttaattattctatttcatacaatataaaaatttttgaattttatttatcgtttttatcaggacacaaattttgattaatagattaattataggtttctattgatattataatatattttgatcacgtcaccgaaggacacttggatgaaactgatcttaaatgngttggaatagaacaatctaatctttgcttcattntatcgcattactattaattattttatttttatctctaacattattaanncataatttatttatttataaaaaataaattatttgttttttataggaaaatgtttt

SEQ ID NO: 45147 - DNA, 563 bp, Heterodera glycines
attcaaaaattccattttttttctaacgcggcgcctatcgcggtaagggatgaactccgtctagccattccgtatcagcaaagttcaaaaatctatctttttctttgttgataaaaccagcaaaacagtatcattcaactttttttttctataaaaatggcctttttgtctaaaatctattacatatgaaatcgcacaaaaaatccaatttttaccgctggtgcctgtggcgccgccggtgaattttcttaaaaactgacttaaaacaaaaattggtcacttttagacaaaattttcaaaaaatcacactcaaattcccaaaaaaaaatttcccggcgacgctaaggcaccgccggatccttccgcaaaggaattaaggaaaagcgcaccgcaaaaaaaaactgttttaaaaagcaaaaattcgtcaaattcggtgttgaaagccccctcgcaaaattggccgctgattccccccccccccaagggcgtaggcaggggcggggatgaggtggacaaggccccaccccctgaaaccaaaaagtaaaaattttcagaaatttttt

SEQ ID NO: 45148 - DNA, 1240 bp, Heterodera glycines
  misc_feature (1197)..(1198): n is a, c, g, or t
aaattatatagctatttttctcctcaaaaatcgccgaaatcgaccattaaaattgtctcttttctctatttttttaattgtttttgttcgttgtgcgctatttttatataaaagtttattttgccattttccctatgagatttaacaaatttataagcgctttgctggtggcgtagaagcattttcggcaactgtgaactttgcggtgctaaaccaaggccacctgccacctaacactaacaaatatgtgaaccccccaacaaacagccaaggggcggccgagacagggttcagtggtcgttactgtggacatgccaccattagaaatgaattacatataagtaaaataggttaaatggcaaaaataaaccaaaaaaaagaaataaaagcaattagacagacaacgaataaaataattataaaaatgaagaaaaacacagattttttttttttggtcgttttcgagagtgagaaatagggcgtcggaaatttttttgttttcgtttttgtgtttgttttcgtatttggttttttttctctcttcactatcggcagtaattatatggctgtaagtttttcgtaagtttggcattcgacaaaaaaaaaacgaagggtcaaaacgattcatttctaattgattcccattcccatctcagtgccgttgaccaacaaaaatagaggaaatgaggcgaaatgtggacaatgacagtggtgcaaacaatggcgcgaacatcagcagcaacccgaaaattgcccgggatgcggaaattgctcatgttgtggacactggaaatggcgcaaatgacgcgcttggcgacggaatggacattgggcactgcccaaactgctcgtggcattgcaatgtgtgcagtaagcgaatttttctgttctgcattcaatttcgttcaaacatttctttgattcagtctgtcattaccgcctaatttgtttaatttactatcaaaaaccacaaaacggtcaaatttttatttttttttccctgttatcaatttaatcaatgtttttgggctgattttccactaactaattcaatttgctaccaaacaacaaaataatggtcaattttttttctcttctctattttttttcgtcaaaaaaaaacattgccgccaaaagttcaattccctattgaaaactatacagtacaacaatgcgcggtgcggagaacattgcacnnttgaacgctatatcatacttatcttttactgtaatcgccgat

SEQ ID NO: 45149 - DNA, 1184 bp, Heterodera glycines
cgacgcaattgggagatggatttacagaacagatttcctttatttttgaggaaacattgggactttgcaccaaaatcacgtcccatctcaaaattaaagaaaattcatctcccgttttttgtgcagcacgaccaattcccatcggcgttaagcaagaagtggacaaggaattggaccgtctcatcgatatgggcgtcctgaaaaagaccgactacagcagttgggcggcaccaattgttgctgttcggaaagcaaacggaaaggtacgtttgtgcttcaatttcagcacaggactaaatgccgcattggaaccacaccaccatccactgccacgacctgaacaactttttgcgcagctctccggcgcgaaagtgttttcgcaaatcgacttcaaagacgcatacttgcagatcgctgttgatgagcagtcacgcaagtttttaggcgtaaacactcaccggggtttatttgagtgcagtcgtttagccttcggaattaaaagtgccccaggcatttttcagtgggtcatggaccaattgagtaacggaattcccggagtgcttggctacatggacgacttcatcatcgcctcccgttcaatcaaagagcattatcgaacgctttatcaatttttccaacgaattcaggaatttggtttccacattcaactggggaagtgcaaattcctcgtccagcagatcaaattccttggccaaattgtgacaccaaatggaatcaaaccggactcggagaggacaaaagcactgcaagacatgcctccaccacacgatgtctcaactctccggtcgtttttgggtgccatcaattattatgggaaatacatcaaaaatttgcacgaaattagtgcaccattagactcattgctcaaaaaaggagctaaatgggaatggacacgggaacatcagaaatcatttgatgaagcaaagtctgtgttgctgtcagacttagctcttacacactttctcacaatcatcgtcaccgccgacgcgagcaacaaaggaatcggagcgacaatttcccaccggttcaacgacggaaaagagaaagttttccaacacgcagcacgaactctcaccaaaacggaacaggcctattcccaaattgagaaagagggacttgggctattttcgccatccaaaaattcatcaatttatttttggacg

SEQ ID NO: 45150 - DNA, 659 bp, Heterodera glycines
  misc_feature (53)..(53): n is a, c, g, or t
tcaaagtcggagttgtgcttttcagctgaaaaatgaaattaataaatataatnagggaaaatttaaaaataaattttaatacatttttaaaagaagggaaaaagtgacggtgccatcggaaaaagtaaacgaacagaaaaaaagttcggcacggagccgaagcattcataagaaatgcttcatcccaaactgagaataaatttggttgttttgaagaaacagcacaaaacacacagtttcgtcgctgtttaacaaaaggtagagagagaatgggtgaaaggagcatggatttggcacgggtgaatagtttaggagggacccaagtgtggggcggggggaagagaggggtcaaagtgccctcgaggggaatgctaagaggggtaggaacaaacggaggatgatgaagaaacatgggggaaaggggaagaacaaccgcaaaagagcaaacagttggagggaaaagcatgaggaaatgcgcaattgaacaagaaaaattggaaggacgaagaaagtggaagaaaaggggagggtgcggatgaaaatgggataaagcaatgctaaattaagccgagacgagaggagggcacacgcccaaacaattgtaattgacggacatcccattcaagaagttaaagagtttaattaatcttctgcgacct

SEQ ID NO: 45151 - DNA, 1347 bp, Heterodera glycines
tttctcccctctctctctctccctttctcccctctatctctctctcttttctctctctcttctctctctcactctctccctttctcccctctatctctctatcccctctatctctctctcttttctctctctcttctctctctcactctctccctttctcccctctatctctctatcccctctatctctctctccctctctctccctcactctctccctttctcccctctatctctctatcccctctatctctctctccctctctctccctcactctcttctctctctcactctctccctttctcccctctctctctctccctttctcccctctatctctctctccctttctcccctctatctctctctccctttctcccctctatctctctatcccctctatctctctctccctctctctccctcactctcttctctctctcactctctccctttctcccctctctctctctccctttctcccctctatctctctctccctttctcccctctatctctctctccctttctcccctctatctctctctccctttctcccctctatctctctctcttttctctctctcttctctctctcactctctccctttctcccctctatctctctctccctttctcctctctatctctctctctatctatctcttttctctctttttcgccctgttaaatgtccgtccgtttctttttgttgtctttcattgtttatttttgtgtttctttgttttggattaattggttctgctctgatccctctcttttgagcgtttggcggcgattgtttggagtgtgtgttttttgttgttttgttttgctaaatgacttttctcccccttcccttcccctcccatctttctttttttaaagacactttaacattgctcaaatggtcggtgggggggggggggggtaattaaaaaataaattaattgtgcttttccacttaatatcccccgcctttcttccctttccctctgtttggcctggcttcacctttctgatcgaaaatgatctccgcacatgcgttttgctgctgattgtccacttcgcagccgtacactgcgcccgttttctgaagtcgccgctgcgccgtctgagcaaatggcgcaccgaccaaaagactgaaaaattaaattggcacattcatttaataattgttgccatttgtgacgctgttttcataaacttaagtgaatttgtgccgtctttggtctctgtaggcgaagtccaaagaatagccaaacgccgaatgggcgccgggccgacgatggatttgcgcttgtcggaagtcaaattgaaagtgaaacgacagaaagaaagtgaagc

SEQ ID NO: 45152 - DNA, 1041 bp, Heterodera glycines
tattatatatatataataattaacttaaccatacaaacatctttaagctttcatacaaaaaaaagcctaattaagctgcctcaggacataattttgcttttttgcctaattagctgggccaattattggaaaatagttaattccaaataatttgaagtaattctccgaaaaattcaatgtcattcaaatttcgggccgtgagtcttttctgccaaaaatttcaaatttcataaataaaaaatgaatttattttttaaagcatatttatcattaatgattcagcagagtgtctgtttcttaatccgcttatcctccgcattctgagaataatttagcgcaacagttgaaaaggagaggagcggattttttcttaaatttcaatttttctcctttaataagcaattcagaaatgagcaagtgttacggacaaataaattgaagctgcaaatgaagtgccgacttttcatagcaaaattccggaggatgggacgcataataaaattgtgtttatctgatcttccgcaagtgcaatctcattaggagggaaaatggcatttttacttgaatgccacgccctcccctcccgcgttcaggaaatggcattttgaaaattggcatttgtaaaaggtgcgccatgactaattgccatagacgaagacgcttcaccgctggaggtcgagcagcgatttgcagaatgggggtttgggatttttttgcattcggccgacttgccatagaaagtggcttaattttgttattgctttctaatggcactctccttttggtatgtgtgtccttggcattccgttgaactttaagcagattgttgacatgagatgccaatgttggcatgggattgtttcgttgtgtgggggtgggaatttaaattggcattcaaagcttcaaaaaagtccattcagtgaccaacaagcatttgaaaatgacaaattattcactatatgtcatggaggaaaagctaatagttcattatctttgtagtcttcgaaacgaattccttacgtttttggcatttcattaaaa

SEQ ID NO: 45153 - DNA, 1009 bp, Heterodera glycines
  misc_feature (10)..(10): n is a, c, g, or t
cttacgatantttgaaacgcaaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaattcttgaccaaaaatggttatctcttttttctcattttttttaccgcaaacttggtaccaacagttgccttcttttgtctggccctatcaaacaatcttacgatatttgaaacgcaaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaagaaatagttatcacttttttctcatttttttaccgtaaacttgaaaccaacagttgccttcttttgtctggccctatcaaataatcttacgatatttgcaacgcaaacaaaaaaaattcttgaacagaaatgtttatctcttttttctcattattttaccgcaaacttgataccaaaagttgccttgttctggtctggccctatcaaa

SEQ ID NO: 45154 - DNA, 914 bp, Heterodera glycines
gctgggaacatttgtatggtacacaatttctcgtacaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaaaaatttctcgcaaaaaagagatagccatttttctggcatagagaataaatttaaaaattccctgtagaatagaatggccattgctctccgcgcccctctgcccatgctgggaacatttgtatggtacaaaatttctcgtaaaaaagagatagccatttttctggcatagagaataaatttaaaaattccctgtagaatagaatggccattgctctccgcgcccggcggcccatgctgggaacatttgtatggtacaaaatttctcg

SEQ ID NO: 45155 - DNA, 1060 bp, Heterodera glycines
  misc_feature (1010)..(1010): n is a, c, g, or t
taccaaactttgcagggatactccccggtaaaggactttcttacactgaaatgagcgccgagctagctggctcaaaacaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggattttgctccccataattgtttgagtacccccaaacggacactgaaaaaatcgatttttttgttttcggggcagtccccccgagccgatgcgcccagatttatggggagaccgaatccttccggaatagcttccctatagcctgtactttaattctgcgntgaatttttgctccccataattgtttgagtacccaaaacggacactgaaa

SEQ ID NO: 45156 - DNA, 855 bp, Heterodera glycines
gtttttatttgaagacccaattgaataataataaaattaattaattaattaagtttttgttgcgctaatatgatttggcacgggcgatcattgaacactccatttggtttttttaaatatttttgtttatttattcatctttggatgtttacaatatcctccttctcatcctttgactaccataaaaaagttttctttcatcattctttacaaatatttattttccccgaatgatcaacatttaaatcattacttttttatgttgcatatttttgccacagggaattagagttcgtcatttttgaaattttaatactaggattcgataattaaatcctgggttggattcagaataagaaaatctgttttcgcggcctcctgtgattttgatgcatttttcgaaaaattgcctgatcaaggtcgaaaaatcatttgaaaagtcctgacagggtccggcccacagatccggtctctctaccggaaaaccctattttttcctgctgatgctgaagaaaccgacaccgcgtccacttacgaagcctccgccccaaccgccgccaacgccgcgtccgcaaccagcatcgccggctcaacggccgacgccgcgtccacctaagaagcctccgccccaaccgccgccattaccgcatccgccaccggcatcgccggcgcaacggcggcgccgcgtccgccgcccaatcttccgtcggcgcgtcccactcacccgccgatgcagctggccggtgccagaagcagattctgagccaatttcaaagataatcgcattttagccatcaaacatattttgaccgatctgttgttttggcacattgccaaaatatggaaattcaattt

SEQ ID NO: 45157 - DNA, 1021 bp, Heterodera glycines
agcaaaaatcattttttaaaattttattccaaatttaaaaatcaataaaacgcttttttgaggcgcgctttttccaaaaaaactttttgggaagggggggaggcaggcgccgccgtgaaaatttttgaaaatttgattaaaatttgttgacagattttcaccaaaaaatcatcaaattttgtgatttttgtatcatttttctaatgagaaataagagttttggcgcgccgctgagaacagtttttcatcaaattactaaattttgcgattttgggccattttctaagaaaaaataggagttttgggggcgcggcggtgccgataggcgccgccgtggaaaaaaattggaaattttgatcatttataaacagtttttcactgaaaattagccaatttataggtaaaattttgaaaaattttatgggactttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgttttgtacgtatttaatgcttttggttccgtcggtcactcagtttatttattttttttcttttcggttcaagaagtgtaaaagagtgtttttattatatttatatttagttaaaaattacggtttttatttcaataatgatttttttaattcaagtctgaagttttattaatcgggattttaaagtttttgtttattttaaatgaaagcattatttttttttattttttttccgaaaatttattattgtaatcttataaaattatttatctcacaataatttttttgacttgcaaactgactattttaatttgctttttcatttagaataatattttaactttaaatatccagtttttaaaagagaatattcagaaagaaaataaaggaataacaccgacacatattaaaataataaaaagaattcgtaaaaacggggcagttaaccaataaaccgg

SEQ ID NO: 45158 - DNA, 1133 bp, Heterodera glycines
  misc_feature (80)..(80): n is a, c, g, or t
  misc_feature (116)..(116): n is a, c, g, or t
tgaaaagttaagcagccaaaaaatgcctggacatggatggacctaagcaagttctgaattgtacaatttgtatttcaatntagcaattcgaattatttttattttattcattttcncaatgaatcatcatcatatgtaaatcattcgctccattcatttacattctctcatttcgtattaacacagatttatttgtgttgggctactcaatcattttgaattcattatttttttttatttattactttactgaaccaaaataaaaatttattcttttttctttctttgaacaaaattttttttgacacaaaaaattcttcttaaaatgacctttcgcccgcttcaactttgtgctgctgcttcgcttctcatcgcctgcttcccccacttttgttctttaagtttttttttttttgcattttttgaatttaatggaatttttcccaattgaaaagctttgaattgcgtcatagaaacaaagggatattttgaaataccattcaataagacagaatgcttcagcggcgctatttttgccaccaatgcaattgcactgtcggtaaagaaactctagaaccaaaaaaattctcaattgacagtaaaatatttaaacgcttttggaaataataaaacaagaatttttgcttttttgaaaattacgaatttttattgaaattttgtaagaaatggagaaattttgggctattaaaatataagattttgggactaggtcgtttcgtcgctgtcgtttcggcgcttttggaatataactttttttcgttgttaactaaatccaacattgttggtatgattcgaaagtccttcacatgctctattatccttataaaaagtgaaaagattttattgcctgtaaaaaattaattaagaaaaactccaaaaatttcgaattttttgttaattttcatgataacttttttggtaattgtctaattgtttctaaacataaatctttcgaatgatgatactatgattgctagctagattggttaacaaagaaaaaaattatagtccaaaaacatgggctggcgctaggtatgtgcgagagtctcggttcacgattcccgactcgggaaatttctcagatttttcgcttctcggtctaggttcccggg

SEQ ID NO: 45159 - DNA, 1240 bp, Heterodera glycines
  misc_feature (1219)..(1219): n is a, c, g, or t
  misc_feature (1232)..(1232): n is a, c, g, or t
ccgacacatcggagcagccaaccgcgacgaacacagcagagacgggagcacatttcattgcgaaactgatcaattcattaattgatgtgtcatttgacgctaattgggtgctaccaatgccaataacaatttttatttttgctgttgtttttaaattttatcaaaattcattttcatatttgcttgtgtaccacctggaacggatatggattaaaatagatgctaacagccgtgagatttcgttttatttttagctgtttataaccggctttagttgtaagaaatctgctgggctcctatttatcacttgttaaatgcaatgccgacaaaagttaaattaaattattatcattctcttacatagaacgaatgaaggcatttttggctcaccatttttgtatttattttctttttgttgtctgttgttcattgttgtgtaaaatataagtgttataaatgttatattcctttttttgcaaattttccacaaccttagttaattggttggcttttgtgagttttattgaaaattaaaaactgaatttgtttttaattctctttgttcgatttgtttggagatgatttcccgtcgcttcttcgcctcatcctttggcgctgatcgttttgttcctacgactaattgcattgatgggaaagcgtttgacaagttccaggaacacttttcgcgcattgacaagcttgtggtgatgacaggcgccggcatttccactgaatcgggtgggaatggcacaacaattaacacaatcaagcgatttgcactctgattctcttgtgctctcttttccacattctctctctctccactcactaattttcactaattactaatggcatttcgccgttttcctctcttccgtcatgatacagtatttttatatttcccctttaggcattccagactacaggtaagtcgttgctacaaaagtttttttgtttcaaaaaattgtaaacatctattcgggtggtatctaagaaaagttcaaaattgtttttacatgttaaatttcaaaatcgacaggtgggaagttaaattaccaattagttaattaccgatttacaggtccaaactgtcgggtcgctatcgcgagcatcggccgatcacttaccagggtcggtcatttcttaccgtacaccaaatttcactcttttttggcactgtcatactgtatgttaggcgcttagacattcttgagattgnaatactgaaattntgtcatct

SEQ ID NO: 45160 - DNA, 875 bp, Heterodera glycines
gtgcttctgacgggcgctttttaaacgccaattcgccatagccttcgatcacttcggccatttcttcggagtgctataggattttgcttagggcgggggaaggggggggggaatggcaattttcattttgccaatgtttgttctgtcctcacctaaaaaagctcacggaaaatgcgtcagtaatacatacagtattcctaaaatattaaattctgtagcatgaagtacggtgttacaattggtctaaattatatttttaaaaacccattgcaaaatttgctagttcattttttgaaagctttaaaagtttcaataaattttttaaaatttacccaactccccaataaaacaaaaattctgtaattgtgattttaattcatcaaactaccgtatctcttttttcatagaaaaaatctggtttactatcacattttccactgacccattatttttcagttacgcctaaaaaatgcaaacatttttgtgcagaatatcaccgttgggcgccgggtgccaagaaaattttcagaaaatttgtggcactgcagttacatttgaatggttgtttcaacgcttggtggagaagtttaagtgcccggatgagccagagccccagtggattgtggagaaaatgaacgaaattggggacagaggtggacaaatgctacttttttgttggccagtgccactccggcatggatataacaattttccttggatttaggattttctgggctttattagcggagggtataaaaactgttttctttcggccaatttttcggttttttttttgtcttttttctaagaaatttgcgaattttattccctttgggcgcgagggagtgcgtaccccataccgttatctccccccc

SEQ ID NO: 45161 - DNA, 1369 bp, Heterodera glycines
  misc_feature (1361)..(1361): n is a, c, g, or t
tttttgttttattttgcccgtttcaccaatgcttccccactgtaatgagtcatcgattctcggtctcgccccaattcttaatatctcgacaatgtgcgcaaaaaattgtttaaaataaattgtcattgtaaccctttaaaaaactgtttttttccgattactgatcaatttgagagtttattacacaaaagcgcgccaaaatgatcaaaaaatgtcctcccctctcttctccgttccgcaaaaaattttgtataatggagcaattaattaattgactaattaattaatgttaattgtgcgcccgaaaggagggtgaaaaagaagtaacataccattaactgctgaacattttcaattagcagcaaacatttggaatgcttaataagtaggagcggtacaatttttatgttctaaaacccaaaaatagtttactaaaaaagaaaataggtgccaaaaaatacaaatttaggggtgtaagatagtaaatttgtttttattaataaatttggggcaaaacgccaaaatacgtctctaatagattttttcaaaattattttatgttttttcataagttcattcattaacggaagatgatttttgatgagattgcataaacattttgtcggtgatgtgttctttattttgaataattgggcctgtctcagcggtgtctaattagggcaactaattggaccaaaaacctgctgttcactccaatcacgttgatcatcatcatcctcttcgattaatccgataacatactatcactttgatcacaccctccctccctgataacctgatccaattaatcaccactgccctcttctaacacgccgatcactttgaacaccagtttccccgcttttctgatcactcctttctcctatcacttaactgatcaattttctcccatctgatcactatactcatcttccaagattaatctaattatcagctcctaatcactttatcagctcttaacacctgtccaactgatcagtcatacttaactgacggaatttttaaaaatttatatttatcttaaatcaaaaaaaaacatttttctcagtccaatcagtgataattagggttcggaattatatgcacatggcatatttttttatttgcatatttgtgcatattttggcatttttcaaaaaaacctctaatagaacggcccccaacagacaaattgggcctttttgacctcaaaaagcggaaaattttccaaaaaaataattttttagcaaaattttcacgaaaatattgaataaataaattttctcaaaaaataggttaatttatggtcaacaataagcaaaaaaagcaaaattttactttttggggttgatttttcgcanaaaatgag

SEQ ID NO: 45162 - DNA, 948 bp, Heterodera glycines
ccataaatctgggcgcatcggtacggggggactgctccgaaaaacaaaaaaatcgattttctcaagtgtccgtttggggtactcaaacaattatgcggagcaaaaatccaacgcagaattaaagtacaggctatagggaagctattccggaaggattcggtctccccataaatctgggcgcatcggttcggggggactgccccgaaaacaaaaaaaatcgattttttcaagtgtccctttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagttccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagta

SEQ ID NO: 45163 - DNA, 1018 bp, Heterodera glycines
  misc_feature (3)..(3): n is a, c, g, or t
aanaagatggttggaccaggcgactttgaagcgcgaaaacatccgcggtttgcaacgagttgtccaccttgatttccatctcaccgccagcgcgtcaattctcgccttggactaaaaaataattaaaaatgtttaaaatttaattttattatttatataaatcgaaagcagagacctgcatgggattttgcgggctcacagtcctcaatcccatattattttttgcaaattgctggatggatggggtaaaaacggttgaatttcaatttgatcctccaaccaaaatctaacagattatatcaggcccctggtaaatccgtccatttctaattcaaaatttgtgttcataccgccttggccaattgccattgtccattcgggtcgcgctggaaggtgttcagttgccaatccgcggtcccacaattgttgcctttcagctaagaaataaattacgataattgatggtaattaattaaaaataaatctaggtaattattgggcaatatttagacggtaatttaaaaaaaattaatcccatttttacaatgacgcgcgaagttcccggaccttcgaagatcaactgctccacctgttgtccatggggtaccttaaagagtataaaaattcaaaaaattattttgaaaatcctgggacctcaattttgaacaggaatggcgttttcgtctccgaaattacattggccagaatttcacagtaggtcatgggaggcggcggcggttgtggcgcttggggcgccacctgctcaaatggggccaacaaagggaagaggaacaggggaaaaacggtcgtggcaattagtaatagcatttgaaattctaattaaatttaaaatttctaattaaaaatatatttttaaaatttttaattccttaaataataattttttaaaggctatgtgcaaagtttaaaaaagttgagttcacaactctgttttttatttaaacaagggaagaacaatcgtggcaattagtaatagcatttgaaattctaattaaat

SEQ ID NO: 45164 - DNA, 1409 bp, Heterodera glycines
  misc_feature (1293)..(1293): n is a, c, g, or t
tgcaggtcacatcatctgacaaatatttaaaaataataataaatttccttttaaaataaaatatttttaagtttcgtgcctttcgcactttcgtcaaaaaaccgtttgcttttgcttcgtctgtataaaccaattctgccataaaattgtgccaattttttgtgtcgaacagacgcaaattggccgacgtcgcagccaatgcccgcgacgacactccgccattcttcgctatcgtacacatccaattcaaccgtatgtcgtctttccgatacggtagtgatttggtcagcggcggaggacgactgatggtaaattgtgtggaaattgttgggcagcaaaaaaaggaacgaaatgatcagaaaaacggtagcacaactgatggacaagagaacaaagcgaaaagtttgagacaaattaagcattaaatacataattgattaatatctaaaggataaaaaaagtaataaaaatgcaaaaaatagagagagaaaatgggcggaaaaattgaaatgataaaaaagaaaaaagaggcgattttagaaaaaaagagaaaaaaaagattaaataagatttcttaaagcatatttatttaataagtttaaaaatttgtaaaaaattttaataaaataaacattttttgagaatgcaaaaaatgtttagaaaatggaaaaaagaaaaaatgaagaggaaaatcgctcacagaataaattttgtgtttgctttttgtgtattcttagcattattttctcaaatgctcgcggaggagaagaagaaatgattttgaagctttacgtttttttatgagccatcagaaaatattttaattaccaaaaattgaaaagggataattagcaaaaaaaaaaaatgatcgaaacggacgggacgaatatccatcccaacccggcaattatgtagtttttcaaatggcctaattacctcagcttcaaaatttttcacaggcaaaaggtaaaacaggcggaaaaggctaacagaagaaaagtgaacttgtgaaagctaatcaaatattaattgaagaagcaatttcttttggagggccgtggcaaatgaaaataaaatattattccaaaatatattttaattgttacatcccaaaaattaatggctttgtttcaagaatgagtcccgactcaattttgacaaaaactcatgaaaaaggagttcaaattaaacaattccatcagaaattttttttcttacacattttatgataatcggagccgccactttttaaagatatgaaatgataaatgaattttttttatttccgactanactgtttaattttctaataccacacaaaaaggttcccaatcttctcggactccgtttgccgctcacttttggcacttttttcttttcggcacttttttgcatatttttggcacttt

SEQ ID NO: 45165 - DNA, 981 bp, Heterodera glycines
catccatagcctgccggttctcggcacagcaagcactaaataggtgtttgactcacttcaaaaaataattcattacacataagtttcctacagtcactttataaccacatattgccaatctaatttcttgcagattgaaagccatccattgcctgccggttctcggcacagcaaagcactaatagggtgtttgactcacttcaaaaaataattccttacccaaaagttttttacaaccacttattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagtttttttacaaccacttattgccaatctaatttcttgcagatttaaagctatccattgcctgccggttctcggcacagcaaagcactaatagggtgtttgactcacttcaaaaaataattcattgcccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttacagccatccattgcctgccggttctcagcacagtaaagcactaatagggt

SEQ ID NO: 45166 - DNA, 213 bp, Heterodera glycines
agcttgatgcctgcggtcttgtcatataacgtatatactagcgggtgcgtgatcttcaaaatatttagctgggaaaaagcgcttcgcgctttcccttcttagctacctagactgtgaagcgattcaaattgatcgaattggttggagagatttttttgaatttttaaaaaattattatggggtttttagtccacatcgaggctcaagacgggc

SEQ ID NO: 45167 - DNA, 648 bp, Heterodera glycines
  misc_feature (27)..(27): n is a, c, g, or t
ataggatagaccccccccccccccccncgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtttaaaattttttgcagacaccaccacttttgcacttaaaaaaatttcaaaaaactttaaaaattcatacacaatattaaatcactctttactatccataaatcaacgcacacaccccttcccccgtcctttttacccctctccaaaatc

SEQ ID NO: 45168 - DNA, 1303 bp, Heterodera glycines
caaaggaaagatctcaaagtcaattaatttttattttctttattaacctaaaagtcgaaaaatttttactcacagcaataatttgcttacaattagtttatttattttttatttatttattttttgataaaatgatccatttaaaaattaatagaaaataagaattaattcaatgtttggccatcaatttctcggatattgtgccaacaatgaaagggcacgccaaaggcaattttcaagtgggacaaaatgccaaacggccaaagcagcaaagaaagactaaaatggaaatcaaaaattaaattcaaaatggaaaaatgggaacaaacgcggccaacgttcgaaaatgcactaaaattccatgcgaaagcgaaaaaaagggggtggggaaacggaaagaatgggggccatgtcaaataaaagaataaaatttaaaataaaatatcaaaataacccattacaaacacaaaaaggacaacttttctctaaaaacaatgattgattaatcgaatttttgacattgccaattttttaaaacaaaaacatcggccaaattggtcaaaagtgactaatgcccttttattttttaatttaataccaaatttattttacagtaattgtaaatggtgggaagcactttcacccgaagtgatgtccaaacattctcatctgatattggtcaaaggcatcattttccgtcatttgtgagtcgaccaaaacaacaaaaataaatccgacggcgaaagcgaaaaagccgaaaatgataacggaaaaggcacagcagccgaatgccaacaatttgcgcaatttgttctttgaacgtcgcccggaaacggattgaaaaatggcgaaacgatcggcggattggcaacctttggcaaaatgggactcacaaatcagcaaaaatgtaattgacatcggacaaagaaattccgaatttggccattcccttaaccggttctatgtattcgacttgctcccggactctcaccgcggcactcacattggctgttatggccaaggcatagaatggtcactttgtctttggccattggaacgaccacagcggccgaagtcggctgggatggttcagtgccgcccgcgtcattctcttttgtcgctcttttggcatttttacacgagggtaaaaagcagccttttgcagtgttttgctgctgtccgtcgttggcattgttgcgcggtgccgtgggagaggaaacataactcggagggggcgaagacggacaaaagtcgacgggagggacggacgggggcacggagtgatgctcacaatcagtcatcg

SEQ ID NO: 45169 - DNA, 949 bp, Heterodera glycines
  misc_feature (725)..(725): n is a, c, g, or t
gttcagggcctttctaaatgaaggacaccagaggcccccctgttgcgcaaaggcactttctatgtgttggttcatatggtgactattttttacagacaaaattattggtttcagaacaattaaaattaaaagctgttttaactgagttattttagaatgtgagagtttttgtatacggttcagggcctttctaaaatgaaggacaccagaggggagattgttgcgcaaaggcactttttatgtcttggttcatatgggactattttttacagacaaaattattggcttcagaacaattaaaattaaaagctgttttaactgagttattttagaatgtgagagtttttgtatacggttcagtgcctttctaaaatgaaggacaccagaggggagattgttgcgcaaaggcactttttatgtgttggttcatatgggactattttttacagacaaaattattggtttcagaacaattaaaattaaaagctgttttaactgagttattttagaatgtgagagtttttgtatacggttcagtgcctttctaaaatgaaggacaccagaggggagattgttgcgcaaaggcactttttatgtgttggttcatatgggactattttctacagataaaattattggcttcagaacaattaaaattaaaagctgttttaactgagttattttagaatgtgagagtttttgtatacggttcagtgccttcctanaatgaaggacaccagaggagagattgttgcgcaaaagcactttttatgtcttggttcatatgggactattttatacagataaaattattggtttcagaacaaattaaatttaaagctgttttaactgagttattttagaatgtgagagtttttgtatacggttcagtgccttcctaaaatgaaggacaccagaggggagattgttgcgcaaaggcactttttat

SEQ ID NO: 45170 - DNA, 1224 bp, Heterodera glycines
caaagaaaagggccggcggatgctaaattggggtctttctgagttttgcggaggagaaagaattatgggatcggcgttttacacttggcgaagaagtgaaaaaagaggggagggcgtgcggaaggcgcagtcggtggaccgacgtttggtagccctttctgttgagcaatgctcggaatggctgtaggaagggggaaggaggcaaaaggaaagacggagaaagaagaaagggagggatggaggggaaaaagacggagaaaaggaggaagggacggagaggaaggggaatggctggaggatgcatttgggttggctgagaggtgtgcttgctgctgatggatggggatgaataaatgaatgcgttgtcgggttttgcctggagagtgaaaaaggtgagtgagtgcggtggtgtttttctcctccgtttttctgcccatccgccgatttgactgatccatccgttccccccccccccccctccgtccatccttttgcttatacaattccatggatgaatgtgaaatgaatgaacccttttccttattttgagtttgccttcagtaaatatccaggtactttttcactttacgcaacataaattttaaatttatttttgtatttttctgggacaattattgtccaaagccgattcaaatagacgggaatataataaaaaaatagagattcacagccatttagtgcatttgaaccgtttttggacaatatatgtaaattttgctgaaaatttaattttcgacttttgttcgagttcgggtccgggattctaaataggtggaaatgaatgtcatattcgtgatcaaaacgcccccgaaaacctcagaaaaatacaaaaaaaaacatttttttttatgtggcgtaaagtgaaaaagtaccaatatccattacaaatattcaccagaagtattttttaagtatcattctcatatatgtattgtatctatcattttatgtagattttttttttatttaggttttcttaatatctaatccttaaatattggtttattactttaaagacatccaatttatttcaatgcatttcctgtcaaactttttgccaacttagcaatgatttcgagaggtaaacttttctataaatatgatacttcaatttataaatactaggtcgttgcataaaaaagggcgctttttcaaaatgacttattgtaagacttgattaacgtttgttatgtcttttttgtg

SEQ ID NO: 45171 - DNA, 1099 bp, Heterodera glycines
aatagtgaagaaagagaaaaggtgaagagaaatgtggagggaatggaatatcggtggagagggagagggaaaaagagggggagagagtgaaggtgaggtaagaaagagggaaagggaaaacgagtaaagggtagaaagagaagtgagaggaaaagaaagaggggaaatggagggtgaggccttgaaggagccatttctgttgtaaataatgacgaatttcagttctagcctctatgcagtctgaaggatcccgatggctaaaataaaggatatgacaatgctaaattttcgataatttgcccaaaggatggagagagtgggccatgtcactcatatatcatgggacacaaaaaccaaattatggccaaaggcgtcaattacactatgccatttgaggagagagcaattcaatgattaatgtgaaaggaatttaaaagacggaatggacaaaatgattgatgggacgagaattaggaggatggaacaattttgaattttttcaaaaattaatggagagctaacaaaccgacaatagtctctcatagtccctttttaattaattaattaagctgtttggctttgttttgacttgctaattgacagagccacaaaacagctctccggcggggatggactcgcggcattatttatacggattgaaaccgttagacaaatgagttggcatgggtccaaacggcgccaaatttgtgcgcattggggtttggactgccaaaaatccaatcacattggcggcggaagagcgcctcgggggaaggtcatcgcatcgtccgccccccccccctccccccctcggccccgtccgtctcaacccgctaaagcccctcgggtgccgaccagtgccacttgggaaaaggacaaaaattgaaaggggagagaattggcgaagtgaaggtcaaattatgcctgatttttgaatttttggtccgggacttggaaaaaatcaaattaaaaatgaaaatgagcgatatgataccatgcaaagttagttataagagtgacaattattggctaaaaagcgaccaaattccctcaaccgttcaatttgatggccaaaaaacggattaaaaaacccattccg

SEQ ID NO: 45172 - DNA, 1140 bp, Heterodera glycines
  misc_feature (982)..(982): n is a, c, g, or t
  misc_feature (1034)..(1034): n is a, c, g, or t
  misc_feature (1059)..(1060): n is a, c, g, or t
  misc_feature (1073)..(1073): n is a, c, g, or t
cagaaagtagaataaaaaatggtaattcgcctgagggcataaaaatggaaatgcgtcgcccgaggcgtgaaaaaatgacctatttttactccccacaatgccctaagcacaatttgcgcggcgcaacaccactttctttcgcgttcattcgctttctatgtatgtattcaaaaaaaaaaatcgagtgcaataaaaatgggcaattttttgttgtagaagaatttatcctttttgcaccctctgaaatttttaaaaaaataattttttatgttattttatgcgctgaacacgaatcgtaaaacgtgtgatagccagggattctttttttatgtaagaaaaatcgcaaaatatgtaaataaaatatgtataaaaaatgctaaaatatgtatgaaatatgtacaaaaagaaccaaatatgtacttaaaatatgtaaataaaattttttaaatggtgttttttggaaaaaaatcttcgtaaaggggtgaaataagtacaaaatgccataaaaatgacctaaataggcttagaagcaccctttttactatctcttttttgaaaaaaacgatttttaggggtatattttaaaaaaaaattttaaatttttcatatgaaatttctatcacttctcaaaaatcctaaaaatatgtacaaaaaattgtgaaattttggggtttttttggggacatttaatgaaaatttccttaaaaatcctcaaaaatttcaaaatatcttcgaaaaaatgcgaaaaagtccaaaatatgtataaaaatatgtacatatgtaatatgtagaaaaatcccaaaatatgtaattaaaagtctcaacttttgttcgcaaacacaaaaaagaaagtgtttttcctactaattaggctatggagaatccagaaaaaaaacatgtatttacataaaaaaagaatccctggtgatagctaaaaatgaacggcagattcgtattcagcatataccaaaaaaatttttanattattcttgcatctaattcgatagctataataattttctatattagccagncaatttaaaaaatcttgtttactannagtatatgatganaaaacaaatgtttaccggaccctgtcaagattttcccggaaatcctaatcttggccctggtaatttt

SEQ ID NO: 45173 - DNA, 922 bp, Heterodera glycines
  misc_feature (828)..(828): n is a, c, g, or t
ttgaaagagctagaaccgaagaaaatttttttaatttaagcctaaactttttggcatgtttaaaaagcaattaaaaattttattcatctccctttttgatagtaaaagcatcagagagccttatttaacttgtacataaaattttatgcgtttcagagcactttctgaaaaaatatttatgaattaattttgcaaaaaataaataaacagttaaaaactcagaatttctaaaaaaatttaaaatcaattacaattgtcattttttcaggttaagttagtcctgtaccggggagtatgccaataaaatttggtacgattttattgctttttgaaagagctagaaccgaagaaaatttttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataaataaacagttaaaaactcagaatttctaaaaaaatttaaaatcaattacaattgtcattttttcaggttaagttagtcctgtaccggggagtatgccaataaaatttggtacgattttattgcttattgaaagagctagaaccgaagaaaatttttttaatttaagcctaaactttttggcatgtttaaaaagcaattaaaaattttattcatctccctttttgatagtaaaagcatcatagtgcctaaactaacatgtaaataaaatttggtgcgtttcagaaccctttctgaaaanatatttaagaattaattttgcaaaaaataaataaaaacgaaagactcagattttcgaaaatttttttgagccagctagctcggcgctcatttca

SEQ ID NO: 45174 - DNA, 909 bp, Heterodera glycines
ttacaaattcaaaaaataaataattaaattctttaatgtaaaaatttttttaaataatctacaacaaatcttcagattagttaaaaacattgaaaataacgtaaaaaatcatagaaaaataatttacaccggccggattcgaacctaccgcccccccccccccccacagaagatgactcagaatccccaatcacacagggattctgaggtcttgacgatgtcaaaagtaaaatctgatcacgtattcgtgatcagcggcccaaataacccctaaagacatgtttttggaagattttgggtgaaaaaatttttccactcaaaaatcctggtcacccccctttggtctggaatcccaaaatcacttttatttttataacatttttcaaaaaagtgataaaaatgccaaataaaatttatttaatagagcaaaaaattgcggatttttgtagtattttacttttacagtatgacctttcagaaccgagttatgaatttttttctgaaaaatcgaaaatttccagaaattctggaataacttttttcttttttgtgataaaaaactcaaataaatcccataaaattctcctgatttttctctatttttaaggctttattcctgtaaaattgatcaacccttcgatttgttatgaattttcaaatattaggtcaaaatcccgagggccaaaaaattgccaaaaaataaagaatttttaaaaaattccaaaaattctggaactgaaaacaaacaccatattcgtgctcagcacctcaaaatagcccagaaaaatatttttcacccccatttttgacccaaaaaaaaattctgaaaatttctagggggcctagctcgaaaatttttgaaattttccgggcatatagcacaccgttcgatagagcttaaaattctct

SEQ ID NO: 45175 - DNA, 966 bp, Heterodera glycines
atacgcggcaatttccaagtgaaatttaaaagactgcaaacggcaagttcttcttcagaatgcacttaaatgttcgagagcgcatccgggttatgagccggaagaattggtgagaagggaagtgagagggacggaggaggggccgagcgaaaggccgacggtgcccggatgggtgattggccagtgagagaggaaaagcgacggtgctaagcgagtgcaaatgcaaattacccatcattggacagcataaactcgtcttgacgtcgcctccgacatggcaataaaagccaatggggcaaatgttctgctgagtggctgagcagaagccaatctgtccttgttggtctcgcaaaggcgtgcccacagcacatggatttgctaggcgataaacaattgagccgattaacagtcatttgattaccttggcaaatctgttcgcaatcaaaccgagatagaaaattgttttcgttgccctgaagccctttgtacgtgaaactttggcactgtgccgacggtgcgaagaaaaaccatcggaccaaattggaagggccaacgccaacattcagaggctgttgacacgcatcgacggcagcttaatgagaattgaaatcatcagaatttcgaaaagtcgagtcattaatcgtgcgtgccgattggccatcccgtgcctggtttgttgcagcagatcgtcgttgtcggactgtctccgacatggcaaaattgctggcccgggcaaggagcgcctggcgcggtgctcggcttgcaaaacaaaaattggccggttccaaaggcacacggattgatcgatggcattcctaaaacattcaaagagcaacttacttgcaattcattttctgtagtttggcctctttggccaattttaattgatttaaaaatgttatttggtgagtttttgtgagtggttaatgctttccgtttgcttctccgtttacgctttactttcct

SEQ ID NO: 45176 - DNA, 353 bp, Heterodera glycines
aaaaaatcgatttttttgttttcggggcccctacccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggg

SEQ ID NO: 45177 - DNA, 830 bp, Heterodera glycines
  misc_feature (19)..(19): n is a, c, g, or t
taaaaagcgatgggttaantatgagaattgtctgaccatttcgccgtgggtgtcaatccacaaacgaccaacaatgatgttgtgcacagtcgtgaccaccttttgaaacgtaaagtgcgcctttccgtcccgaaaggacacgtgggtatggccagtgggaatcacgctcatatatttgccacgaaagcgtgaactgaccataaattccttcgggttgataataaataatatggagagagaaggcatagaaccaaaaaagtgtgtccacctggttcaaatgccaattcactccttcaacgtgatgggcagcggcgggcgggtggtgtgagacttgctcgaccagcgaccgccacccgagatcagccctccgatcgaactcgaaagtttcgcccagcaacgggttgaacggtttcgtggtacgtacagcggtggctgaataacagctgacagcaaatgcggcgacataggcgagccgttcgcaaatgtcctgtttttcagcagcccgatcaagcaaataggaatattccaagtcttccgtaatacgctgaagcattgagagtggttcgttgaaattgacctgtaaagcaacgatctttcaaagagacaaagccacaaaaataccggaattggaattcgagtcaattctttgccaatgcaattgcgcataatactccacaaactaaaagacgaaaggacattcaaacagttgattttttaaaatttatttgcgatatatttataaaattattccaaaagaaatcacttaagcccatgcgattgcggcttcggtcggacggacgaccgtcttggaaccactgacagtccaggga

SEQ ID NO: 45178 - DNA, 755 bp, Heterodera glycines
  misc_feature (100)..(100): n is a, c, g, or t
gatttccgcgaatttatgcagtataaccgaatcgaacgctgccgaatgcaagcgggagaaactccgggttttgccaaaacaaaaaacagtcactttttgngtctccccctaccccccccccacccatttgtttattcattttaattgtcaatttactagtccaagtacctcaactgaatggaaacccaaaactcaaaaaaaaaaattcgaaattttctccgcttaaaactgaaataaaattaaaccatatacaccaagtaccttaatctggaaagccaagtaccttaaacagtccaagtacctcagcagaaaaaatattttggccaaaaattgtttctaagtgtcaaaattctttttggactaaaatctttaggactttttattcgatctttcgtattttattgataagaccatttttagcgtcagcttgagcagaatggcactacccaattggacaacagcggcaatgaaaccgaaattgcgtcgggcagtatggacacgggtaaattaattgaccttattttcaacgtaactgatacgattggacattttaaactcatttagcacatttggaggacacttttctgatgagcggtgtgcttggccacgaacgcgagtcggacccattgagccgaactcaaccggtggaagagggaaaaggcgagagggaggaggagagtaagctgaactccacctacccgttgccaccccccaggaagagggaagcaaaaaacccaaaaatagcgagggctaaa

SEQ ID NO: 45179 - DNA, 195 bp, Heterodera glycines
taattaaatttcaaaaaatcgtaaaaattaaaaacttgacttctccagacattcaatagctcattcgaaagctctttttaagctctacaacatctatgtattggttttttaagcccgactaatttccttaaagttttggagaaaagcaagtactcgacgaaaaaatcatagacaaaatcaatgattttgcaaaat

SEQ ID NO: 45180 - DNA, 945 bp, Heterodera glycines
atggcacgcagagagggaggattctgttggaacctcctcgtattaaccggagtttgtcccctccggggagggagctttggaataaacagcgaaaatgggtgggaagggaaaggggacagaggaggagcagcagaagtcgagaaattgagggggggattagagccatatttggcaaaaggggatgatgaagaagaagaaaagacggaagagggagggggcaaagggaggggaagagagagggaaaggggaggagagggggggggagagtcatcggtgaccgatgcgatgataatttgctgatgagacgaccattccctccctcgccgtcctttgccaaattcagctttcctttgaccgctcttccgcctccttttgcccatcatttcatttggcgcatttagcagagattgggcgagagagcgaaagacaattgcgtaaggccaattcatcactcgaaaattgagagggggcgggaagggaaagtgccaaagtgccatatgccaatggggggggggcaaagggaaataaaagggaaaagcgaacgacgggcgaaagagtgccaatggaggcaaaagcaaaagtcgaagagatcagaggaaaagccaaagggagggaaaagtgaagggacggcaccagggcaggacgtaattacgtattatggaaattacggccttcttggagttacggattacggatttttccgtaattttgatccgtaactggcttttttagattatttttcgagacaatttcttgtaagattattttttataaaatgaatttttttttctatttttattaaaaggctacccaaactccgatttaatctgacttcttcttgggtattttggagtattatttaacatacataaaggggggggggggggaggctgacaaaaaggaaaaaagggaaatgacgaaaaatttgaatatgttttaacaaaa

SEQ ID NO: 45181 - DNA, 1058 bp, Heterodera glycines
aaatcgggacttctagcttttcatttttaaaaaagcctaattgattgatgcacaaatatcgcattaagcaacgctttacttcatttataatacaaaatatgcacacgaaatctgtgacaaaaatcagtcatttgatgggaagtttacattttgtgaaaagataatgatcagataattccatccgagtggccattgattgtgtttagggctcatctgctgttgatccactgtttgcgcattgcttctgttctcagcccggtctgtttctcgacatggacgcagcacaatttgaaggcaacggtctgaaaacaaagggacagaaattgtaagagtacccccgaatataaaaattggttgacaactcgtccatacccaatttcgtcatctgcgaagccaatggtcaccaaattcggatgaggttcgttgttcaagcgcgtcatacgcaaccaggacaccacgtcagcttcactgaactccgctggacagcgcacaatcttcacgaaggacaccacgccaccacctcgtttcgggtgcacattggtcaacatcgtcagcctctcctccgtcagcatgttcaccatttgttcccttctggtgtagatgaattcgaacgaagtgaacaccatgtagttgaccgggactgacgccgtattgaaggactgaaaagcggaaatgaatgtgatcatcagaacaatgattaaaagggcacagagaaaaaaacgaaatccgtccgtccgtcgatcaatcgatcgatcatcccacacacccaccatcatcaattcgttgacgaattggtcccatcggttgttccatttgagcaatttgtacaccaacggaagacggtcgacgcgcgtcgtgtgcagccacatgtacaagtcacggctcgatgtttcaggagcagcagaattgtcaacggtcggacgttcaggcaaaactgggctgacgatttcgacaaggtttgggcagtcgaagaggaaggtcggcgaaatgtgtttgcgcatcaaggccagttgcttccactgcacgttgaccaacgtgccgagcccgttcttcagcaa

SEQ ID NO: 45182 - DNA, 992 bp, Heterodera glycines
  misc_feature (22)..(22): n is a, c, g, or t
gatgtttgtcgaaacatactcngtcaggcttaaagatagacctgccattgctattcctgcaaatatggagtctagtcagcccaatcgattgctattcgaatggtttggggtcgttgtcccaaacaaaagttgtgctgcttcttgcaaagaagacttagccaactgtaaacagcaagccatccaaatgcttcaatgtaaaaaaaatttacatttggatgcaacctttatttttcctcgcctctcttttcgaaaagaaaagctattagcaagcgtgttttgaccaattctaaaacaaatcggggtaattaatttaatctgactttataagataaatgggaatttaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttgtgctgcttcttgcaaataagactgagccaactgtaaacagcaagccatccaaatgcttcaatgtaaaaaaatttacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataatgatctatagaaattctcaaaaaggtagttcctcgcagattcgggaaccgtttctatctgaggtagggacatatgcgctaaccataaaaaagttgaatcatttt

SEQ ID NO: 45183 - DNA, 635 bp, Heterodera glycines
atttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaatttt

SEQ ID NO: 45184 - DNA, 763 bp, Heterodera glycines
gccccagcagcccacgccaccgccgcttccaacgaccgtcgctcagtcgccgtctccgccattcgctcaaatgcttccgccgaatctctctaacattactcccgaagttgtccattttccaaggattgagttttgatttggttttcttcaattcgcagatggctgcccaattgttggcccagttgcaacagcacaatccttctctaatccaaaatttggtgatgggccaacagcaacttcaccatcactcccaactcggcccttttcgtgccgatgccgactctcttccgcctgccactttcgccaggtcggcttccctcagcaacgggcctttgtcacccctcgggggcggctgttccgctgctccctctccgctgccggcgcctccccgagggctccaaagcagcgtggcgagcataagggcatcaactggacgggcgccggcgaggaggtcattttccggcaaaagcggagcacagaatgaaattgggacattacaccagcgacaaacaatggaatggcctgggagcagtggtgaaaaagggggcacgacggcgagcagtagcagcaacactgagaaggacaagacggaaccaatttgggtgatgaggtaacggagggaggcggggggggggggaagcaggcatacagagagagagagaagagagagacagagatggggagagaagaaaaaaagaaagtgagagatagagagaaaaagagagacaaacagagaaagagagagactagagtcgagagaaaa

SEQ ID NO: 45185 - DNA, 376 bp, Heterodera glycines
gtttttggggtagtgtttgtgaaatgatgtgtgtagatttatggggagatagaatagttagggaatagtttgtttataggatgtattttaattgtgtgttggagttttgttaatgataattgtttgagtgaataaaagggagatttgaaaaaatagattttttttgtttttggggaagtaagaaggaatagatggggtgagatttatggggagagagaataattagggaatagatttaatatagtatgtagtttaattgtgagttggatttttgatgaggataattgtttgagtaaaaaaaagaggaaattgaaaaaattgatttttttgtttttggggaagtgcttatgaagagatggggtgagatttatgggga

SEQ ID NO: 45186 - DNA, 949 bp, Heterodera glycines
ctcaaagagcaaatttgctttttctcattagcatatcacccacaaaaagtaatatctatactttttctaattaacatatcacccacaaaaattagggaatattcaaaacagtttaataaaattccagaaaattcaaaaataattttctagggtttttaatggcaataataagtccaaataaattgtaatttacccattttctgactctttggatacataattggaatagcaaaattttattgttatgccttttttaatatctcaaggaccaaatttgctttttctcattagcatatcacccacaaaaagtaatatctatagctttttctaattaacatatcacccacaaaaattcgggaatatttcaaaacagtttaataaaattccagaaaattcaaaaataattttctagtggtttttaatggcaaaaataagtctaaataaattgtaatttacccattttctgactctggatacataattggaatagcaaaattttattgttatgcctttttaatatctcaaggaccaaatttgctttttctcattagcatatcacccacaaaaagtaatatctatagctttttctaattatcatatcacccacaaaaattagggaatatttcaaaacagtttaataaaattccagaaaattcaaaaataattttctagggtttttaatggcaataataagtccaaataaattgtaatttacccattttctgatacttgataattggaatagcaaaattttattgttatgccttttttaatatctcagagcaaatttgctttttctcattagcgatatcacccacaaaaagtaatatctatagctttttctaattaacatatcacccacaaaaattagggaatatttcaaaacagtttaataaaattccagagggattcaaaaataattttctagggtttttaatggcaataataa

SEQ ID NO: 45187 - DNA, 1387 bp, Heterodera glycines
  misc_feature (1325)..(1325): n is a, c, g, or t
  misc_feature (1370)..(1370): n is a, c, g, or t
aaatttatggcgaatacaaataaaatgcaaaaaatcctctttaaaggtcaaaacataaacgaaaaaataagaaatatcgtcgacacaaaattaaatccaccaaaaataaaatcgctcaaaatatgtattaattaacaaaattaaaaatgctgaggtcaattgcaaagataacgtagtacaataattgggcggggatgtgctcgaacgtctttgactttgtccgagggttgcaattgaccacagtgtaaaaaaaagacaaaggcacaacgatcgagaaaactcctaatcaaaatcaattcaacaaattaaaacaatccaattttatttaagtctgaagcagatcaataatatcaaaataaaatgggagaccacaattttgaagatcagaagcaaaagtacaaaattaccaattgcatacaattacggaagaatgtcatcggggaagtgaacaattaaccaaaataatgagaacaaaatgccaaatttaaaatatttaaatcaaaaacgaattgtctttatagcacattaacactactttgatcgaagccctgacatttcgctttttgcttgtttcttggcagttattgatattaaaaaaaatattattatatttaggtttttgtatgatatattatcattactattattatttatttaacgaattgaaaattttaaattaaggattaaaaagttttcacaaattagtattataccgatcaaattaaacgccatcataatagttttattaattaatatttcaaaaaatcataatattttttgactaaacaaatgatttaattgatttaaaaacttttttaataataaacttattcttcataaattatagtcaggaaagtaaaaaaaaaattctatatattataaaaattaatgttatccaatgaatcacagccacttcaaaatgcaccaggtcaagatgattcagaaaaaaatatatttgatgaactaacttactcaaaaaaatcgatagtatctatgaattcaaatgtcattgtaaacatcgtactttaattttcgtctatttatgatgtttattttttaataaattaaatagtaaattaaaaaattacaagaaacgaaaaaatcttcaaataaaatattaaaaaagaaaagaaatgcaaagaattaaagttaatgtacaaaatgccgcggacgatttaataaattatagtttaacaaaatcaaataaatacgctgaaataatactgacaatatttattcaaaaaaaatatattaatcaaataaaaagaataatatatatattatttattcgcatttatatgattataatttactagaaatgttanaaatgagtcatatacagggctcgtatcgtccatgctccgtttccnaggacgggtatgccgat

SEQ ID NO: 45188 - DNA, 985 bp, Heterodera glycines
  misc_feature (909)..(909): n is a, c, g, or t
  misc_feature (951)..(952): n is a, c, g, or t
taaaaaaatctaatttaaaatcgaatgtgttaataattttttaaaaattataaaataaattccttcttttatttaaaaataaataagaaattaattttatattaaaacatttaattaaacaaacaatattaaattaattaaaataaataaataattaattttaaaacaaaacatttatttataaaaaaaaatttaattcaaataaaaaaatataatttattattaataaaataaaaaatatattaaataaataaaacaatgaaaaaaatggtagttattaattaaaaacaacgttggaaattatttattgaatattcacttaatttgaaatgatattattttttacagataaaaaataataatgaaattatttattaaaaaaaaattttaaatttacaaccaatcttcaaattaattaaaagcattgaaaaataactcaaaaataaatagaaaaataatgtacaccgtccggatccgaacctgccccctcccccctcagaatgatatctcagaatccccaatcacacagggattctgaggtcttgactatgtcaaaagtaaaatctgatcacgtattcgtgatcaacggcccaaataacccctaaaaacatttttttaaaagatttttgttgaaaaaaaattttcactcaaaaatcctggtcacccccctttggtcccgactgccaaaatcacttttatttttgtatctttattttaaaagatgataaaaaggtcaaataaaatttatataatagagcaaaaaattgcggattttttcagtatttaaaatttcaaaaacacctttacagaaccgagttctgaatttttttctgaaaaatcgaaaatttccagaatttctggaataactttttttgtttttgcggtataaatttcaaataaatctcatanaattctcccgatttttctctatttttaaagctttattatagnntaatcgatggcaccatcaccgaggtatgaattt

SEQ ID NO: 45189 - DNA, 828 bp, Heterodera glycines
  misc_feature (764)..(764): n is a, c, g, or t
  misc_feature (779)..(779): n is a, c, g, or t
ttttctccccataaatggttgagttccccaaacggacccttgaaaaaattgattttttgtttttggggcagtccccccgacccgatgcccccagattttaggggagaccgaatccttcgggagtagctcccctatagcctgtactttaattttgcgttggatttttgctccccataattgtttgagtacttcaaacggacacttgaaaaaatcgatttttttgttttcggggcagtccccccgaaccgatgcgcccagatttatggggagaccgaatccttccggaatagcttccctatagcctgtactttaattttgcgttggatttttgctccccataattgtttgagtaccccaaacggacacttgaaaaaatcgatttttttgttttcggggcagtccccccgaaccgatgcgcccagatttatggggagaccgaatccttcgggagtagctcccctatagcctgtactttaattctgcgttggatttttgctccccataattgtttgagtactccaaacggacacttgaaaaaatcgattttttttgttttcggggcagtccccccgaaccgatgcgcccagatttatggggagaccgtctccttcgggaatagcttccctatagcctgtactttaattctgcgttggttttttgctctctctttctgtgtttgcgtccccccgtcggtctcttgttcttctcgttttttttgttttcggggccgtccccccgtcccgttgagggccgttttttgtggngtctcgacttcttcngggaacccttacagaatagcctgtactttaattctgcgttggatttttg

SEQ ID NO: 45190 - DNA, 1464 bp, Heterodera glycines
taaaaatatatttttttttttctaaatcctttaataggggggccaattttgtgggcccaaaatttccccccggcgtccagaaaagtattttttcataaaaaattaatcaattttaatttttcggggagcccttttggccgtttttaagccttgttaagtcgccttttgggggttttttggtgactaaattccccatccccaatttattaattgagaattgaactttaaaaaaaagggtaagaaaatctttccaccaccctttgaaattaagaaacttgtgtggtgtccaggtggcaaaatccctttttaagacaagtgattaattaacaattatattttattaagctaaaagtctgaaaatagcgaaacaattgccagcggtgaagccaatatttgcagatagctttaataaatgtcttagtttaattactgccgtcgtaaaactgaatgttatttcgaaatatttttgggaaaatattgaaaatgacttggatatgactcagataaaattgctgaacgaggaggaaataaatatttctgaaataaaagtggagaaaaaagttgaaaattcgctgagcaaaatgcaaaaaacaaatgcattttttgaccaatcgtcggaaattgccaaccttaggacggaatttgagcaaaaaatggagaaattatgtgaaagaaccaaagaaaatgccaaggaagaaaaggcgaaaatggaaaaaacaaaagcaaatgcagcggatgaagggcatagactcggaacggaacttcactttctgtccaaatttggcactttcatttcgtcgccatttttccgttgatttccttaaattgagtattttttttacactgatcattagcgctataaattatatgcattaaaaaatgccaaatatgcgcataaaatatgcactaaaaacccgaaaatgcccaaatatgcactaaaatttgccttaaactgccaaaaatggctttttaaccctcaaaaaatatcaaaaaaattgtctaaaaattcagaattgactttaaaaacgccaaaacattggctaatgaacgttttttagacaatttcaaaaagttttgaattttaaaatttatctattatgaaaatttgccaaaaatggccgaaatttgccctaaaaaagcaaacccccaaaatatgctttatatgcactaaaacgttctccaaatcaaaaaattttaacgtagaaatgatatttatgagcataaaatatgcaaaagcttataatttatagccctaataattacgcttattatttcacaaaaagtttttggagagagatgtcataaatgcaacagaaaatgacttttgcccttcttctgatgttgtttgttgggtaaaccttcgccattttccacgctccataatttctctcattttgccctcaggcggcggcggagcgtttctccgagttgatgcaaatgataaaaaatatatataattaatat

SEQ ID NO: 45191 - DNA, 624 bp, Heterodera glycines
aaattcattcaaattaatggaaaaatttccttgacctttctaagaacatcaaaaatataaaagacttgatgaaagcaatagttcaatcggacccttttctccttctcttcctcttccctttccctcttctttcttcttccgcctccttccctccttcttccccttttccttccaattcccccctccctcgtctttcgccctccctctcttcctcttcctcttccctttccctcttctttcttccgcccgagaaaaaggaaagggaagggattctctctcaccaaatggaagtcctcttcacttagctcattcatttccttccatttgcttcttccttttgttgttcctctcgattcggaaagggaaatcgtcgaatcgacttactggcggactcggccaaggcaaagaaagggccggccggccaaactggcggttggtcgctccccccccccctttttcccacttttccctttctgctctgctgctgatcggtcgtcgccgtgaaagagaatagtacatagaaatgagtgatgaatggaaatgggaaggatggaagagaataagagaaaatggtgggagaaagggaaacgaaagggggaaggaagggagagggaggggagggag

SEQ ID NO: 45192 - DNA, 1188 bp, Heterodera glycines
tctacaatcgcctttatacatcccattatgagcgctaaattatcagagtgccgaaaatcgcatgtgatctaagccttaaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagaaaaaaatggtgtaagtaaaaatcgtaattacgctcaaaaagcttctcaaccaattttagcgcttccaattccttctacaatcgcctttatacatcccattatgaacgctaaaattatcagagtgccgaaaatcgcatgtgatctaagcctagaaaaaaatggtgtaagtaaaaatcgtaactacgctcaaaaaacttctcaaccaattttagcgcatccaattccttctacaatcgcctttatacatcccattatgaacgctaaaagtatcagagtgccgaaaatcgcatgtgatctaagcctagaaaaaatggttaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctt

SEQ ID NO: 45193 - DNA, 621 bp, Heterodera glycines
atttacactggaaaatgccttttttgtatttttttattttgatcagccataactcgcttcattcccaactaaagtgaacaaatgtggtatctaaaataagaatttgaaaaggggaatctttttctaagcgaatgctaagcaatttaagtcatatgaaaaaagttgtgagagtttcaaatttttatcacgttataactcaagtcctaaactgctgatttcaccaaaatgcgaaaactaatcattttctattgattctaagtgttcaaagtgattttgtagcctataaaccaaaattgttagaattagcgaatttgatgttttttcatgtgttagagacatgaaaatagtacgccaaaattagaggaaaagaaatgcaaaattttcatcatcccttaactttaaaataggatagaaattcattaaaaccttatagaacattcgatgcaaaatttttatgactatcgatttgcaaaatttaaagaatgtaaggcgaaaaaaaagttctatagagcgaagtgaatgttgttttttacatcattaaaatgaagagatagtacgccaaagagagagaaattataaagaaaaagagaaacgacgagatagtacaggcttttctctgca

SEQ ID NO: 45194 - DNA, 1363 bp, Heterodera glycines
  misc_feature (996)..(996): n is a, c, g, or t
  misc_feature (1133)..(1134): n is a, c, g, or t
  misc_feature (1322)..(1322): n is a, c, g, or t
acaccaccagctgaatttgtgcgaagaaagctaaccggtttcaacgcaattaattactttttgcttaattagccttacatttgctgcttaagtccgggtaagggtattcgccccgggcggtttcaatctgacaaaatgtaaacagcagaaaatcaattgatcaagcaacacaaatgatgaataaaatgaccagagaaatgccaagactccacacgtcggtccgaatgtcgtacccgtcttgactcgctgttaagcgttctggctaaaaccaaagcatgttaattatctggtaattagtagttaattgtgttaatttgccactagtaatagccaatttatagagacagatttcccaccgacatatacggtctgcagccaatgtccttcgttttagcaattgagtccttaaataaaaattcgttttcgcgccgcaatgtgttcaaaatgcctcaaggtatcctgagattccaaaatcgcacagttttatttgaccacgaatgttcaacaaaatgttcgaaggcttaacatctaaagcgagtgcaattaatgggatgatcactgatcagttaaacatgcttattccctgggtgaagcaactaagcccaattctgtgagcttgcacatatttttggcatttattctaaatctcttttttgaacagccaactctattaaaatttatatttaaaaaggcaaaaatattatgtaaattacgattaattcgattttctctgaaaattcataaattttaacttttttattttttctctaaaatgatttttaattccaatttagaactatgtacgtgattcttcacttaagtttaacataagaaattttgagaaattgcaccctatatttgaaaaaatatgtgtatattttcaacccaataactttttttaagacgagtcgtagaccatcgtccaaaggtaattcggcaaagaatttattgaattttttgtccatcttttttttctcaaaagcactcaaattccanataaaactttttttttctcagcctaattattcagggctgccaaaaatatggcacgaaaagtggccaaaatatgcgcataaatatgcaaataaagtcgtgacatatgcatcaaatatgcacaaaaaaaacttgaaaannttaggggtgtaaattaatttaaaaaattttattcctcataattttaccgggttgtttttgcaatttcaaatcaaaaatttctcaaggttttcggcagtgaaactcactgttggcccactctcgcacccattcagatttggatttaattttaggcaatcaaattttttttccgaagggatattcaaatncggaaaatatttgacgaaaaatggcaaaatatgcagaaaaa

SEQ ID NO: 45195 - DNA, 1099 bp, Heterodera glycines
  misc_feature (1011)..(1011): n is a, c, g, or t
  misc_feature (1033)..(1033): n is a, c, g, or t
  misc_feature (1055)..(1055): n is a, c, g, or t
gtgcctatttttatttgttttggcgttttgacttttgatatttgaccttcttatattcattctcattttttcattcgtgtattattctcctcaattttgtcctttttttggtctcctccggaaaatttggttttaataagggaggtttggttgccaagggtcaaagaccttcaagaaagtcaaattgaaaatttggatcagttgatcaaccagtttaaaaatgttttcgctttgcacgaccatgaattaactcagacgagtttggttgaacatgtcattgataccggagatgcgacgccaataaggagcagaatgcggccagttccgtatgcttatcgagaaaaagtttctgaaatgttgagggactatttgggtcgaggactcattcggccatctaattcaccgtgggcaagtccaattgtgcttgtgccaaaacgagatggaactttacgattttgtatcgattacagagcaattaactcagtaactaaaaaggacgcctttccacttccaaacatcgattacattttaatggcgttaggcggaaaacgctatttttcaactcttgattttatgtccggttattggcaaatcagaatgcacgaaaattcagttcaaaaaactgggttcatcacagaatttggactccatgagttcactgttcttccatttggtctgtgtaatgcagttgccacttatcagcgttttatgacgaatctttttgacggaatgataaatgatttcgtttcatttacgtcgatgacattttggttgcatccgagacttgggaagaacatttggtacatttaaaggaagtatttgaacgcgtcggaagagcagagttgaagctaaaaatcggaaagtgtcattttgctgcagaagaattaccgtttttagggcacattttgaccagaaatggtataaaaatggatgccgataaaactcgcacaattatcggtcttccgatccctgcaaccaaaaaacaattgcagtcattccttggtttcatgncttatttcaaagaatttatttncggttttggttcgttggcagcnccacttatgattgataaaagaaaatacaccatttgtcatgggtg

SEQ ID NO: 45196 - DNA, 947 bp, Heterodera glycines
tacccctgtggccgtcaaatggcactttaccaatgccaatgccaaactcggcacatttcgagtcaattttactaatttgctgacattattcccattaaatcagttaaaatacttgaaaatttcttctctgttcatgtccttgctcgccatcgtcgttattttctgttcactatacaaatgttgcgttccggcaccgcgtaattaatcttctaattaatagggttataaattgtatgattttgcatattttttctgcgcatatgctatgaagaaaggggctaaaaaatagcatttgtgtgttaaaattttttgatttggtgaaggtttttagtgcatatacctaaaagcagattttgggggttttcgagaataaatgcatattttgccatttttgcatttttagagcatatttcggtcattttttgcaaattttcataagaaaaatgcgaaaaaaacgaaaaatacacccctaaggatcgacctttttggtaattaaaaaaaatatagccttgaaaatcaaaaaattttgaattttttgtaagaactttttttataaaaatgttgatataaaattttgttttagcatataataaaaatttataaatttggaaattaatatttttgcagttgtttaaaaaaatgctccttagcccttgttttggagttttaaaagtcaattcttaatttatacacaatttttgggattttttgagggttaaaaaccatttttggcagtttttaaggcatatttgggcatttttcgggtttttagggcatatttgcgggatttttagtgcatatttttgcgcatatttggcatttttttagtgcatacaacttataaccctagtaattaataattaattgctttgaattgatccgtgctgtcccggcagccaaaaagtggttttgctaatggctaattacgttggcacttttgcccattc

SEQ ID NO: 45197 - DNA, 937 bp, Heterodera glycines
cgacggaatgccaaaatgaaaatgtcgtcaaagagacccccccgggcatcgggcgcagaagaaacgcactatttttgacattataataacagctgtaaaaaaggaggaagtgatgagacaactcagagaaatcaggggatgctacacaaggataagcagatatttggaggaccagagaatgttcaagaagctgctgaaggaggcggacttttatgagcagagaggtaaatttattatttagaagcaattcaaagcgattaagggactaattgccataaaacaatgccaaaaatgtgtaattattaaagccctgaattttaggttttacctattttttacggataaatacttgatgagagaagcacgaaaatcatattttctccgaacaatttttgtattagattgactttttagcatccaaaaacacttaaaacggggatcagcacttttttagcattttcggtctttatcacctattttggcctttttccagaaatttcataccaaaaatgcaataaaaacgtaaaatgcacccctaagaatcggtcccaaaaatttcagaaaaatacgccccgaagaaccgaccaagaaattttcaattacaaccctaagtatcgaaaaaaaattttttttaaatatctccaaaatttattatttattttttcttgacaagttgcaattgttcggacgaaatttttgcaccttttttgcacctattttagtacctatttcagtatttttggcacataaaaatcccagctctagtcattatctaaattcgcaaaacttagaaatttttggccgtttttatttctcaacatttgtcttctgtgtgggtgcattagattaagatagcttttaacattttgattactctgatagggttttgctatataataataaaaaaaaagataagagcacttttagtaattcaaaa

SEQ ID NO: 45198 - DNA, 1016 bp, Heterodera glycines
atgatcacttttgtgatattctcaatatttcaatttcttatatccaaatgtaatctgtataagttacagtaggaaattgtaattgggggttatgggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattgccgatttcaaaccgatccttccggaacactgatgctgtttatatttagagcgtaatgagctgaaaatgtcagaattcaaaaagtggggtcgcgaaaatagtaaatctgaggttatggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttagaattccaccatttcaactccttatcctctaaatataaact

SEQ ID NO: 45199 - DNA, 1121 bp, Heterodera glycines
  misc_feature (925)..(925): n is a, c, g, or t
  misc_feature (954)..(954): n is a, c, g, or t
  misc_feature (999)..(999): n is a, c, g, or t
  misc_feature (1018)..(1018): n is a, c, g, or t
  misc_feature (1099)..(1099): n is a, c, g, or t
ttcaggaagcggcaggggaatgctaagcaaaaagcagtgcgctgtttaacccattggaaaagtcggcacagacgcgcgttgacccattgccttttttgacaaccacaatgggtgcgccccaatttgtatgttcaaccggacggatgacattcatcgattgaagtcgctccaattctgcctcaacaacagatttggtgttgaatgggacgggacgcggtcggcagtaaattggtgttgcattgggcttaagcgacagatgtgctttcacctttttgcaatgcccaagtccgtcggcaacaatttcaggaaacttctttttgagttcctccataatcgttgcttcgtcaccatttcctcttccgattgcattcaaatgcagtgttgagttcactttttgtcgaatgtcgtccaaaagtccgaaagcatccagcatttcaatccccaataaattcaatgatccacttttggacacataatacgttccgttttttgtggcatctccaaatttgaatttcgcttcccctcttccgagaagagtgcacttggagccgtcgtgatatgctgcttgttcttggcatcggcgcaattgaggttttccaatcagacagtgagtctcttcgttgatcactgtgacctcggcgccggaatcaagcacaaaaatcacttttcttccattcatttccacggtaatttcaatgagcctcgttggatggttcacaatgttcaccattacacctccgatccgaagagtgcaagctcttttcccttgaaatttgccgtttttgttccggttgagccactcatggtgcttctcgcattgtgcctccaaatgtccagctttgttgcactttcggcaaacagttttgatgcttggacattcgcttggagcatggtgaaacttgccacaacgccagcaaaccctttngagtttggttctgaacttggttccctttnttgcgttggtttcatgggccgctgcttctgtttgaccgccatcanatttcgcgatgccatcggncgttcttcaatgactttgcttcggcgaatgggtgattggaaatatttggaagttcttcgacaactccatcatactcgaccnagtcaccatccgctgcaagctt

SEQ ID NO: 45200 - DNA, 1586 bp, Heterodera glycines
tttttaaacaggtcaaaaagtttaggcttatattttaccccaacaggtcgaacctagcgcactaacatcgatataatctctctaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaacaggccaaaaagtttaggcttatattttaaaaagtttcatcgaacctagcgcactaacatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataagtattttttcagaacgtgctctgaaacacacaaaactttatttacaggttagtttaggcactctgatgctttttctatcaaaaagggagatgaataaaatttttaattcctttttaaacaggccaaaaagtttaggcttaacttttttttcagaaactgatcagaagcgcaccaaactttgcagggatactgaaaggaagagtaataacctattttaaatattatctagtcagttcatttaaataatttttatccaaaaaaatttttttttgggttttcggggcagtccccctgaaccgatgcgcccagatttatggggagaccgaatccttcgggaatagcttccctatagcctgtactttattctgcgttggattttgctcccataaatgtttgagtaccctaaacggacacttgaaaaaatcgatttttttgtttcatatatattttttcagaagtgctctaaagcgcaccaaattttatttacaacttaattttagcactctgatgctttttctatcagaaagggagatgaataaatctaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgaagggttctcagcagattccctgcaaaatttggtgagcttctgatcagtctagaa

SEQ ID NO: 45201 - DNA, 1013 bp, Heterodera glycines
  misc_feature (18)..(18): n is a, c, g, or t
  misc_feature (692)..(692): n is a, c, g, or t
  misc_feature (711)..(711): n is a, c, g, or t
  misc_feature (903)..(903): n is a, c, g, or t
  misc_feature (969)..(969): n is a, c, g, or t
caccaaattctacacaanagtgctcacacaattgggatctgctgcttaatgatatgaaaagcggtttggtttttactcaatataatatatatatatcattcctaacaataagatgtttctcgtcttcctaccacattggcccgacttcgtccggtgactgaacgacttggaatgacagaaagagcgtaagacagatgactgactgaccgtgtatcatccgacagacaacaataaattaattctttagaattcttggacgtctgacaagcaaagacccggacgcagtggctgggcaaagtccattacctccgcccggaccctttgtaactccaatggcacaaagtcgcttctcgggcatacagccgaaattcgccgcacttttgaagccgaaacaccaatcaaagaaagaaaatctgccagagaaagacggaaacgacaaacaaaatcaggaggaaacgcgaccgagcaaagaggaaaaacggactgacgctgatgttgagaagacaagtgataggagtacaaaggaagcggaaggaagttgcaaggaggaggcagaaccagtgcaagacgacaccgtgaaagaaggttgactttcgtacattccataaatgcgtatacgtattttcactttcccgttagttatgactagggactccattttaggcacgaaaagtcgcaaaatagacgcctanaaaggtaaaaaaaatctanggctcaataggcaaataaaaaaaaatttacgctttttagctagaaatacacgtaaaaaacttgatcaaaagtttaattttggttatatttcaattgtaaataaaatgagaaattttaaatcaaaatttttatgaagaaaaaaaaataaaattttgggggttattttttgtgaaatttttcccattttcttanggggtgtattttcctgaaattttttcgggtcgatttttaagggtggattttttcattttttgtaanggatttttctgaaaaaggcgccaaaaatggcaaactgaaaatgg

SEQ ID NO: 45202 - DNA, 1141 bp, Heterodera glycines
  misc_feature (1118)..(1118): n is a, c, g, or t
cttaacaaaataccctaaaacagcaaagaatttcacggtggtgccttattttattttgaaattagacgcaaagttttcattttttgaccgattgctatcacattgattttaccgttataaagcggggttcgattgtccgtggccgtgatgaaacgatcgacctaaaaaatgtattaatgaaaaaacaaaattcaagaaaatgtgaaaaagatacattcaaaattgccagatcattctcctccataaaagatgccaaatgctccaccggcacagtgatgcctcctgcgccgtccatgcgactcggaattggacgaaaagtatctgaattgaatccatggaatggatggaagacaccaaattgaaaagcaatgtgggtttaaaatttgaagaaaaatgaacgccctgaatgcattcatttcgtaccaaacgaaaagtttaaaatatattaaaaaaattcaaaactaaaatttggaatagacttcttccctatcctaaaaaaatttcgtcacctttttgcaacacattccgtatcttcagtttcgcctccacttcgtccgcgttcaaaagatgcgtcacttataagggaaaataattattttttgagaaataccagaaattcgttgtcccaaaagtccctttttcctaacaatttttggaaatttttccatgctcctgtgtatttccgaaaaaactacaacatgacccaggccaaagtcatttttaaaacaggacatcgggttagtcttgtatgacaatgagccaaaaactcggtcagggtgtgggttttttcttcaaaatttcgctctataaaatagcgattttttcaaaaaattattaaagccattgtcatttgtggtagtaaaattctaattctgtgcttttcccgccctttgcccacactgactgaattcgtgggatgccacactgtgtctctcgtgttcgttctccctttggctgtccaacagttcgtccgctctcaaattggtcggcgcacagtacggcttgagcctgtccttctgcgctgtgctgacattgtcctcctcactcggctccataatcatcttacgattaaaattgaagagtaattttattttataaaaaggtgggggcgaacccanaagtttggcatttttatgtttct

SEQ ID NO: 45203 - DNA, 877 bp, Heterodera glycines
  misc_feature (844)..(844): n is a, c, g, or t
ctatgaatgatttttgtcggggggggggggcgggctcctcctaaattttttattgccatccattaatccaagccaaacctcctcagaccataaataaatataataaattctatcgtatttaaatggtgtttaacgtctttaaatcaatcattttatttttatttttacggaaaatttttttaattgttattttttgttttgacttcgttaccaaagctaaaaattaaaaaatgttaaaataaaataaaggttttattgtgctttttaagctgattgttccggcgcttttgaaatgttttcttaccctgatttatttcaacattaatcaaaaataaaagtataaatttgactgattttcacggcaaaaaaaaatacgaaatggtattttccccttccctcttttttaaccccatttcaaaaattttgcccccaatttaaaaaataaaattatagtcaaggctaaaaaaatgttccgcattctgtcaaattttgttttttattgttcttacgaatatgattggatcaaaagctcagcatattggcgatgttggtaaacatgggaaaatttgcaaaggtaagctgaattgatcacttttaaataatgaaaattattaatatttaaaggtaattttgtttttaaaattttcggcattcgaaaaaatttggcacatggattccaattcagtccttaaaatgaaagcgtccacatccccctttacagtatgtaacgacagataatttaactgtatttacatgattatccgcttttcaaaaaaaaaaatttttgatttaaaaaaaaaattcggcattaaaattatgttcaccaaaatgggctacatcctgngtttacaaatttactcaataaaaaggtacctat

SEQ ID NO: 45204 - DNA, 1226 bp, Heterodera glycines
atttcatcgtccccgatgaaaatgctaaatcttgatcttctatgggtgagcgaccagcgttttcggcacatacagaatgtacttcggcatcgcattttcagaaaagcgcaaatgaccgaacggcatatcaaagtccttggtgatggagttgtagaatttcgtgtgctcatttttctccagttctgcatgccttcgtgtccaaatgggcttcattgagttcactttctgccattctaatgtctgttccaccaatttcaaatttggcctcgcctcttcatcgtttttctcttccttttgcttttcacctgcttcttccttctcttttgtctcctttttcgcttccccactctcttcgatcaatttctctactttttctgacttttccaacgtgcccacaattgccgggtccgtcatgtgtgaaatttgctttttattattccccttaattttgatggaaaattcttcggttgtaggaagtgctgtttcatttttcggcaaaatggactgaattttgttctgggcatccaacgaattggagtccttaccacattccaaattttcggaaatcggttcttcaacaatttcggcccaacgcagtcccaacggatcacaaaatttaggcaactcgcctttcccatccatgaaccgctgttgtaaactcacagcaactttgtcaaaatccacacccaaacgctgtgaagtttcatagaaaagttgacctccgcggccttgtctgaattcgtcgtcaattgactcacttatcataagataaatggtcatggctcggctgtacaggatatatgcatcctcttctttcccttcctgtattttcgtttttcctttccgttcgacttccatcaaaaagttgagccgcgtaaaattgtcgagccgtcgaagtgaataagtcaatcgattgtcaacgtttgcatgttttttgagcacctcataagattcgtacaccaatggatgcaaatttgtcgatgaagtccgcataattttgtcttatcaacacgagataaaacaaaaaaatccaaatgtataaagcaacacgagctttttataaaagattgtttggcgagcacaacacgagtgctttagacgaatttgtaaacgtggacgaaggcggatgaagaaaaacccaacacgagggtattaaaatttgacgagcagttgacgaacccaacacgagggtattgaaaatatcgataaacccaacacgagggttt

SEQ ID NO: 45205 - DNA, 1271 bp, Heterodera glycines
tttttttttaaaaaatatatcccatatattttttttaatatatcccatttatatccctttttttatatatcccatcttatatttttctttaaataatccgggataaatgttaggtattaaaaataaatttaaaatttatgaataatttaaaaaaaaaacccatatggagaatttcaaatataaaatctccctaaaaatatattggagttaaatttaatgagaaaatttgattttttccatccgaaattgcataattaattaatttccccctataatgtcggcggacacaaggcgagaattcgccagatggtcgaattgggtcatcaggaatctttaatttgttttgatgcaaaattgagtataaataggtaaattgtcagggactcattcattcattcattcattcaataattaaattttattttgttatttataaatatttcgcaaatatttattcaaatgtctcaaccgtgtactttaattactttttagaccaatccattttctgtaaccatgaactctaccgaccgtcgctcaccgtctcctgacatggagctttatgaattgtccgcctggtatgacattttcgaatcgcccgacgacaatgtaaattttaatttttaatcgtagcatctttttttttcactttgccattctcagattttgaactggttcacaccgatggtggcgcgtgacgtttgccaggaggtgttggaattcgccaaagagcgtcgtatgccgtgtgaaaatgtccagaaatggaagaaaattctggataaaatttgtgatcagcttgtccaaaaaaagtgatcgctttgatttgagtttcatgcggttccgcttttttctctctgttctaataaaagatgaacattaaacttgaacgagaaggggacgggagggggtgtcatcatcgatttgaattgtcgcacgggactcagtattgagtgcccatcccacccaatctttactcaattccttttgcgtaatttgacgttttaaattggagggggggggggctcaattgatgtccagccgggtgtatataagcagctgttaattccgccgtcttccatttcattctcgaaaatttttctcccaaataaaaatggcaatcaatatttccgacaaaaaggcgctcgtcaaccaaatccttgggcaggcagacattacggtgacaacaagcggcataaccgtgagcgggcctcgtctgtccccccgcgatttatcccgttcgaggaatgccgccgctgccgcgcatgcaaagctac

SEQ ID NO: 45206 - DNA, 703 bp, Heterodera glycines
aaatggcatttgttttttaggtcaaaaatgctttttttttaattaaagtttggcactttgtcattgccggagggcactttcgtcattgagccattggtggtcattgatgaggaacaacagcagcagcagcagaaacacagcggagaagcagacaatgttgaggtgcgcaaacggaaacggcacctggcggccgaattggactcagatttgcgggcacatctcgtctatcgacttcagtcccattattttgaggtacaggctcggcacttcaaattgtctggcacggctctcctgatcagtaacagtgaccagaattataagcatttggcataatggcccatgtgatcagcagatagcaataatcacagtcaatcagtgccttttgtaatgctgatcagaagtataagctcgaggacacacataaaactctacaatttggttgtcgcccgaaacccgaacgcccggattatttcccaagccaaacccgaacgtttttgtcggctttcgaatcaaaaaatacaccctaaaatatagctaaataatttcaattattatttgctacaaaaattattttctttctgacccgactgacccgcatttgtgataataaaatgaaacggaattcattaatttgttgtcagactcattaaaatgaacctaaaacattctaaaggataccgctgatcatcactatcaaaacgga

SEQ ID NO: 45207 - DNA, 1064 bp, Heterodera glycines
gcttggctatcagtaataatgcatttgccgtattttcttttaactccctgggttttttagccccctcggcgggggggggtgctctaatggaatgagccttataatagaagaaatacagaacattacaataaaatgccacccgagaccttccccctttagaagaaatacagaacattacaataaaatgccacccgagaccttccccctttagaagaaatacagaacattacaataaaatgccacccgagaccttccccctttttaatttattttttaatagctgaaaattgctgtaattcattgctttccaccaacagaattgtggaagtgtccggcgacaacacgcccgagccacacgaactaaacagggcatccattctgatcacaacacccgagaaatgggacgggatcacgcgctgtgcggacacacggcactacgtcaaacaggtggaaggggggggagggctcccacccgagccgcgaagcggcagagtgagtaccttcggtgcaggaaaattattaaggaagagagttcattatttatttatttttgcaaaattaattcataaatttttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatctaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaaaaatttttaattcctatgtaaacaggccaaaaagtttaggcttaacttttttttca

SEQ ID NO: 45208 - DNA, 1446 bp, Heterodera glycines
taaagccccccccctgaattagagcctcccttgtgagcatagttgaaaaaaagcccccggggctccattagaggaaatactgtattattttctttgacaaaaatcgaacgcttttgctgtgctcacccaaagcaattgtcgtagctgttaagcgtaaaatggagcatccgactgttcgtctttctgctgctgaaccgccgccatttccccattaattggacatcgcttcagcacccaagatctagatccttccttggttagtgtcagcttctcattggtccgttcgttcatcaatgtaaattcaaatggcacaattgatgttggcatatcaaaatgaactttgtagctgactgaagcggtggcacggagaaatgtctaagaaaatgggaaaaaaaatgtgaatcaaagccaatcaatcaatcagggctgggaatttaagtcacgaaaaattgagtaaaaagttggctaaaaaagtagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaatttaaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaactttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaattaaaaaaaaactatgaggaatcatattttctttataggaaaccaacgagtatacaaaaaaaaaaattgaaaataatctaatttctgtagagggattgaaccaggggaaagaagaagggaaagtcaaggagactagccattaggccatttgcacacttgggcagtgttacttttaaagaatatattaattattattttttatttttccaattgactccaattttcttcactaatttttcactcacaaaggaggggtcggcaagtgaccgtgggatttccaaatgaaatttggtgggtgggtaaatcacccctagtttctattgtgaaattttaaacatttttgccaaatgagcatgagtgccgagatatgacgggggggagtttttatgcttttttaattagaaaagatataattct

SEQ ID NO: 45209 - DNA, 805 bp, Heterodera glycines
tctccccacatatctgtgcgcatctgtttggggggggtcccccgaaaacacaaaaaaatagattttctcaagtgtccgtggggggtactcacacatatatggggagcaaaaatcccacacagaattaaagtacagtatatagaaaagatattcccgaaggattctctctccccatatatctgggcgcatcggtgcggggggactcccccgaaaacaaaaaaatcgattttctcaagtgtccgtggggggtactcacacatttatggggagcaaaaatccaacgcagaattaaagcacaggctatagggaagctactccggaaggattcggtctccccataaatctgggcgcatcggttcggggggacccccccgaaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttaacaagtgtccgtttggggtactcaaacaattatggggagcaaagatccaacgcagaattaaattacaggctatagggaag

SEQ ID NO: 45210 - DNA, 1396 bp, Heterodera glycines
tttccaataaaaataaacaatgcaaagccctattataataaaaataaataaatatgtgtgggcggttgctgcactaattagctaattaccattaattagcgtaaattattgattgcgctgtttgccttttattggccagtcaaagcattcatcacttcagcagcagagattatatggatttcacctaccttgagctcagtaatggaattaattaaccgaaaattgatttgcccttattcaaaggacattgaattaggtgaattacgatttcaacaaaaatatgaaaattaaggtacttatcaagcataaataaacaaatatttaataagccttttttttgcactgacgtcttttattacttttcagttaagggatccttggccaacaattaaaatcgatagaaattagacatattaaattttaaattcttattttggtaattgcatcaaaatttacagccatacacggggctgctctttttaattaaactttcttggtattgttaaaaacttataaaaaactgtataaacctgcaaattttcaaaattttttattcatgtaaaaaaatcagggcaaaaagttcaaaaaactaagtttttgagttccttctggtcataacttttttgaggcttaacgaaaatttttgaaattttgcaaattaaaaactaaacacttagcgctatcgaacaacactaagaattcttaatttgattgacaatgagaaagttatggtctaaaaagtcttccggcgtcgttttggggtgcaccccccaaatcggcagtttttgccggttcaaaagaagtgatttctttattacgcatgacgttaattaaattagaatagttcacacgaaattttcacaattcattaaaataaaattatggaataatgcaaactataaaaaaatttgccaaaaaaccaaacggaaattctcacatttactagaaattgctttcaaaattttctctcatcagttaccaacgcgtttaaaaatgaatttttacataaaatgataattttcttttgtttaaatatatcaattttcacaccaaatctatattagataactttggttttcgcagattgtacttttcaaaatttatttaattgctagtcaactagtctacctcattacttacttatttatatatatatatatatacttaatctatcttcctcattaatctatttccctcatatcatttgagctccgtccaataaagccaccaactgatgagtcgttttaaaaaattgctacccaccctctatatgtgccactgaaaattattaattgcattgaaaaaccacccacccctttaagaatgtcaccgaaaaattttattacattaaaaaagcttagaggacctatcaattagtgccatcgaaaaatttaat

SEQ ID NO: 45211 - DNA, 765 bp, Heterodera glycines
  misc_feature (665)..(665): n is a, c, g, or t
ctgcagcctcgttcaattgaagcggaaacgggaggggcgcaggcagaacaacgcctggcatgtccggcagcggaggcggtgcgggtgataaagcggcgagagtatattggtgatgatccattttcgacgcttgcgcggatgccggcggtgtgaaagcggacaaaaaacatggcaatgaagggaattttggcgccactggcgacaacggcaccaccgcttcgtcagtgccggcaccgctcgttcctccactcgcggaaatgccaccactgctgccgccctccaacgcggttgcaggctgtgtgacgacgcggcgacgcattttaacgattggaacgcccgagggcacggaactgtcgcggatctcatgcggcaacagggcctgatcggggtccaagccttggcgcagctgatgcatggatatcggcattgtgccggcggcggctgaagcaacgccggcgccgctcccatttccaaagcctggcaaacagaaacgcgaggcgaagtcatcgccaaaaagtgcggcgacgctttccgggtcgcggtggcccatgcggaagtcgttgcgcaagtcctcctccgtgaccggcggcattagcgacgccttgcggcgatactgcggcgactgtgtgttcggggaggacgacgccagcaactgctgcgattgngggttagcaattgcattggcagtgacgccgaaggaggacggcactccatctgtgtcgtccgcttcttcttcttcttcttccctcctcttcttcatccgct

SEQ ID NO: 45212 - DNA, 971 bp, Heterodera glycines
  misc_feature (896)..(896): n is a, c, g, or t
  misc_feature (925)..(925): n is a, c, g, or t
actcgaagcatggcagattacctgggtgaaatggtttgtcagataatttggtcaacgtattataaaagctcatgttttctgaacagcgagaaaaaatgccggttcattttatgaatgctttttacgtcggtctagtcctcatttgtgtgccgtcagtgttgcaatcggagctaataaatgtggatttggaggttgacaatcaaaactatttcgacagcggcaaatatcgtaccttttcaaaagatgcgaccgcacaacacttcggctacagctggaatacagcatgtcgaattgagaaatgtgagcgcgacagcgaatgggccgtttcacttcaaaatgtttacactttgcacaattatcagagtgtgtttttaaaaatgaaatcattgatgaaaatgtcaccattggcctgttttgaatacaatgggtatagttttaccttttttgaagacagagaatctggtgagacggctatcttccgtggtcaccagcagaagattgtgcaacgactgttcaaacatggacgggttgtgtttgatcacctatcgggtcgattgtttctgatcgataaacaccagaggcgaatcagtgaaatagagcttgaatacctggagcattggtggcttcgaaaaaaccaatcttccgcccatacgattttgaagagcaactttgtcgcttttcttccaccagataaaagcgactttactttggtggacaaccatgtgtttgtgatcagagaccaacgcatctataaatttcacatttccgactatgcaaaagggaatcgtgcgctaacttttgtaaccaattcaaatgacgtccgatttaattatctaatttataaacccagagaccaaaacattaacccgcggcgtttttgctcatctacgcatgtncgacgcttggatgccgatctcgtacctgntcatctggttctaattgtactttgcacatacatacttaaacagcta

SEQ ID NO: 45213 - DNA, 865 bp, Heterodera glycines
aaaaaattttgttaagttgattaagtaaatattattttttggctttgaattatttcagttatatttgtaaaataattaattttatttttgtaaatatattttcttagaaattgacgaattttataacacaattgttttttgaccccaaatgtgattttgtagcaaaatgcagattatgaaagcttaggataaaacaggatttagtcatttttggctattatgggatcaaattctgaaaaaatgcaaatattgggtatggctgtgccattttagcgccaacggggtaatagtttaggtggtaacacaccagggatggcattccgaggccccaaaaattttcggaaatcggaattccgggggtcaaaaatttttcggaagtcggaaatcggaaatttttcaaaaagtataaaatataataaaaatttgctaaatattttagtaggctaattttttgattcttaaccaaataaaagatgttttcaaaaatgttattggttatttgaatattttgcttgctaagttattcaatgattttatcaaatcttttttatgtcatttttcattatttgaaaacatttttggtaaaaggagtgactatttacgcgttttttacagcgcgcttttttcaaaaactttctgggaacaaggaggggtaggtccggcggtgccgataggcgccgggaaatttttaaaaatttcagttcaatttattaacagaaattgtacaaaaattactaatttttataaaaaaaaatttaaaaaattttcgaaaatttacgacttttcaccaagaatttcggaaatcggaagtcggaattccgacgaccaaaattttttcggaaatcggaattccgtgccatccctg

SEQ ID NO: 45214 - DNA, 944 bp, Heterodera glycines
attttcagcgaaatcagcaaattgctgcacgaaccgttcagtttccgtttgatggaggcaattaaatttttaatttttaccaatttaattaattatttaaattttttttcccatttttcagattaatagcaaatgtgctgctgtgttcgaatcgttgggcttaatttcggctgaaaaggaggaaatttatttgcaatttgaccaatttttgaaggagaaaatttatgtaaaaaaaaatatttaaaaaaatattttattttttattttcagccaatttccaaagcgatcgaagcttttctcggcactatgcgcgaatgtgcgcagatggcacgcgactcggcacgcgcgtgtgccatcttttcgcaatggagccgcgaatttggggaccaattgcaattgcagccgaattgggaggtgaaaagagaaaatttaaattaaaaaagaaatgcaaattatttgaaaataaaaattaaaaaggaaaaatatttaaaaaaactttaattcaaaatcaaaaatggaaacggaaattcataattaatgatacaaatttaaaagttaaaaaatccaaatttatctatctaattaatgatgcttaattatttatataatatttaattattaacttttttgcactgacagttaatgttctacaaagtgcaagacttgcagagcaggtgaaagagcacaaaatgaaatgcaattacaattaaaatgagaaataataaataataattcgatttattattaaaactattaattacaataatttataattaaaaaaaatggagcaattcaattaactaatttgtcaacagatttcgcgagaatggcctcacaaagcattggcttccgccttcgctgagtccgcttttgcaagtgcttattttcgagcacagaaatcgcatggaagaacagaaaggcacaaaatttaaaattaaaatttt

SEQ ID NO: 45215 - DNA, 950 bp, Heterodera glycines
ctggccaaggcgactgtgctcattgacacgtagttgttcaataaggtacttggactttccacagtaaaatgtggtacaaaattttggaactgtcccgcctcacggcggggcttaaaagtattgtacagcataattaaaaccgaaaataattttcgtatatttttcacaatttatttcaaaagacaaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaaacattgtacagcataattaaaaccgaaaataattttcgtatatttttcacaatttatttcaaaagacaaaaaaaaatgattcaattttgaaacgaaatagtgcacaaaagggagggatggctagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcttcacggcggggcttaaaaacattgtacagcataattaaaacctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgaca

SEQ ID NO: 45216 - DNA, 1086 bp, Heterodera glycines
catgctcgagagtatttgtatgtgtataaaatttctaaaaaagagatagccattttctgggatagagtataattaaaaattccctcaaataaaagatcgattgcgcaccgccctccctatcatgctcgagagcatttgttgtgtataaaatttatcaaaaaaagagatagccatttttctgggatagagtataaatttaaaaattccctcaaataaaagatcgattgcgcaccgccctccctatcatgctcgagagcatttgttgtgtataaaatttatcaaaaaaagagatagccatttttctgggatagagtataaatttaaaaattccctcaaataaaagatcgattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaagatcgattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtttcatacgcaagcgcttttgtgaggtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggataacctctaaatataaaaatcctctgtgaaataaaatggcgattgcgcaccgccctcactatcatgctcgagagtatttgtatgtgtataaatttatcaaaaaagagatagccatttttctgggaagagtataaaattaaaaattcc

SEQ ID NO: 45217 - DNA, 1048 bp, Heterodera glycines
atgtatgagcatattccggacagtcatgaagcgcgagaaggtcaatgacagaggatggcaaacgccaatttatgttgttttcaggacagcaaattggctattaccaatgggtaccattttctggattattattcattcgctgccaccattttcttggcacttttgccattcctatgaatccattgattaggtgccgttcattctgatcgcccaagcactgatgttttctttgccgtgcattctgtggcgattgctcaattggcaaaatggtccatcatcgatttgccaattgcttttgcttttattcacatctttttttcctcccaaaacaggcaccaacattcagcaactgatttcggctgcttgtgaggcgcgttcagtgatcgacgcggatgagagggaacgcgtggtgggcgcggtggcgcggacattcgtcgaaatgttggacctgcgcgaagtgagtgtggtggaaagacagacactattttagggaattttaatggccggatatccgattctggcattcgtattgactttgtagtcctggctgatcctggcaatccatcaccattaattattgcattgacatttcatttaaacttttaaacataatcacgcttaaaacaattttctaaaaaagtattacatattttgctgttctttggtctcatcaaatttttaaataggcaacagaaagcggcgagattaattaatacacaatttaaaataaagaattttgggatgccattcaattttatttatttgaaattaaatttttttaaatttaaaaataaggacacaaacagcgaagtacccccaaaaagggatgattaattcaccattgatcatgattcatgacccaatgatcagattcaaaatcggccccacccttacgcttcatccctcgcccgtttcaacccaattcggctgatgaatggccatttggtctgttccctgtatttgttcaccaaagtgtgctattccgtcaacattatgctccaatttgctcttctcaatgccgcactgacctcaaaagaccattttctgt

SEQ ID NO: 45218 - DNA, 502 bp, Heterodera glycines
tatataattttaaaaatatttcttttttattaaaatatttatattttaatgttgctaatttttaaatcggatttgttatttgatttttatttaatcacgtagcattgttgtagattcatcaagttttccgctgcgtcaattagttatttcaaatataaattaattttaatttttttaatatatttcattaaggtatgaattgtaattattaatttatcttcttattatttttccttttatttaaatttccaggaaaatgctcatcattacaacattaacaccactgtcattcagatgatcattttttattatcgatccaagcatgtttaaaataattattttttaagcggaggggggaagcggtcgaaaaattgttggtcttttgttttgtttttttttcaaaattttgaacatttgaatgtgtgtgtgcatattttaatgtgttacggaagggacatctctttttagcatggattttttcatacaaaattttttttaatat

SEQ ID NO: 45219 - DNA, 1121 bp, Heterodera glycines
tctttcagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaactgcttagagggattttcggtgttcagccgcacgaaa

SEQ ID NO: 45220 - DNA, 568 bp, Heterodera glycines
tgccagtgctaattattctcctaattaagttggcttttcttagaacaacgaaccaatggacggttcagctttattcatttaaatgtgtaaaattaaataattgaataaaataaaattgaaattaatatgcctaatttccaagttttttggcaaatttcgattaattccgttttcaaatgcattttgctcatttcttgtttatttcactttttacttaatgatatgtggaggtgtgccgtgactgaaaaatcccgtgaatcgtgaccgtgaccgttaatttttgagtttaatttttctctggtgctgaatttttttgcgttttttggggaacagggggtccggtgcgccgataggcgcatgaatgtgcacagattttaaccaaaaaatggccaaattttgcaaatttgagccattaaaataattggcttaattagaagtgcgtaaaatttgtaaaattcgaatttttagaagataagcattgaatgctatagtaacatgtaaaacattggagaggttttattattttagtttttaaaaaaatttgatcacacataacttatcattaact

SEQ ID NO: 45221 - DNA, 736 bp, Heterodera glycines
gatgaggcggaggaggatgatggcattgccgtggtgttccgttgagtcgcctgcaaattcttgtcccatttgctgaccgtccgctgcactttgttgctgtacatggactcaatgtaccttgaaatttgaatttttgaaattttaaaatgtcaatgccatccatcaacatccatgcccgcctctccaccgctggctgaccttacataagcctcggaatgaagcacccgttggattttcactgaagcagacggctcaacgaacacgggcaacgccattttgggcatcgcattgaccaccgctcgaccagggtcgatgataatctaaattttattttaaaaaatgtaatattttttttgaaaatggacaattttatttctaaaaaacaaatatacaaaattaagatatttttatttttagttgaatttatcagtggtaaacaacaatgttgtacctgctgaacctgcgattgggcagaggacgcattcgttccaacgaggccaacagttccagccgtatagggcggtggcgactgaacaccaaccgcacaagactcagcatttgtcccgtaatgatgttgaatgtattgttgttgaacttcttgagcttgatgttgttgttgttggggctgttgcaaatggaaaagcaccgttgggccaaccgttgacgacgacgacgacgcggaacaggaggacgaagcaaccgctaaaaaatgcacaaatgttgttgaatgaacatg

SEQ ID NO: 45222 - DNA, 1369 bp, Heterodera glycines
atttgggcccaataaattttggcatcgggaagtttatgcatcatatggaggaatttcaaaaaaataagataaataaattttgtaaaatgttattcattttgcaatatttctttaaataaaaattttttaaggataatagatatgcttataaaatcacgttttaaattaatttaggattaacagaaacaaaaaaccgaaaaccggttccgaaacaaagaatcgaaaatcggttttttgggctaaaataaaaaccgagaaccaatggtccgaaaacagcagaacaaaaaaactggaggtaccggttaataaccggtcgtgaacaattagaaaagtataccaatacataagaatcacataaatttaatgattggctttttattttgttcgttcaaataactcaattattatgaacttattggttcaattattttactagtgttcgctatctttaaattacattataattgttatgaaaatcatttattatcattaaaataattttttatgtttttagatacattatttattggatgatataggaaattattatacctaatatttttaagtgttcattgtaaaaatggcaaatatttgtaaatttagtaaataatttaataatttcacggtgaatgtcttccatgggatatctatcatctttgcatttaattattaattgcattatgagaaaatgcacctttgcatttgcatgtagatcgctgctgggaaagaatttttttaatatcttttaattttatttatttttaattttgatctaggtatattgtaattttttaaaattcttctttttgtcttcattagggttttcaaatttgaataaatttattaaattataaaataaaaaatatgcaatacatcattaaatttatttacataatcacttcttttttaaattaatcaaaatgtaaatgataaaaaatatctgtaagtttttattgaataggcgacatgaacatttaatttttttggagaataccgattcacatatgactacgaaaaacttcattgagtttgaacaaaataatatattaatataaaaaaagaaattaatttatatataatattaaaacttatcaaagtataatcattttaatgaaaatatctattctcgacataatgacaataaaaaatgatacgcttttattggacagtgtgaagtgatataattgaaaaaagaatatacaaaaaaatcaataaatttgtttatattttgtgtagggtgtatggattaaataaacctcttaaaggccacaggagataaaaatttaaaagattagctaagtaaaataaataagaggcaatatgggaaaaagcaataaaatgataattacaaggagtaactaaaggacat

SEQ ID NO: 45223 - DNA, 77 bp, Heterodera glycines
catgccgctcggcaaggcctacgacaagatgatcgattccaagttcgccgacatgaagaactcggccggtcgctatg

SEQ ID NO: 45224 - DNA, 1642 bp, Heterodera glycines
  misc_feature (1405)..(1405): n is a, c, g, or t
  misc_feature (1570)..(1570): n is a, c, g, or t
  misc_feature (1614)..(1615): n is a, c, g, or t
tgagctctgtgcttaagcatttgatttcaaccctttttattgcctttcaatcgctttaaatcggaaaatacgctatttttttacggatgtttaaactgttatatctcgtcaaatgttgtttttaatggggtttacactatacattcagtttttagagagtgaaaacaaaaaatggtcaaagaccgcctcatggaatttcaggtaatagaaatgactgccttttccattttgttacgatatttatacatgcttttggtattttcagcagttgtccggtatgaatcggaacattgccgctaaatgcaatccgtcatggaacagaccaatgaaggaccgactggggaccctaaaaccggtcggttttttgttttattttcccaattaatgataattgcgttattaaaaacatttcaaggccgaggatgaccatttggtggcgagccaaagtcagttcatggaagactttttcgagcaggttgaagagattcgggccagcatcgacctgatcgccacgagcgtggaggaagtgaaaaagaagcactcggccattctgtccaacccgatcaacgacccaagtgagttttttgaggaaaagtgaagatgtaagactaaaatagagttaagataaaacagactgtagaattggcaggcgtgtggttacatagctccatgatgacctaacctacctatatttttctttaaacgaaaatttttggatttaccaagaaaaagcgggttcaatttttcctcattgaattttattcatatttcgggatggggcgggggttttccgtcgtttataaatagtcactttcgaattttttaaaagacaatttaaactttttaaagaaatcaaagagcagctggacgaactgatggtcgagatcaaaaaaactgcgaacaaagtacgcgggaaattgaaatgtcagttcatttgttactttttatttgttttgggttttatttcatttataatttattcggattggactttttcattcaaaagtttgcacgattttcaactgaaattcgaaaaggaattgttagtgccaagacaaggctccaccatcggaatttaaatacttttttctatttccagccatcgaaaataacctcgaccacgacgaaaacggaggacaagcgaacgtcgacctgcgaattcggaaaaaaccgagtgtcaactttcgaattcggataaaaaaagcgagtgccgaccaacgaattcggaaaactcagcacgcaaccctggcccgaaagttcgtcgaagtgatgaccgactacaacaaaacgcagacggactacagagagcggtgcaaagggcgcattcaacgccaattggacattggtcagtgggagggcacacgactaacgacggactcacttttggggcccttgtatctagtgnggaattaggaaaacccaactctgaaagtgggcggggaaagaccggactggcataacttggtgccaagcctggttttctggggaatggctgctttaatattttatgtcgtctcgtttatacaaagtgaacatctgtgccccttttaagtgggtcttcagatgccgnaaagaggaagtggaccgtgcgattgagaatggcaatttgtcacnnatgtcgggggtcgggtggtccacatga

SEQ ID NO: 45225 - DNA, 1133 bp, Heterodera glycines
ttcacatctatgtaaatttagactaaggaatccttgcaattgacctaactttctgtcagtattttgtaatgtttactttaaaaatttctgaatgtctaccaagcccttgaaatttaattttcttccaaggtccttgacaatgacctcaatctgattatatctccgagatttggattgaaaaatcgttttcttgtttgttagttttttggatcagcccatgagttgatctaatcctgtccatagctttggtattgtttgatcactgtccataattggtcgtaaactcttgatttatttgaaaattggtctgattctgactgaccagcagttccttgaaatatgattaattaattctgactaagttaattaatgttcggactagcgggtccttgcagagaaaatttttggaaaaaaaattaaattaattaatattttattttccatcagaaaaatgtagttggcccccggtgtgatcagtgccgtcccggcacatttgatctgcgcaagtccgacctgtacggctgctcggaatgcttctgcttccgcgtcacggaccgatgccgctcatcaaattggcccatccaaacactgcgcattccggacgagtcgtggagcctcaaaattggcaataagtgaaatttttccaaattttaaaaatttttcataaaaaaaattgccaaattttgccaaaaaaggtcgtcaacaaatggcacaatttttgtggaagatggtcgaattgtgtacgcacctgaggcgggcttggttccagatgagttgccaatggaagtaaccttcgaggcacgccttcagcctggcatggacgtaaatgtttttactaaaattaaataaaaaataaataaatttataaaaattcatttttaaatattcatcaaaaaaacgatttaaaaatataataaaatattaaaattaagtacacgcgcatgtatggactgcatttgtcttatgccatctccagcttcccaagctcggaccgtcccaaaacattctcacaacctgacgtccgattggtaattttttgtaatttatattttaaattataatgtataaaaaaatcaaaattttattaaattaaaaatcactttatatgttttttagtgcttaaacaattcccg

SEQ ID NO: 45226 - DNA, 967 bp, Heterodera glycines
tatctcctcgccttctgccgttcaacattcccaaacagtttctgtccaattgctcgatgtcaacgatgaaaccgttgttccggtcaatggcgctgtgattccgtccccctcattcatccagctaagcaatgacaatcgaccccttttgcaaatgtccaatggccaaaccatcgaattggtgtcggccaatgggtttcacttctcggacggagtccaaaatgtggaagaagtctcttctgaagggacttcttcctcttgcggaggctctcgactcactcacaattatccaccaacgactttgctttcgacggcagaagtattttcgccccaacaagttgagcctgtgtacgtgaatgagaagcagtacgcgcggattttgaaacggagggcagcgcgagcaaaattagaaatggaaggccgaattccgaaacaaagacgggtggggagaaggaaggggaggataagtgtgcaaatgccatttaacagaaatatttgcacgaatcgcggcatcggcatgctcagaatagggccagacgtgctggaggaaagtttgactcgggacagcctcgggcgaactcctccgcttcagttcaaggctcagagggaggagaccaagagagttcgaagaaagacggaagcgaaccgatggacagacaaatgccaaaagacagcccagacaaatgaccacaaaacattttataccctcaaggaatgatcaaaagatgtatacctctactcactgttgtaataataaaacacagacttttatggaaatgatttacatttgattaaaccaaaaatcatttccatggttattggcgacagagacgttacgaccaaaaaccgggcacacgagttaagaaacccaatttcaaacacttggaaaaaccgtcaaatttacgcagttctttaaggttaaaaacgtaaaattattaacggaactatcttcaagttcgcaaattttcag

SEQ ID NO: 45227 - DNA, 1115 bp, Heterodera glycines
tttttctgagaattaattcacaattcccgcagctcttgcggtaatggaaaaattttgaagaggctctgcggaacggattagcatcggggttacgagatagaaaattgtcgtaaaaagagatagccatttttatgagaattacttcacaatttccccagctcttgcggtaatggaaaacattttgaagagattctccggaacgcatcaacatcggggctatgattagaaatttgtcgtagaaagaaatattcattgtttgtagatttaattcgcactcgccactgctgtggtggtaatcaaaaacattgcgcagagagtcgtcggcgccctcttccatagaggcggagacatacattaaagccccataaagcgagacccccttttccgaaaatagcaaaaaattggatcatcgtttaaattttaaaagttaaaatgaaaatgaaagtataaaataacatccgattgatgaggacggctaacttaacgggaataaaagtacactggtaagaatgggggtccgagtgaaaaaatttgaagaaaattggtgggaaaatagtagagtgccacgggaccgggaatttttgccaaacccgggaccgggactttccgggacctgagaagccgggaccgggccctcgattttttttcgggaccgggaccgggcccgcaagaaaatccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgatttccacatcacttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaatcttacatttggcataagaagaattgtgaattttgtcaaaataaaa

SEQ ID NO: 45228 - DNA, 1040 bp, Heterodera glycines
cactaatagtgtgtttgaaaacgcacgaaaaatagttattgacaaaaaatggctatctctgaaagtcacgattaaatccctaccgtgaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttatgtcttctgttgtagcgctgaataaagcactaatagtgtgtttgaaaacgcacgaaaaatagttattgacaaaaaatggctatctttgaaagtcacgattaaatccctaccgtgaattggtcaccaacttttgtcttttgttgtagcgctgaataaagcactaatagtgtgtttgaaaacgcacgaaaaatagttcttgacaaaaaatggctatctctgaaagtcactattaaatccctaccgggaattggacaccaacttttgtcttctgttgtagcgtgaataaagcactaatagtgtgtttgaaaacgcacgaaaaatagttattgaaaaaatggctatctctgaaagtagtgtgtttgaaaacgcacgaaaaatagttcttgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacacaacttttgtcttctgttgtagcgctgaataaagcactaatagtgtgtttgaaaacgcacgaaaaatagttattgacaaaaaatggctatctctgaaagtcacgattaaatccctaccgtgaattggtcaccaacttttgtcttttgttgtagcgctgaataaagcactaatagtgtgtttgaaaacgcacgaaaaatagttattgacaaaaaatggctatctctgaaagtca

SEQ ID NO: 45229 - DNA, 499 bp, Heterodera glycines
ggtatattttctgaaatttttttagatcatttcttagtggtgtattttctgaaatttttttagatcaattcttagtggtgtattttctgaaatttctttagatcatttcttagtggtatattttctgaaattttttagatcatttcttaggggtatattttctgaaattttttagatcatttcttagtggtgtattttctgaaatttttttagatcatttcttagtggtatattttctgaaattttttagatcatttcttagggtatattttctgaaattttttagatcatttcttaggggtatattttctgaaatctttttagatcatttcttagtggtgtattttctgaaatttttttagatcatttcttaggttctatattttctgaaatttttttagatcatttcatagtggtgtattttctgaaatttttttagatcatttcttagtggtatattttctgaaattttttagatcacttcataggggtatatttt

SEQ ID NO: 45230 - DNA, 1301 bp, Heterodera glycines
ttgcatttgtcgtaattacacctattatgataaattaatgaatatgttttcgtaaatattgaatgtagctattctcgagttgtgtaaaattttattaaataaatttttaaaatgaaaaaaggaatttattaaattaaattcaagaaattgtttttaattttctcctcgcagtctccctaccgtatatacaattaatacttttatttttctcatttatttttcattagtttatattcaatttcatttttctctttctcattatttttttctcaccaccgtaccatttttttcctttactctttgtactctcctaagcgtatgtgctatttctcttcacttaacagtttacggtattttttttctactcctttctctgctaaattatcctcggcgtatgcactatttcatttgtttctcattcttttttgattatttcttcaaatatctattctttctccgcacactacctcctttttctcaattgacaaataaacagatggacaaaaaaattcaacgccatccgtaagatgagcaaaatatgagaaaatgggccaagcttcatttaaaaattagcgccaaaaataaagaaatgtcaatgcttcatttactgccgccaaaggaaagatgtcatttgtcaaaaattcttcacacaattatgagaaaatcttgaccggtcaaagaaataacagtcgtaaattaagagaaaagggtgacagttgtcaacatgtcgtcgcacaattacgaataattctatggtcaatcaacaaattgacgccaaacatgagaaaaaaagacgccacttgtcaagaaatttggcgccaaaatgtgaatatgagtcaacttcttacaaaatagctttaatatctgatgctagacggaactgatcaacgttgggcttaaatgtgtaagcacgcagggacttctaatcggtgtgggcgtgtcacgctgatcagctccccgaatatcggccggttcgtacaccctgtaatttacacaaatcattttaaaaattttgctaattttgttgttgcttttttggtctcactatattctgttgctttcctctcctcgtggctttttcaggaacaatttttaaattcatgaaataaaattaaatatggataattaaaataaaaatgaatatattattttcagttgttagttgggttttaattttaattttatttttaaatattcactacatattttcattattcacacaattagttcaatgtccttaattttatgtaattcttcaactttaatatatttacttgatattttacactgtcttccactct

SEQ ID NO: 45231 - DNA, 1278 bp, Heterodera glycines
ggactggagataacccttctgcattttatggttgttttttaatttactacatgcaaattaaaaaatatatatttaaaaaggtctctgccaccaccctgccttcctgctggacttcatctgtgaaatcaatgaaagcaccgactgacgatggacgctgcccgatctgagctgctcgccattttattcgaatatgacaaaagcgatacaccatacaggacgccgtcattatgcgaattttggcggacgcgaaatgcaacaacaatggcgaaataaatccgtggcctgtgacggcgatcggtcttcaaattggaggacatcagcaaaattgaaggatttcgagaatttttttggttcattgtccatgttccgtaatgatttttttgataattttaataaatttattcattttcactatgtgaagtttgtctagagatagaattcggattacttgggaacccaaaaacttgttcgaactttggtcgccatcttgtatagaattcttagtttattttatatttatatttggatcaagggttaggcaaggggtaatataaaagtcgtgttcctattcagcgaccccgaaaaccctaaattagactccttttccgggtttttatgagctttttcgagttttggacatttcgtgttttttacccttatggacatttcgaggcttggacatttcgtggcttggacatttcgttggtcagcgtttccgaaagataaatccaatttcaaaaatttgaactttcgattttctgttcgaattcgggtccgggtttaggaattggtcgaaatggatgtcatatttgtaataaacggcccgaaaacccccgaggacaacgtagaatcgtaaaaaaccgcctttttattccttttttgggaccagtaaaagtcagtattaccgtccatttttctattgggttcaattccccattaggataggaaattttcattggtaattgccgaacacggtatcaactcaaaaaagtgaagaccgattttcgaacaaaattgaagcccaatgagtataaaataattatttataaattcattactttaaaaaattacaaatatttttttgacccgtgataattgaaaaaggtagaacaaatgaatagaggataagttcagtcggtaactcccgttctaaaatttctttttttctaatcaaatgcttttttcgaagggtatttgaaacaattaaaaagtcgatttgtcaagtttatgcaccaatccaccaaaaagtttgaataaaaaattgattaaaaaaacatc

SEQ ID NO: 45232 - DNA, 1091 bp, Heterodera glycines
  misc_feature (44)..(44): n is a, c, g, or t
  misc_feature (62)..(62): n is a, c, g, or t
agtcttttaaaaaggtactttaagttgagcttcctctaaaattntcagcatagcattatganatacttaattaattacaattattaccaatagcacatcatatggcgaagagcggtccgtacaccgagagataaaatcagacttatattgagttcggttcgagaatgggtcagttattcctgaatatgaactctgaatgccattcaatgggcgcgtgacactctgaaaattcggttttaaaaaaatttattttgggttctttatgaaatcatacagtatatttgtatagttctaactgttatttttattattagtcgctccaacatatgcacaaaaaattgctaaacacgctcaataaaagtaaaaatatgcatataaattttaaaaattgaaaataaaatccaaaataagccaaaattattaattttgattataattaattaaaaatctaaaattccttttttaaattttttgaaaaattttgtacttataggtgagccgtgttcacagtggattttagaaaaaatgctattcgtcatattttttagattaaatataaaataaataaaattaaaacaacaacccacagcataataatcggtttctgttaaaaaaaatttaagctcgttcgtttgatgctcaacgtgtcttgacaatgctgcgaattttgcttctacaaaatgatgcagtttttgaatcgccttgaattcctcggattctggctaaaataatgaaattaattaatttttatattccgattaataatcccggtgttatatcgttcttttttcttactttgaaggctaagtcagccccggccgcaatcaaactgccaatttgggaggcgactcgaacgaaagtgatggcatgcttactgacatggcggagctttgaaatgatgtcccaagttgaagaagttagcgcgaaaatttcatcagctaacttttggacatcttcagtgtctaaaaaataaattactaattgttatttaaattacgcgcataaactggaatagagccatttaaactacatgctataaaatcctctatttataaatttgtttgttgtacagtctaatatgagttttagta

SEQ ID NO: 45233 - DNA, 947 bp, Heterodera glycines
tttccattttgaattgaaaaagcaaaaatcaatgactgtttgaaattattcccccaaatcaccctaaaccaatccaattaatctttataaactctaatcatagaaatatttttcgagatttcgggggattaattccttttttgaatttaattttataattttcgtttcctaatcatttttttcgaactctgaatgactcgaggagtgtttggcataatcattgaaaatttttgtttatatttcgtccatattcaattttgttgattttaggttagatttagtaaaataaatgtcatttttgcaaaaattctcaaatatttgttattaaggaatttttcaataaaaagtacagcccggacttttctttataagcacagtttgcgttcgtgcaaaagaacacttcaacaaataaaagaataaattaaaaaagcgattttaaaggcgaaaatcgcaacggaaaaaattaattaaaaatcaaaataagagagaaaggtttacaagaacaaaggccattttggaaaacaaacaaaatgaacaatttaaatatgttttgtttttaaagtaaacattttacaatattaataggaaatggaggaaaagaaaggaagacgagggaatggaagtgaattggcattccctggggggggggggggtccaagccaagggtttgcttctgtcgtgcatcgaatctcccgacccgtgcattttctttgaacctaaaattctctacaggcaagaattatgcaaaaaaaaagttattcattactggaaattttacagaaatgccgttgaagaagtgccgatcgacaaatatttgctgccgcttggcaaggctgaggttgtcaaactgggtcagtgcattttaagtacaattagacgtaaattacgaggcaaataatccttaatttagggactgacgtcactttggttgggtggggccctcaatt

SEQ ID NO: 45234 - DNA, 880 bp, Heterodera glycines
ggcgcatcgtttcggggatactgcccctaaaacaaaaaaatggattttttcaagtgtccgtttggggtactcaaacaattatggggagaaaaatccaacgcagaattaaagtacaggctatagggaagctattcccgaaggattcggtctccccataaatctgggcgcatcggttcggggggactgccccgaaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacatactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcagggaaaacaaaaaaatcgattttttcaagtgtccgt

SEQ ID NO: 45235 - DNA, 1399 bp, Heterodera glycines
  misc_feature (684)..(684): n is a, c, g, or t
ggtgccttattttatgcctttttcagcattttgtaggaaaaaatagaaaattttaaaattttttgcaatttttcttatcatatttcactgcaatttccaaaaaaatttttcccagcggcgcctattcaccgccggacccctagttatatcttggttttttaaatttgaataccaaaacagcaaaaatttattcctttttttgctccgccggtgttgaaattgttgacataacaaggagaaaaaaacattaggcccgaagaacaaaaaaaaggtctcttggatttctgctgccttttccaaattttcgtgccttttttgacgtttttgttcattttttatgccgtttcttcccatagtactctctatttaaattattttctctaccctccttcatatgactgggactgaaagtcagcagcactctctcacttttgagttattctcttctccaactgaatttattactagagaacgaaaaaaagcaccaaaaatctcgaaaaaggcactataataggcaccaaaaaattgaaacaaaggcattaaaaggcacataatcccaaaaaaggcatgaaaaaaggcatttaaaattttggagaattttgaaaattcatagaaatatcttgttaaaaataaaaatttttttgaaaatttactttcaaaaatcaaccaaaaaataatttttanattactaaaatgtgattctaagcctattagatcatttttatgcattttgtatctattgcatcctttacgaagaatttttccaaaaaaataatcatatttacatatttggtgcatattttgtccactttttgtaaatattttacagccctatttattagcgcgcgcaatattttatctttcttttggcattaaatggcattttttctctttaataaaagaaaaaaagaattatggtgtttttgtttgtattttaagactagatcacttttaaataatgacaatcttataatcatcaaaattcaactaaatataacttcttttgtaacgtttttcctataccattcaaaattaattcagtagagaattttttgctttaggaattgcaataattatagtagcagctcccttttttaattttttgtttgatatattgtttcctgtgggcttgtttttttttgaaaatttccccgattttctgtgtattttaggttgtaccgtcgctttgaaggaatgatctgatcaatttgttgtaaaagatgtgaacaaaatttgaaaaactttgaatactactagagcacagtctatttttctataaattaatttctttttcaattttctttttatattataatttcaatacataatttaatgttgcattccgtttttataattcaaatattttttcatttgtgcgtcaaataatttctttgggaat

SEQ ID NO: 45236 - DNA, 985 bp, Heterodera glycines
  misc_feature (963)..(963): n is a, c, g, or t
ggctaattcgttcgccgtttgttgggcacagaccactcactccctcactgatcatttatgcttttggaggttgatagaaaatccctgctgctgcttctgctgttcattttacgtctttttcctccgatggttcgctgttacgacggcggacatttgcgggaagcggggggggggggggtaattagggcaatcggtccgacgagctggcggcagccgaagcggcggcatggcccataaatatggcccgttgggatggttgttgctaaacgcactgccaaaagagggggagagagagagtgagaggaaatcataattcattccccgaagcgactcgaaaacattgcatccgcttattttttatggaaaacaccaaacaaatttgtccgatcggattgtcattcataaaatcccaccccttttttgtcggctgatcaaaaataaattccgccctttccccgccttcccaatgtgtgctttgcaaacagaacaaagtgcttttgcttgcttctcctcctcctccgcatattaatcaccagcagaatggcaattgcttctgctgttggtcacagtgcgcgaaacgaatttaagcgccaatcgccgggggatgggccgacatttgcccaaatcagtttcaattcatccaaattcatccacaattcttaggtccgctgatcattcagcgaccgaaaacattttccatagcaactgtgtactgaaatgtgatcagtaataattattgtccctttagaacctccctcccccaatgataactgatcaccgccgctcttcgccgggcaccgacgtggacgacacgtcggcacgggtggccatttatttggctttaaccatctcaactctgatggtcggcatcagtgcaatggtattgacctttttgcacaacgacacggcactgctgctggacgaagtgtcggtcggcatggacgaattcactgtatgtaaggngggggggggggggggggggggg

SEQ ID NO: 45237 - DNA, 1679 bp, Heterodera glycines
  misc_feature (216)..(216): n is a, c, g, or t
tttgctcgttaggttattgaactaaaatgggttttatgtaaccatgaatagaacctttattttaattttaaagattcgacagagtttttgacaattcaaaattacaatttagcagttaaatatgttttttagcttacgtatttcctataagctcactgattctttaaacaactgactaattgttgcaaatttggccactgttgttacttggcaacncattctaatgaaaatctatgagtttgtactctagtaaatccatgcaataaaatttattaaatattatcattttcctgttttttcattaaaaacaggaagaaaatcactcaaattccgccaaaaaggattagtgtgacctagcaaataaacggaccgggtcgactgggcgccgccgactgggcgacgccaactgggcgacgccgactgggcgccaatcaactgggcgccagccaactgggtgccgccgactggacgccaatccccctttccctcactacgattaaatttataaacccgaaataaaaattaattattacatttcgtttaattcttgtttaatgcattctatttactttttgatgtacagtcatggtcatatgtttaggaacacctcttttttttgaataaattctttgaaaatattgcttctctggattgaaagaaaaataatcaataatctttttaatgcattttgtagcattttttctgggctatccattggtaccacacattcctcgtttgctttattcctttttgtaaaaatttgtgttttcttccatatagtcaaatttcggggtggtcatatgtttaggaacactacccatatttttttcatagcattaaaaaaatccaaaaaaaatcaggtaagaataactttgggtgctgatcaaaaaaggtagcaacaccaagttgatcagatgcggttttttgaatattgtagcaaattttgtgctctataaaatgggcctactcaaaatttccagaaaaagttttgcacggaacgaaaacgaaactgaaaactttttgctagccgattctggtggtacatttttgttgaatgaaaatggacccccgcaacggtaggcaatgcgttttgttcgattcactattactttttttgttaggattttgattttcgggcgcatgtctcataatagctgggccaatcaaatgacagaatgttacgctgacggaacattttcattaagcccaccactatttagaattttaattttaatgcctcttcgaagatttttgtgtatttaaaacctattttgcgattttttgtgcctaagaaagggaatttggaagtgggtcttggcgcccagttggcggcgcccagttgagctggcgcccagttggcgtcgcccagtcggcggcgcccagtcgacccccaccgcaaataaatatgctttttgattacaatttgccattgtttcttggcaatgcacgcacttccaaagtctcggtccctgctaattgtttggccgaatacaataataatataaaaaggaaaagagaaatactgtaaagaaacaaaaaaggtccaataaatttacaattgcgtgatttcataaagatatctacaattttgaaaaatatgtagttgccaaactgaaaatctttctatgacattataacaaatgttattaagtgagctaaagttatgattttttattcag

SEQ ID NO: 45238 - DNA, 1167 bp, Heterodera glycines
  misc_feature (36)..(37): n is a, c, g, or t
gcgcagggtggccagcagacttattgtagagcttannaaagcccaattttcccagattttaaaatttcgaaatttttcaaaatttttcgagctaggcctaaaaaacggttttcgggtttttgaattttaggattttttaacgaattttcccagaaaaacggagaccacttccaaaacatagtttttcgagctctatcgactggtatttttttcggaaaaatttcgattttttcccggaaatagaaaaaatttttggcctcagcgggacatttgagtcctgggcccataactcgtcaggggttgattttagcgaaaaattgtcttagaacatttttgtagagcattttaaatgctatcgaatggtgtactacatgatgtaaaattttcaaaaattttcgagctaggccccctagaaattttcaaaaatttttttggggtcgaaaaagtgtgtgaaaaatatttttctggggtattttgaggtgctgagtacgaatatgatgtctattttaagtttcataatttttggaattttttagaaattcgaaaatatttttaatttttttggtccttggaaatttgggttaaattttgaaaattcataactcaatgaaggactggtcaatttaagtgaattaaagctttaaaaatagcaaaaaatcgggagaattttatgagatttatttgaaatttataccacaaaaacaaaaaaagttattccagaaattctggaaattttcgatttttcagaaaaagtacctcttcaaatcaccgttgtacctcttctaatcaccattgtatctcttctaatcaccattgtacctcttctaatcaccattgtacctcttctaatcaccattgtacctcttctaatcactgttgtacctcttctaatcaccattgtacctcttctaatcaccattgtacctcttctaatcaccattgtacctcttctaatcaccattgtacctcttctaatcaccattgtacctcttctaatcaccattgtacctcttctaatcaccgttgtacctcttctaatcaccattgtacctcttctaatcaccattgtacctcttctaatcaccattgtacctcttctaatcaccattgtacctcttctaatcaccattgtacctcttctaatcaccattgtacctcttctaatca

SEQ ID NO: 45239 - DNA, 701 bp, Heterodera glycines
aaaaattatcatggttttttatcttaaaaaattttgcatacaaaagggtcctccccccttttgtttcaaaaactgtcactttccatatagtgccatgttttttgtttctgcttattttcaggcgggaaaattttttttaatttgaaagctatttgttaacagatgattaaattttaatgctttttgggcgaatttttgaccaaattaaaaaacagaaagagaggttccggcggcgccgataggcgcctgaaaatatgtgtcaaaaaagcggataattctagccatactgatcagaatccaagctcagatattatgccatttttattcccttccattgttaatacgaataatacggcgtttaatcggattaacgacaaatcagcaaatgttcgccaaaaattggatatgatggaaacagcgcttgtgcacctaacgactaacaaatgtcagcttaatttcagtgccgaaaaggtcagtgtttggccaatgctaaagaattgttgtaactaatttaattttttttttgggctcaaaatccgttttctgggaggcttgtcactaatctgaactcggtttaccctattttcaaccccctgatccgaattcgaacaaaaagtcgaattttttagttttaattattaaccgagaagtatatgcaatttcccaaatgttattgaacatgtcaaatgtttttccatgaa

SEQ ID NO: 45240 - DNA, 1042 bp, Heterodera glycines
  misc_feature (81)..(81): n is a, c, g, or t
aattaaaaaaatatttcatttaaacttataaaatttattcattaaaaaaaattatttaaatataattttttatttattacntcaaaaaatatttaaatgaataaaaattgaaaaacacgaaaaaaatggtagaaaaataatgtacaccgcccggcttcgaacttcgccccccccccctcaaaatgatgcctcagaatccccaatcacacagggattctgaggccttaacgatgtcaaaagtaaaatctgatcacgtattcgtgatcagcgtcataaaatagccctaatgacatgtttttgaaagatttttggttaaaaaaatttttcactcaaaaatcctggtcacccccctttggacccgaagcacaaaatcacttttatttttatatctttttttaaagaagtgataaaaataccaaataaattttataaaatagagcaaaaaattgcggatttttatattattttacttttccaaaatatcttttcagaaccgagttatgaattttttactgaaaattcgaatttttccagaacttctggaataactttttttagtttcatgatagaaaatctaaataaaacccataaaattctcctgattttttgctatttttaaagctttgttgtatgaaaattgacttaccctgaggttagttatgaattttcaaaatttaccccaaaatcccgagggtcaaaaaaaatgaaaaaaatttcgaatttttaaaaaattctaaaaattatgaaacgaaaaacaaaggtcatattcgtaatcagcatttcaaaataccacagaaaaaaatttttcacccccattttcaacccaaaaaaaattttcaaaaatttctagggggcctagctcgaaaatttttgaaaattttcgaacatgtagtacaccattcgatagcattttaaaagctctacaattttgctctaaggcaattttttggctagaaccaacccccgacgagttatggggccgggactcaaatgtcccgcttagggcaaaaaattttctatttcctggaaaaatcgaaaattt

SEQ ID NO: 45241 - DNA, 937 bp, Heterodera glycines
agaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaatataagcctaaaatttttcgcaaatttaaaaaggaattaaaaatttttaaaatatttattcatctccctttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaa

SEQ ID NO: 45242 - DNA, 1293 bp, Heterodera glycines
agcgagttggcaaagaaccaacggcccccagccgccggagcgggccattgttgaaatcgtgcaggagcgagtcggtgataaaaattcaccaacatctgaaaggcttgcgctgtcgaagcgagggacaagttacgccggccggaaaaggttttttgacgggcataaaaatttttaagacaatctttttgaaaaatctaaaaaactaacggttttaattaatttgaatctccgatttattccgagaattatccaagaaacgagactgagactcgcaaaacccgacactgaaaaccgagcatctcgacaagcattaagatatctctccattaataggaaagtcaaactcggagacgtcttccattccgttccacgaagctcttgaacgtttcggcggtgacgtgtcgaaatcaaagtctttcgctcaaaagcgtaaagaggtttctaagtcatataattaaataaaaaaggttttttggatattgtaatgcaatcaattcttgaaatatttggctatttgacattcattttcatgaaaattttttgatgctgggtgggttaaaggcccaaccgttcgctatttgccaattcccccttctctcatgcgcagaagcagcaccaggggacgacagtgcccgagatggtccaccacggccagcagttggcagaattggcgcaatctacgagccaactggcaacggaaaaagaattggacgttgaacaggacaacaaatcgctcaagcatgggccgggcagtggaagtcaccacagcccttcttgaattccatcgttttcgccacgtgatgagtcattggcatgaattttcgctttaaattttaaacttaatctgcctattttaatttcgttcttattttttattctcattttttgcttcgcttacgttttgctttgtgtcttatggataaacttaattctttttggtgccaatttttcatccacctgctttcagtcacaaagggtggcaatattttttacccaattaccgcatttccgtaattaatttgctagactaaaacaaatttagatcgaaaaaatattttttagtcacttaaatccttgatccgtgggtgttcccaaattttaagtctgtccttcaaaaaacacaaaatgaaattattgtaaaagcaaaattaaattttccaaccatggaaatggatgttcacggcaagtctcagaaccaaagaatgtgggattttgacctgtattttctggacaaaaatccgggacaagcaaacctggtttatcccatggctcattctgagaatatgtagctga

SEQ ID NO: 45243 - DNA, 885 bp, Heterodera glycines
ctctttttctgctcaacagtaataggaattccaaccgcattctcagaataattacgccgatactaattgttctggaatttgtttctctgcgcgtttgtttgggaaaaatttggaaaattggatatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaaattgtttctcggcgcgtttgtttgggaaaaatttggaaaattggctatctctttttct

SEQ ID NO: 45244 - DNA, 1446 bp, Heterodera glycines
  misc_feature (81)..(81): n is a, c, g, or t
aaattagttttgctattagcatagtttcttggctctcagttgactggcgctcaatttgaaaaacaataaatagtcacacanctctgtttcacagcagtttggactcaaactcaattatatgaaatcgacattttacaaatagatactttccgtgttcaattttcgtaatttgtacgatttaccaaaatataaataattaacattaagagattttttaaactgcatttaaatcgttttaagaatcatgaacatagaagaattaaattttattattattattttctttaaaattttaaattgcatttgttgttttttatgttttaaaatgttgtattgactagagctaagaaacaaaagaagaaattttttgctcgtgtgaaaatatattctttattttaaaatatgttttaattgattctttctttattgcttcaagtaattttatttcaaatttctcctggcaaggataccttgtgttttcaatgggcaagactaaatgaaatgggtgagcatcaaaactacgcaatttaattatttagataatgaataaaattgaataactttcatgtataatttagaaaggattggttttttaattaattttaggaactaacagcgctaattcctttatcgtatcatcattgtggtttaaaatctacaaaaattcaactatttaaaaaaaatataagacctgacgatctttccctacatgaacaagaagaaatgagtttaaatagcaatgggggaactttaaatgaataattattaaaaaaatttttaaacaaaaatagatacatagaaagaattactaattaaaacaaagcacccaaaacatgtggttaaatttttaaatttttaaacgataaatggaactgaatttattataaaaattatgattgaaatgtaaaatgaaaattaaataaataagaaattttaattaaaatctcaaaataaacaacaacaaaaaaatgtctagcatttgtcgtcagcataaatataaaatttatcttgttatttatttattatcgaactaacaccaagtgaaaaatatttttaattttatatactataccaaaatataatatcgagaaaattagagtaaaaaaataacaagcattttgaaatcaaaatttttttaatgagttcaagcgatatgtaactacaataatttatagacactttagcttaaaatgtatttttcctgaatatatagagttaaactgctttgtactacatatcttataatttcattttccattgtgccatcatggtactgcataatctagtaaactgggcattattcaacataacgattgtgagggtatgatttttcaaacatggttaaaaacacttttaatataatcggacaaaaagccgaaacctggcaaattagatttggattgggacattttttactaataaaattttttaacatgattaacaact

SEQ ID NO: 45245 - DNA, 1211 bp, Heterodera glycines
aataacattcacggtgcgaaaaatggggtttgacaagtttatttggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaagactttaacaaataatacccctgggagaagggagtgggaaacatgatttcaaaattttcaattttttttctagtctaatctactcaaaacgggttcagaattccataaaaaaaacattccccggggcaaaaaagggggtttgaaaagtttattgggaaaaaaaattttacaaaaaaaaaccccccgggaaaagggaggggaaaaatgatttcaaaaattttaattttttttaacctaaaccactccaaaagggttcaaaattaaaaaaaaaaaaatttcccggggggaaaaaaggggtttgaaaaaatttttttggggaaaaaaaaaattaaaaaaaaaccccggggaaaaggagggggaaaaatgatttcaaatttttaattttttttaatttaaacttccccaaaagggttcaaaattacaaaaaaaaaaaaatttcccggggggaaaaaaagggggggtttgtaaaatttttttgggggaaaaaaaaaaaatttttataaaaaaaaaaaaccccc

SEQ ID NO: 45246 - DNA, 769 bp, Heterodera glycines
tctagagtcttatctgaacaatgaaaataattcaaaaataaatgcgaaatatgtgccgtcggagttggcacgcacaatataaaacaaaaactcgcctcgttggtgccttcgatgatttggtggactcggcagtcgcgcaggtattgctgcagggcgtagtccttgagaatgccgtagccgccgaacatttgcagcgcttggttaatcaccttataagcagaaaatttaggttggcaaattgggggattcaaatcatttaaaaatgccatttcccaaatgtggcacaaaattccggaaaaatagttggaaaatgcgttcttttcacgtcatatcacacaatagaatgaacccaccgtgaatgcctcgtcagttatgtacattttggccatggcgctcatcgccgatgcgttcggagtgtcctcctgcaaatggtggcacgcctcgcgcagcaaaagtcgcgaggtgaccagctgaaaatggcattttgaatcgagacaaaatttgaattaaaaaaacactgaaccctctagaaaaagcgtttgaagtttaatggatttgaatgaatgacccaatttaatggaaagtgccgaccgacctttgtggccatttcggccaatttgaactgtgtccattggaattgggagatggacttgccaaacgcttgacggacctgaaaattggaaaatattttcccgacaattgctctgtccatttccaagtcggtgtcaccaacttttgtgtgttcgatggccaagtccatgctcatctg

SEQ ID NO: 45247 - DNA, 837 bp, Heterodera glycines
cgtggcaattgggtctttggcaccgatgaagttcagctgaatagtttgagtggctgcgacattggcattgataacactgtaaaaatttaaaaaaatatatatatatataagaaaaaagattattttaaaccaaaaattcattaaaaatttataaaaatattttaaaaattaaaaaaaaatatgtaattttctagtaaaaattagattatgttttacataaacagaaaattagtgttatatacatcatccatatcccgaataaaaacatttaaaatataaaaaaaatcatattttaaataaagtcaattgaaaacgcattatttttagcaataaaaaataaaattaaaattaatttttcaatttgtctttatataaattaaattaaaaaagaagaaaaacattattttgaacccaaaaaattaatttaaaaatgcattaaattttttctaaaaaaagttcattttaccaaaaattttaatgtttgcatttaaaataaatatgtagatattttaaaattaagaaatgaaaaattttaagcaagagatttataaagggattttaaataaaaagaaatattttaatttattgtttttttcgcggcattttagcattttttaagaaactttcattttaaacctaatattgaaaattgggaatatttttgaaaaatataaattatataaatacgaaaattatatatgcattaaatcctcatttcgaattttagcattatctctttctttttataattgtaatattttatgccccgagtggacaatggcatcagattttggcacaattttgccggaagaaattgctaaaaataaattttcaaaa

SEQ ID NO: 45248 - DNA, 1154 bp, Heterodera glycines
  misc_feature (233)..(233): n is a, c, g, or t
  misc_feature (240)..(240): n is a, c, g, or t
  misc_feature (245)..(245): n is a, c, g, or t
  misc_feature (247)..(247): n is a, c, g, or t
  misc_feature (254)..(256): n is a, c, g, or t
  misc_feature (269)..(269): n is a, c, g, or t
  misc_feature (291)..(291): n is a, c, g, or t
  misc_feature (300)..(300): n is a, c, g, or t
  misc_feature (307)..(307): n is a, c, g, or t
  misc_feature (337)..(337): n is a, c, g, or t
ttttttttttttttgttttggggggggcccgggggggcccccaaaagaggggtttttaaaaaaacccccccccccgttcgcttttgttttttttttttttttccccccccccccccgagggcgccccctttttttttttttttttgtgggggggggggggggggggggggggggggggggcccccccccccccccccccccggggggggccgggatgatacttcggtgcaganaattatnaaatntnaaaattnnntaattgcttttanaatatgccaaaaaatgtaggcnttacttttntagtganaattcgatcactcatattttttgctaatgnagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcaatttttttgttttcggggcagtccccccgaaagaggcgcccagatttatggggagaccgaatccttc

SEQ ID NO: 45249 - DNA, 1008 bp, Heterodera glycines
aattgggagaagcatggggctgtagctgaggacccaaaatggggccccattgggggaattaaacatgatttctgaaaagtccctgaaatgtcgattttttctttctatagcttcttgtagagctcgagctgctctttccaatggtcttatcccggtctcgatccgtgcagaactcaaaaagttatgaagtgaaatgtgaaatatgtttgcaccacaagggattttttctgaaacccatcggaaccaaaaatctagggtttggtataagcgttttagaaattgcggagaaaaaagcttcgatattgagaaaccaagtcaagtccagaaaagaatagcttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaaatttataatagaattttttattattaattcgaaatctttaatttatttgacaaatccaagacttaaaattgggagaagcatggggctgtagctgaggacccaaaatggggccccattggggaattaaacatgatttctgaaaagtccctgaaatgtcgattttttctttctatagcttcttgtagagctcgagctgctctttccaatgatcttatcccggtctcgatccgtgcagaactcaaaaagttatgaagtgaaatgtgaaatattgttttcgccacaattgggagaagcatggggctgtagctgaggacccaaaatggggccccattggggaattaaacatgatttctgaaaagtccctgaaatgtcgattttttctttctatagcttcttgtagagctcgagctgctctttccaatggtcttatcccggtctcgatccgtgcagaactcaaaaagttatgaagtgaaatgtgaaatatgttgcaccacaagggatttt

SEQ ID NO: 45250 - DNA, 942 bp, Heterodera glycines
  misc_feature (4)..(4): n is a, c, g, or t
tttncggggcagtccccctgaaccgatgcgcccagatttatgtgggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgtttttcggggcagtccccccgaaccgatgcgcccagatttatggggagaccgaatccttccggaatagcttccctatagcctgtactttaatttctgcgttggatttttgctccccata

SEQ ID NO: 45251 - DNA, 175 bp, Heterodera glycines
ctctcagtctgccgttcgcgggcctcttagcagcggcgcttttttcagcgtcgaaaccctacatagccctctttgccttgatgttcagttattttgaggtactgttcttcgacccatggttcagggcacaattgaagaccgccgcgaagctacaagaggaattcgattgcaactt

SEQ ID NO: 45252 - DNA, 744 bp, Heterodera glycines
  misc_feature (18)..(19): n is a, c, g, or t
ccgcaaataggtccgatnntttcccttgggccgcaaatgtccgaaaatggcccttaagaaacgggccgcaaatgtccggaccgcaaaagtccgaccgcatttgtcgggccgcaaatgtccgatttccagcaagccgcaaatgtccggaccgcaaatgtcttaacacggggtaagcgtcggaataaaatgttgcaaaaaaaaggcgtgggttcaagcccacttgactgcgcacaaatttattattttcaccgtttctccctcctcttgctcctcccgttcgtactgggccacctcatttgcttcgtcatcatcatccccgttttgttcagcgatgagttccgggttgaacgtgaagaggtctcggccagagaggccagcctagcgggaaaaaattagaatattaaaaaaaaaaaattaaaaaacagtaaaaaccataaagcacagatgaaataatcatttcaaagtttttttttctgtgttcttctattggctataccctagcgccccatctggaaaattctttagaaattcacccaggatttcggcttggaggaggggggggggagggtggatatcgcatccgaccgaatttatttatttataattttttgctttttatgccatttgttacggcccggttttaaagtggacaaagaacgtaaatcacaggacaaataatattttttaaacatttataatacagaaagactgcattatttttttaagaaattcatttttttttta

SEQ ID NO: 45253 - DNA, 324 bp, Heterodera glycines
aaaaaaaaaaaaaaaaaaaaaaaaaaaattttttttttttttttttgtttgtggtgggcggggggagaaaaaaaaaaaaaaaaaggggattgggggtgggtggtaaaaaaaaaaaaaaccccccccccccccccctcttttttacgaaaagaagagggtgaaaaaaacccacaaaaaaataatatttagaattaatgtctttgtagcataggcacacagattttttgaaggggggggaccccccccccccccccctcttttttttttttttttttttattttttttgccccccccccccccaaaagaaaaaaaaaaaaaaaaaa

SEQ ID NO: 45254 - DNA, 1244 bp, Heterodera glycines
caatgaaattgtttctgatttccctgattgtgcttggcattctgctgaccaatttggaggcatttcgccaacaaactgttggcatcagaggccgtctgatgtgtggcaatcagccgttgaaggacgcgaacgtgaaattgtggaacaaaaacacgctcggtacaataaacagagattaatagtaattatttgggacggaaattcatgtaagaaaaattgcaaaatatttccaaaaaaaaaaaatgccgaattatgtatggaaaatgggtacaaaaaatcatcaaatattaattaaaatatgtaaatataattttattatggtgttttggattaaattcttagaaaagcatgaaatagggcacaaaatgccgcaaaaaaaagaaactaaggcttagaagaataatattttttgctttttaaacattcgttttggtgtaaatttttatgaaaaaagaggtggttttttaaatatttttcaaaaaatgcttttaaccttttctaattagtattatgtacattaaaatttttgaaattttgtgtccggtaccagcaggactattccccctccccatgtcacagaataggcatttaagttttttaaatttttcaataaatttttcaggttccgatgaccaactggcggctaacaggacagacaatcatggcaattatgagttgcaaggaggcgttggacagctcaccaagatgaatgtgcatttcaaggtgtaccatgactgtgacgacggaatcaaggtggaagaaattaaaatttaaattaagaaaaaaatctgtaaatttttaaatttttagccatgccagcgcaaagtgaattttggtaagttaaatttggaaaaaaaaagttaaatttaaattaaaataaattgtatttttgtacaagttaaatttaaattaaaataaattgtatttttgtacaatctaatttttactaatagaatttaaaatgatataaaattatttcttctaggccgaaaattttcggtttttcagccctcattttatataaaaattgcattaaaaaaattcattggccaaaaaaataaattttttatttttttttctgcaatttaaaatacgttccatagaaaactggccaaactaaattcggcattttgctattttttcaggcgttccggatcattacgttgaacgctcagggtccaccaagaaatggtttgaggctggcacaatgaacatggtaaaaaaaaatttggaattttcatttt

SEQ ID NO: 45255 - DNA, 905 bp, Heterodera glycines
  misc_feature (129)..(129): n is a, c, g, or t
  misc_feature (161)..(161): n is a, c, g, or t
ttttatgcaatgcctaaatttctgcgcacttataagctcagatggtttggggagtctattatgacttttataatgactaattttgcctatttcggggggttttacttaatgtatcgttttttgagaaanaatccttaacaaaatacattaaatttaactanaattagttttttaattaagtttttatgggtttggctacctaaaaggcgttaatgcaaattttatttgcctattcgaggatttttgtgcatatttaatgcctatttgcgattttttctgcctttttaggtgcctatgtcgcggtgagtttttgtgccaaaaaaggaagccctattaataaaatatgctaaacggtgtttccaagaatatttcaaaacataaagtgtgtttgattggatttatccttataagaacaataaaaacaacaacaataatataaatattgttattatgcttttaaataatgtaagaaaagaatattcatgtgtattcttatatttggttgctttatggtgcaactttcttgaatgcacttagatcattaattctaaaattaaatgagaaaatttatcttatttaatcatcaaagttttgatttaatatagaaaaaccatcttaatttatttaactttgaaatattttatttatataaaataagaattattttataaaaccaaaaattactttttgttaatattttctgcatctgtaaataatgactccataagggtagtatttaaaatttcatttgaattcatatttcttcgataaatagccggcaattcattgataccattagttttttgcttgtcatttttcattgttagtccgaccacccaaaaagtgcaataactgacataactaaaaacagtttgaaattgcattaataaaaataaaattctacc

SEQ ID NO: 45256 - DNA, 1318 bp, Heterodera glycines
aaaattccaaatttaacatttttaaatgcagaatttaagctatttggcccaaatgatagagaaggaagtaattggttgtgaattgttttccattctctttaaaattgtttaaatatgcctttttgggcatgaaaattccaaaaatttaattgaccgaaagaccaaaaaattcaaatgcctaaaaagcgttgaaaccaaaaaatataaaaaattccttttgtgatttaaaaattttaattaagcgaatcgccaaatgtaaaaacgcaaaatttcataaaatttttctaaggtttaattttaaaaaatcaactctaagagattaaattttccgaatttaaataccaaaatttcgaattgtactcactttgcatccctcgcaagagaaaatgccgtagtgaaagccgctggctttgtccgagcacactttgcacaacagcacctcctcattgttgttggctgagctgctggtgcgcgaaattgaagtgccatccgacgacaagggacctgcagaaatttttggcattttttgagttaaaactaagcgaattctcaaaaatctaatcttaaagccaaattaacccctaattactgaataggatactgtagctttgtgttctgtagctttttaagggtagtgacagctaatcagaagcgatttattcagtttttgaacagtttaaacgcaataaaatcttaaaattaattaccctgataccgtaacatcattttacttaatgagattaacgtaaatgccgtttcctatggcagttcatttaaaaagatcaatgatcgtttttatgaaataaatacagtaatggcggcattctctggtcattatttcgtcactcccttcatattgaaaagataaatccaaggtcaaattcacaaattccttatagaatcattcgtatattccaagcaattcatttccgaaatttaaaactttccgcgcaacattttttggcaatttttgaattggattttactgaaacccatttgtcttttaatttcatgttaattttgcaccttctccgtatctttttgcatgttatataatgcttctttgcctgttgagcatttattatttttcacgtaaatttttaaatggcacaatgtttggcattatgtcttttatgctttccattttttaaaattttctaattattttcaattatccctcgttttgttgtttaatttgtcaaatgccctcctctcccctcctccgctgctttttgcccatttttggctttttcagggtcatcccccgaggggtcagggcaagcaatcgccgacgcattcacaacacacaaataaatgt

SEQ ID NO: 45257 - DNA, 1207 bp, Heterodera glycines
  misc_feature (1142)..(1142): n is a, c, g, or t
attgatgcgaacatagaagatgtatataaataaaatatcatttacagcgcggtgtaatttcaaatttaattaataatttattgtaaaataacaattttatcgttaaaaaattaattttatttatgtaaatgctttgctattattgaaaaaatagaatttaaataattctgctgaaatttaaaaattaaaaccaattaaaatttatttattggaatttatataattatgattatatttatttacaaacgattgaaatttatttattctttatcgattctacttgccttgtataaaattatatgatcaaatagaattaaatttataaaacatttatctaagaataattgctgcaataccatggagaattgcaacattatttaaacgaataatacgcatttagttgagcttcggcacaaaagcaatctgccatatcggctcagccatttcaaaccaacgaacatgcctgttttcgtatgcacagaaaaaatttgtgcgaaacttggaacagaaagtttctaaaatttagaaaaaacaaaaatatatgggatttgattttaaaacttacaacaaatataatgagaatattgtacaaagtgcggacgacattgtcttgaaatatgatgagaagacttgactttggttaaacaaatgaatcggtccaaggaaaaagaagagtcaaaaatcccaaaatatatacgaaatatggacaaataatataaagtcctaaaggagtatgctacttatgatgttatataaaatcttagaaccttatttgttaaatgaataacaatttaattaataaatttactaacaaaagaaaataaataaataaatttcaattgaaaaaagtagggttagacgggtccgggtcccggacccggtttttaaaaagaatatttaatttttattgtaaaagtaattcatttattgctcctgtggcctagtggatattatgttggattcatttggtatttctcaggtgtttaatttttttttgcaatatccccataagaaattttgaaaatttaaccctatatttcttgaaaatttgaacatttttggtagaaattctgtaaacatattggataaaaccacaaaatttggtcattttttaataaaatctgttaacaaatcgaagtaanatttcaaaaatttttcccggcggcgcctatcggcaccacgaaccaccccttctctcgaaaagttt

SEQ ID NO: 45258 - DNA, 801 bp, Heterodera glycines
ttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatgtaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccattccacagatattatgggcaggacacgccaagtacctcaaacttgggtaattaaaccgaagaaataagtgcagtggggaagaatgacgcccaaaatgaaggaaatattcgatgctgtgcgaactctttgtgacccctctctgactctgccaatgcagcagtttacaatttttaccactatttttctctcactcatcgtctgctcgtctctcctttattataggctatttttccaaagccaacaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattca

SEQ ID NO: 45259 - DNA, 696 bp, Heterodera glycines
  misc_feature (8)..(8): n is a, c, g, or t
  misc_feature (16)..(16): n is a, c, g, or t
  misc_feature (580)..(580): n is a, c, g, or t
  misc_feature (601)..(601): n is a, c, g, or t
  misc_feature (615)..(615): n is a, c, g, or t
  misc_feature (663)..(663): n is a, c, g, or t
aggtcccnttcgcacngggggaagaatgttaagcggtgggtgctggtgtggtgattggagatctcgcttcccaaccacgagataatcttgtcaagatcagtttagctcggaagttttctttttttcttaaagccttttgccaattagttaagcggctctaagattggcaattcaaaacaaaaaaaaatgtatgtgtacaaaattaatgccagactagaacagaagaaaatgaaaatcagaagaaaagctaagcgacccgggatttcatagctttatgaatgagaagccgactgagaaatgctactataaaatattaaaagtttctttttggaaatttaaaatgctagcatttaaaaaatttttaagtacgacatacttaatggcttttcaggatacaacattcattcaaagcgatagagaaatgatacgacctattcataaaatcctggactgcaacagtttgcgtggttaggtgagtaaaatgaaaacctgaaaaaattgttgaatttcaaaaaaagcaggtataaacttaaaatgccataaaaacaaaaaataataattaatcgattaattttgctanatacgatttttttttgcatancaatttaggtgctncattgcgcattattcattcataaaatggcataaattatggcaaattangcaaaaaataagatttaaaagtctattgccata

SEQ ID NO: 45260 - DNA, 1343 bp, Heterodera glycines
gaaatacttcgcaaaaaatttgatgaaaatttgaagggaatgcttaaaagggcgagggaattcgaaaaagcgaacaattggcaaaatggaaacaaaaaatactacagcataatttggaattcgcctttctatgacggagtttcaaaagtgagtgtttgatcaaaaccaaagctcaagatttgaaaagcccaaagaaatccccgagaccgagtcgagactctcgaccagcaacagctcaaggacagtcaattcttacttttctgcgtttttagatataggccattgtttttcctagggtagtgttccatggctcttatcttgtcaactccaacccagaaatttccgttcctaatgtcgtagaaccgatttttcactccagaatactgtagtgtcagtattcactgtccaaatgataggagaagcttctccagtgggaaaaacttattaaaaattcactaaagccgaaaaacagacagataaatgaaaaagaaaattcggcatcgttgtttctgtgtcgtgccaaattaggaaaccataaaaaacataattttaggtagaggacagagcatttgtcgcatttgtgaaagggcggtcaacttttgacactttttgcacggaatttgcggatgaattggcgaaaatttgctatgaaatgacagaagagcagcagcaacccacgtttgaccagcagaaagaatatttggcacaaaaatatgcggcacacattggcgttgtgtatttaatgcgagagaattggcactgtgccaaaataattgggagcgaattgggaagtgatgggcagcagaaagagtgccaaaaattacacaaatattttgacattttttacaaatatttgttttgtgtttatgctgaaggtaatttcaatagattaagccccaattttaatttagccgtagacatacatggttggctaataagcttttttaattttaaatggattgcctttttgggtttttaaataaaaatgtgctaaaatttgcttgaaattccgtggggtcttaagtatacataatttgactgttaattgttaacttccaatttaattggtaatttttagatgatgaccccataaatgccatatatggtcagcttatcatccgaaagattgaacagttcggaactttaatttatgtcataaaacagctgaaccaaatcgcgaagtttttttttgattccaaacgcaaaatggaaaatgcctttgaaaattcattgttttcgcggcaaaattttgaacaaatatttgaaacggagagcgaaacagaaacggaggaagaaggattaagcagcaaaaagcaatttgacttaaagctaaaggaattact

SEQ ID NO: 45261 - DNA, 1119 bp, Heterodera glycines
tagagttgagcgggaccgggaattttgggaaaaacccggaccgggacctgagaagccgggaccgggacctcgattttcgtccgggaccgggactaaccgggaatttttaaaaattcaaaaaatttttaaaaaattcaaattttaatttatttaaagtgaaaacaattattttgttttttttattttataaaattcaaaaattaaagctaaattaaatttatgaaaattttcaaatcgaatttgtttcaattattccatttttaatttctgtagagggattgaaccatgggaaaaaagtagaaaataaaaagattagccactaggccatttgtacaattggcagtgctttaaaaaatatattactcttattaattttttccttttaactccaattttcatcaatcagaccaccattatataccaggggtgggacaactctcgcctctcgtctctcgcctctcgccaactctcgccatttttggtactctcgcctctcgtctctcgcctctcgttttttgcgacgagaggcgagagttgaaaatacacccctaaagattgaacttttgagcagccagaaaaattttcaaatttacgcgaaaaaaaaatcttaaatctctttctttccttccttaatgttttctctatttttgtatagctccaattcaaatatggtctgctggctaagccttctgcctttcattatttttctcttgggttcaattccccaacggtatacagaatttttttaataatttctttaaactgcaaatttaaccaaaactttgatcattttttgacaagttctgttaatatattacactcaaaattttagaattttttcggcggcgcctaccggcaccgcccgaccccaactgtccccgaagttttaaaaaacgcaccgcaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactagaactctgacccggctttctgtacccggcaataccctgacccggtatttgcccaaaacccaggcccgtacccct

SEQ ID NO: 45262 - DNA, 903 bp, Heterodera glycines
  misc_feature (770)..(770): n is a, c, g, or t
  misc_feature (788)..(788): n is a, c, g, or t
  misc_feature (859)..(859): n is a, c, g, or t
tctttgtttgtcaaattttataaatttggcatcattcgaaagctctacatgtttagaagcttttgataaaatattgctaagcgattgaacaacttataaaaaagttgcaacatgaacactaccaaaaagtcagaatttttgcatattttaatttataacttttttatatgtcggtatgtatttgtgatttttggatagccgatagagcttgttaagagctttcgaatgataccaatattgttggatttggtcaacaaagaaaaaagttatggtggtctaaacttggctcagacgcaactggcccgctttcaggcccaacttccaacagaacttcactgcgtgtccaattggttgcaaagcattatcaatttcttcattggtatttcccgaaactatgagacgctgcctttgtttgttctggaattttattataatttttagctattttttaatcatcattttgataatttacaagcgtcagtttaaataacaataaatcacaagaatcaattccacgtcgtccctcacaaataattttaactcgttgaatgacgtggaccagaagtggtgcctgcagtgtttaaaattcaattcatgtaaaaaattatgtcccacaaatgactaattacttgctgaacgacgtacaccagacgcgctgcctgcaatttttaaaaatttaattaatgcaaataaattatagccctcaaataatttaattacttgttgaatgacgtcgaccagcagaagtgctgcctgtaatgttttaaaanttgacattaattttcatnaattccatagctctaaaatattcattgttgaaatacgtggtcagaagcagcagaagcgcctgcaattttanaatatgtttttgcaatcaatttatataaattgataataaaaaat

SEQ ID NO: 45263 - DNA, 473 bp, Heterodera glycines
cgcggacgacgcgcagtgccgccactggcgctgccccgttgacgccgcctcgtcagcgcatggtcaatgtaagttgggggcggtaaaatttgaggccataaaaatggcacttatacaggataggccccaaaaaaaaaaaaaatttatttgtaaaatttttaaatttaattaattgtttaattattaaatgaatttttacaaatgtcgcaggctcaattaaaatttttgtatttttttttattaaaattaattcagaaatttaatttaattattttattaaatttaatttatctcatttttaaacaatttacagctcgacgagtcgtcgaatcaggaggacgaggtgtttgttgaagctcatccgatgcaaccggtcactgctgacggtaagagcaaaagctcagaaaataaaattacgaattcacaatgaatgcattttttgagtcaaacataagtttatagacggatagtcc

SEQ ID NO: 45264 - DNA, 884 bp, Heterodera glycines
tttttggtcaagaatttttttttttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaatttttttttttgcgtttcaaatatcgtaagattgtttgatagggccagacaagagaaggcaactgttggcaccaaaggttgcggtaaaaaaatgagaaaaaagagatag

SEQ ID NO: 45265 - DNA, 1225 bp, Heterodera glycines
  misc_feature (29)..(29): n is a, c, g, or t
atctttttttgtcatttttcattattttnagaacatttttgggaaaaggagtgactatttacacgttttttacagcgcgattttttcaaaaactttttgggaacttggaggagggtacagcggtgccgataggcgccgccgggaaaatttcacaaattttgaatgaaatttgcgatgaaaaatgagttaactttaattaaatttattattaaatttatttaaaaatatttggcattctgtcttagaaaaatcttcaaaaaatcaataaaatcccgcataatcccgcacaaaaaatcaaatttgcggatcccgctgcgggattggaactcaaaattctttgcgggacgggatcccgcgggattaatcccgcaaatcccgcatttcccaaaaaatacgggattgcggactgggatcccgcaaaatcccgcgcgggatcccgtcccgcgccggtctctagaagagacaaagccacaaaaaaagtcacaaaatgccaaaagtttaaaaagttcgagtgccatggaaaatctcaaaatccaaattgtgacagtagttttcaaaaacgatgctgatccgttcacagttaaaggatttgatcaaaacaatgctgaattgtattcggctacaacacagtcaggcacatttaacaatgaaacatggcaatttgtgaagatgaatgttaatcattgggagggattggacgccggcatgattactttcaaagatgggaatgaggtataaaatgtaattattaaaaagtaaattatttaaacgaccattttatcctttggcccaatgttaagggctaatatttgtcggactcggaaagtttagtctggcagatttagtctgcgacaagtttagagcatcataacttttttctttgttgatcaaatccaacaaacttggtatcattcgaaagctcttaacaataagctctattgcctttccaaaaaacacaaagatataccgacatgtaaaatagttataagtaaaaacatgaaaaaattctgtcttttgtgaagtattcatgttgcagattttttataagttcttcaatcgcttataaatagctattgaacagcttctaaacacactattatttttctcctaaataatgttgctttcttaaaatggttatatatatatataacttggaatgtaatttttatttaagaaaatcgtaaaaaatatgtaataaaaatgtacttacttcttaaaatggtta

SEQ ID NO: 45266 - DNA, 1287 bp, Heterodera glycines
aaattccttaattacggcgattcaattcggctcctgttggttctcaggaatctgaacgacttttttcaattgccggaattacacttactgatttaagaaatcgattaactgcagaaaatttggagaagctgctttttttgcatcggaatgtaccaatttataatttttcttattgatttgtgaacatataaaaaaaattttaattgacccgaatcccgacctttttctcgtcccgaaacccgaatcccgacccgatgttttttcggccgacccgacccgaatcccgacccgatatttttctcgtcccggaacaaccctggtatggaataaacgattttaactaattaataatataattattttaatctattaattagatttgttgaccatatttataatttcgatttattattttattttcccatacaattacatttttatgagagaaatacagtgccccaaaaaagtcttgactcaaacctgaaaaactatcgtatagttcatttaaaaacttgaaataattcatgcttgcataacttttggtgctgatcaaaaaagtctcttacaccaacttgatcagatcactccttcctagtgaccgggacacccaaaatacactaaaaataggggaaattttcgaaatccctaaggggctggtaaattttttctagagaaaatgaagccactggaaagatcacaaatttgttacagaattgcttttggaatggtggatctgcgatttgtatatagaaagttatacttggttgaataatgatcaccataaaaatgatcaatttatcaacgccataactttttctagaagcatccaaattaagcattcttggtatcatttgatacacgggaccgggaatttttgccaaaaccgggaccgggtcttgccgggatctgagaagccgggatcgggacctcgattttggtccggaaccgggaacccggaccaaccgggaattttaccattatgaaatctaaataaattatgttttccattattttattataaatagtttaaaattaataacgcgaaaagaaaatttgaatttttgtttgaaattacagctcgttttaagaaattttgatatatgaataaatgagaatattttattttaaactttaacactattactttatatttacatttaacttgcgaataacaaagtttatccagggttcttattaaattttgtcttagtcctttgaacaaaattattattattaattatatcatatttcagcgcatattatttataaatgaaatagtagagaaat

SEQ ID NO: 45267 - DNA, 795 bp, Heterodera glycines
tgaaaaaatcgactttttggttttcggggcagtccctccgaatcgatgcgcccgagattactggggagccggaatccttccggaatagcttccctatagcctgtactttaattctgcgtaggatttcagctccccataattgttttgagtaccccaaccggacactagaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttaaaggtcaattgctctagtcaatttttaaaaatttttgccgttggagatgaagtgctctgaagggcggggggggggggggcgggg

SEQ ID NO: 45268 - DNA, 1601 bp, Heterodera glycines
  misc_feature (882)..(882): n is a, c, g, or t
tttttttttgaaaacaaacggataataagaggaaaggaaaaaataaaagttgtgggggaaataaattgaagataaaacaaaaaagaataataaaacttatctaattttattaaataatcaatttaagaaaagtgcacattgtgcacttctaatggaagttaattaattttttatttgaatattaaaagttctatattttaatttgatttaatgctcttttaaattctcaaaaaataataataaaatgaaaatataacattgagtatgtgatttaaaaataataaaaattaaataatattaaaacatcaatgtaattaaataaattgataaaatgataattaaaagatcatttattaacttatactttcatatgaagataattttaaataaatactttaacaaaacgaattaataagcgccagtttttattttaaaccttttaaattgttaataaaatcaaaatttcttttcttatattatattttttatctttttaacatataaacgaatctcgttttgttattcttttatttttgattttctggttaattttttaattcgaagaattactttgtatttaatgaagaaaatcaaataaaaaacggcctattattgattaaatatattagttaatatgaatttctttttgaatttcaaagtttttttttctcgttttaatacccaagaaatgatgagatgattaacatgttttgcaatttttcaaaagattttttttaattgaatcaacttcataataatcttttaagaattgatatttattaaaaaaaattaatcaatttttttagtgttgattaaaaaaatattattttaagatagtttggatgctcataatcaagccaaatatattaataaattcctctnatatatatatatatatatatatatatatataattttttaattctttcattacgtaattatttattcttgcataaaaacataatttgtaatatggctaatttattaaattttattattttttgaaatcatttctgtcagttatttatatataagttaattccataaaagtaatgaaattggtattattaaatattttgttatttgattattttattctttgctatatcacatggctaattcataagaatcttcgtttttaaaatgattattttaattaatgaaatgtattttaaaatctaattaataagaaaaactcttttttatattattatttaattaaacattttcatcaaaagcaacaaatatacaatattttggaatttaatatatatatatattttattatataaccgattaaaacaacgaatgtggaaggggcatccacatggtgggcattttttctcttcatcggcaccaaaactttttttgcaaacaatacaataagaacgcgtactcattgaagtgcgcgcacaaacttctttaaattttataaataattaaccacagatggaggatttccaagctttggctcatgttcgggatcaccacttgggtagcatcagaacccgaaaattgtcccaaaatcaatttaaaaatttctaatttactttagaaaaaaagtccctcaaaacaaataatttatttttggtgtatttggg

SEQ ID NO: 45269 - DNA, 466 bp, Heterodera glycines
aaatttgggaaacacgtccaattcacacttttgatcaaattccaacaatttatgagaagaccaatttaaataaaagcacaattacaattaaaaatttcagaggagaggagattccaaaattataaatagagaccgcattttgaagcatatgccttttttttctgcgcactagtttcgatatattaagcataaaaaacgctgtttccacttggtttgaggcttctacgttgacttttattatgccttttttgcctttttcaggattttcgtgccttaaatgccttttttggcatttttgccgttttggtgccttttttggcatttttttcgaaaaattccattaaaaatgcaataaaatcgggaaaatacacctctaagaatcgacctaaaatttttttcagaaaatacacccctaagaatcgacccgaaaattttcaaaaatgcacctctaagaattgaaaaattt

SEQ ID NO: 45270 - DNA, 693 bp, Heterodera glycines
aaaaaattttgtgacaagacgggtaaatttttactcagcgtgccggcaataattttttgatcaattaaactgaaaaaaaaaaaatatatatatatatatatatatatatatatatatatatatatatatatatatatatagtgcggggtgaaaagaataaagaaaaaagataatttaacttagtttattgcctgggcctaaattgacagcaattgcttgcttagcttatgagtaattcaaatatttttaaaaaattattcaaaaatttttagaccgaccaggtggtggtgccctcctgagccttgccactttcaatttcttcaacaacagtaggggtatggtagaagctgttcagatatgattttatgccgtaaaatttgccaccagctcctttaaaaatttaaaaatatttcaaaaaaaaatatttttttgcgccttgctgtgccgccccgttcagtacaacaccgtcaaccaccaccggttcatgctcttcagttttttccccatcgttggttgagctcaacttgctggctccgccaaatgtgggccacaaattcagccgaaattttcgcatcacctctcaagccccagctttgttgcttgatcggaaaaaaatgaaaaatttgtggacaggtgtcaatgcttttccgatcagcaaatcatgtattgacagtgtgagataagcatgtcaaa

SEQ ID NO: 45271 - DNA, 662 bp, Heterodera glycines
tgtttgttttcacagaatcccaaattaaaaattaaattaattgcctgatgcgcccggtggaaattgccgactccgaagtgaacaatgccggccgacaatgaagcacgactgtatttcggcacatttacttccgggtgtgccaacgcgatggcatccaatgtacgggcggacagtttaattgtttttggcggtgggttcagcgtgttcagcattgtctggtggtcagctgcgtaatcattttttcgttgctgattcgtgacaaaattttgggcaggcatttttgtggcttggagtactgttgttttctgtaggacaaaaaattatcaaccttttttaaatgccaaaaaatatcatacatgttaccatggtactgaaatttttcgactcaagagtcacgggcaaataaacgataagatttaaagtagaaaaatgttaagccccgggtgggaaccgaacccccatcaattttttcaaccccagtaaccgtctccggtcactttacagtaatattatttaattttctgtatttatagcgtattattggtataattatagtcattctcagtactcaatttagttgatcagcacagaaaattgttgctgacagtgatcagagttactaataaactaagcaaaaatgaacaaacaaaattataataatg

SEQ ID NO: 45272 - DNA, 863 bp, Heterodera glycines
  misc_feature (59)..(59): n is a, c, g, or t
caatcactgggactcaacccacgagcattcaatcactgggactcaaccctccagcattncaatctctgggactcaaatctcgggcattccaaacaatggactcaatcctccagcatttcaatcactgggactcactcaatccaccaacattccaatcacattccaatctctgggactcaatccaccaacagtccaatcaacgggactcaatccaccagcatttcaatcactgggactcaattctactgcatttcaatcactgggactcaacccaccaacattccaatcaacgggactcaacccaccaacatttcactgggactcaatccacaaacattccaatcactgggactcaatccaccaacattccaatcaacgggactcaacccaccaacattccaatcattgggactcaatccaccaacattccattcaacgggactcaacccaccagcattccaatcactgggactcaatccaccaacattccaatcactggcactcaattctcctacatttcaatctctgggactcatcccaccaacattccaatcactgggactcaaccctccagcattccaatcactgggactcaatccaccaacattccaatcaacaggactcaatccaccagtatttcaatcactgggactcaatccaccaaaagtccaatcaacgggactcaatccaccagcatttcaatcactgggactcaattctactgcatttcaatcactgggactcaacccaccagcattcaatcactgggactcaacccaccaacattccaatcattgggactcaatccaccaacattccaatcaacgggactcaacccaccagcattcaatcactgggactca

SEQ ID NO: 45273 - DNA, 1243 bp, Heterodera glycines
tttaattttgttttttaaagatataaaatatatttttatatcttttatttgtccttgatattaattgttaggtatgcttgatcaaaatctaagctctttagactaaggctagtaggtgaaaacacgaaaaattttgcgtgctatatattttgtgatatgatttttgtataaagcatttttttaatcaatttgcctaataaactatatgtaataaattcgtttagttgtgggtaaattttccgattaaagaaaaaaagtatgtcgaaattgacatagcttagagcaagaagcattatttaattatcaccttcagtcattatttcaatttggtaattacgaaaatttatttgaaaattcattttaaatttttttttcttttttttgataatttagtcacaaatgtcggtccgcaaaagtcggtccgcaaatgtcggctaacccggcgcctatcggcaacgatggaccccaaaaacacttttttctgcccaaaattttattcctattaacttgatttagaattttttaaatttagccattaaaacatttaaaaatttttaattgattttatacagtttcagaaattccgatcttccgaaatttttgaggctaggaattccgatttccaatttccgaaaatctttgggcctcggaatgccatccctgaaatatgacataggcatttatataattgcgaacattttgggcacaagattgttattgatagcgttataacgggtggatgagatgaagaatcccagcgtcggcattgcgatattccttttcctttggtgaccatcagcagtttcgtagcccataatttttttcttacttgatcaatgcttcattttggtatcaatcgaaagattaaagtctacagtatttttatataactaattatcggctatttaattagatagttgtttataaaatacgcgaaaaagttaaatttaggatttttggttgtaattttttttcctcgtgatgtttcattttgtagttattatagttggttcttaagttagcaagatttcatccaaaaatttgttatttgctatgacacttttttcaaaaaaaagaagaatactcgtagaaaattgagtcaatcaacctttaaaaaagttcgttttgatccaaatctgttaactcattgaaattttaaaaaattttcggcgatgtttgacaccgtatagccataaaatgttatgattttataaaagtaaaatatttatttattttatttagc

SEQ ID NO: 45274 - DNA, 333 bp, Heterodera glycines
ttttttttttttttttttttttgggttgggcgccccccccttttttaaaaaataaaaaaaaaaaaaacacctccccccccccccccccccccccccccccccccccacaaaaaaaaaaataaacccctatagggtgtggggtgtgggtggtttttttttttttttttctttttttttttttaaaaaaggaggaaggggggggggggggtggggggccccccccccccccccccccccccccccccccccccttttttttttttttttttaataaaaaaaaaaaaaaaaaaaaaaaaaaaaatagttttgtttttttttttttttttttttata

SEQ ID NO: 45275 - DNA, 728 bp, Heterodera glycines
agggtaacatcccttgggcagctgaattcaacaacaatgtcactgaccttcaacaaggcaattcaaaacatcgatctgtctcatatcaacagacaaattttcaaaatccattaattttcgtcacacgcggatcaatttttgaatctgaacaggcacgcctggaacagaatctcaaggaattgacgagacggatcactcggcctgaattgaacttccctgacatagggacagttgacattaatcagaccgagattcacggaagcacggtcacagacattttttccatcggcgaaatactggtggaaaagatgcaaaaagagggcgaaaatttcagaaaaaaggcagaagaaacgattgaaaaagggaaggcatggatggaagacccaattggaatcatcaaatacatcaaatggatcctaatcacaatcgctattattttaattgtgattggatgcacagttcttttgtggaaaatcaaaatttatattccggaagaagattggccgaacaagttcgatatccgatcgtgatggaagtcgaactccaagaccgagccaagccatcagcaccaccagaggaacctttactcgaccaaaaagcatacgtgctcaattatcttcccaacatttgccaaattgaacaaacaagacgaaaaaagaaaagatgttacgtcaattttttcatgaatggagtgaaaacaaaggccttattcgacacaggagccgaca

SEQ ID NO: 45276 - DNA, 1001 bp, Heterodera glycines
actgggatcacatctaaacgactatgctaaaaacggggaactaaactgtattaatatttttaacaaattgcagcccttttcgcctaccctgttaagagaaatcttaatttcactaataatttctcaattttcttctataacagattaactcttctatggtgagtttttcaatttctatgtactttattaagtaaacaataataatcaaacatttttctatgattgcaaagcatttaaaaaatcataggcttgtttattttcattatgttttgaaaaggtcaattaaataaacaattttttttttgtaattttattaattgtataaatcttatgcaattttctataagcaatcgatagtgtaacaaatagagaagataagttctgatcaaacacacacctttcattatttccggttaaatatgtgttcatattttaacaaaaagcagtcttgaatgtcgtcgaaatttgtggtaattccatggcttatagctgaccaattgctctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaacggggaactaaactgtattaatatttttaacaaattgcagcccttttcgcctaccctgttaagagaaatcttaatttcactaataatttctcaattttctttctatacagattaactcttctatggtgagtttttcatttctatgtactttattaaataaacataataatccaacatttttctatgattgcaaagcatttaaaaaatcattaggttggttatttccttatgttttgaaaaaggccaataaataaaccattttttttt

SEQ ID NO: 45277 - DNA, 438 bp, Heterodera glycines
  misc_feature (6)..(6): n is a, c, g, or t
tttttntggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaattttaaaaaatgatttttgctttatgattttaactattaaaaatttgtagaaaaaatttcgcttttcgcatttcgcttttcgcatttttgcatattttggcttttcgcatttcgcttttttttcatttcgcatttttcagtttcgcaaatttcgcatttcgctttttatttttcaatttggcccatccctggtatgtcccccgtcgcttggcagagataatcccctgcgattaattttcacactctgaagccatccaattggcatttcgtcggcctaacagaaggagagataa

SEQ ID NO: 45278 - DNA, 932 bp, Heterodera glycines
  misc_feature (133)..(133): n is a, c, g, or t
ttcaaagctaattctttcggttcatttctcattttccacaattttcatcaataacttgcttccttttttctccttcctcctcttccattgttttattatgcatatttttattctgtcaatttgtacctctccnccaccctttatctcgaaagtgttctgcctgatcattctcgacacaataataccctttccatggcgaagggggagaggaggtgcacttgacggcaccaaaaacacaacttttgtcttgcataacgccgccactccccccccccccccgcaacccctcgggggagggaggggagacatttgtttgctgggcctgggcctgggactgtgtcccagaaaatactttaccacggagctacaaacttactgtacaaattgctattgtctacgatttccccgattcggactccgtcagttgggcctcgacacgtttgggcccggactataacttttttctttgtcaaccaaatccaacattgttggtatcattcgatcacactatgttatcctctattagcctgcaaaatttcgaaaattttcgttaagggtcaaaaaaatgatggcccataatggctgaaaacctggtttctgtgatgtacttttgggcattagtttgttcaaaatttatggaatttttttggaattttgcaggctaatatagaggacacttagggctatcgaatgatatttggatttattatatcccgctttggattttctcatgcgcatttgtcactactcatctcctttgtggttgttcgagaataggaacaggtacaattttgcaaaactttccaatcaataacattaaattctatttaaaatactaaaaatttcacttttaatttgcttttcggttttgcctttgacactgcgcccgaggggacggcggacaccgccgcgggggttgggggggggggggg

SEQ ID NO: 45279 - DNA, 880 bp, Heterodera glycines
aaaagttggtgtccaatttctcggtagggatttaatagggactttcaagagatagccattttttgtcaagaaatatttttcgtgcgttttcaaaccccactattagtgctttattcagcgctacaacaaaagacaaaagttggtgaccaattctcggtagggatttaatcgtgactttcagagatagccattttttgtcaataactatttttcgtgcgttttcaaacacactattagtgctttattcagcgctacaacaaaagacaaaagttggtgtccaattcccggtagggatttaatagtgactttcagagatagccattttttgtcaataactatttttcgtgcgttttcaaacacactattagtgctttattcagcgctacaacagaagacaaaagttgtgtccaattcccggtagggatttaatcgtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttcaataactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaaaacactattagtgctttattcagcgctacaacagaagacaaaagttggtgtccaattcccggtagggatttaatagtgactttcagagatagcaatattttgtcaagaactatttttcgtgcgtttcaaacaca

SEQ ID NO: 45280 - DNA, 643 bp, Heterodera glycines
tactcagattttcaaaaaaaaaagtttaggtttttggctataactttttttttgcatccaaatccaacactgttggtatcattcgaaagctcttagatgctctattagctttacaaaaaacaaaaagattttttagcctgggaaaaattttattatgaaaaaattaaataatttcgacttttcgcaattttcatgtataacttttttggtaattgtctgattgcgaagcgatagcttagaaattgcttcaaaacatgttaagctttcgaatgatagcaagcttattggatttggatgctgccaaagagaaaagttatagccaaaaacataaactttatgtaaaatctgagtagggataattaacaagtaccaattatttttcctcgcattttcagttggatttgcaacgacgtttggatggacattctcccatcttttgaccatgctcaactcggactcaaaatggcacttctttcgccacgttttgatgcgttggtggacaaacatttcgatggccaatcagaatttccaattttgagaacaatcaaaatttgcaaagacactgttgcagcagtgccgaaattagccgtagttatcgacgaagacaattcagtgccatttccgttgcccgactattcgctgc

SEQ ID NO: 45281 - DNA, 417 bp, Heterodera glycines
gaccggagcccatacgaaccatgtggaatgtttttaggaagaatctgaaaatgaagttcaaggccatgtacgggacttgccgcgagatgttgccaagttattgtgccgagcacatgtggcggcagttcaacggaaagaaaactttagcggcatttaacaatatgatttatcacattgccttttattaccccgtgaataactgaattgattcgatttcctttactcatattgtagttacagtaccaagcaatgcatcagcaatatttgcaaaaattgaaaatttgaattttttcaaatgttcgaatccgggttcggggttcgaaattacgtcaaaagaaggtcaaattcgtgctcagcgcatcaaaataacccctaaaaagtgttttatgaatttttattcctttttttttgtgggac

SEQ ID NO: 45282 - DNA, 1207 bp, Heterodera glycines
  misc_feature (1058)..(1058): n is a, c, g, or t
  misc_feature (1140)..(1141): n is a, c, g, or t
attttaaaacaaaaatttttggatcgttcgattatttttccaaaaaaattcatttcaaaggtgcaaattttccccttcgacgccgaccaaattaaaaaaaccgctctctctctaattacaaacgagtaattttttagacaaaatcttttaacaagttgaactcaaatttgggtagtccgaaagtccgcgcattggatatcaatttcaaccgatctcagcctgttgtgttgatattttttagatgaaacaattaaattttaaattttttagcgtggcgcaaatggcacggcacaaaattctcatcacccgatatacctatgttatgttaacagattttcgccgaataacctctttaaaaatttcgggtacgcaatgttcgagagtctcggcgcttcgagtcgttgagagagaaaagtcttggattttctcaagtcttggcaaaacattttgtgccgaccatctgctgctgttttcggcattaaaatgaccaaattcaatgacaatttgtggtgccttttatttctatttctgctgcgcagcttttttcgtcacttctgatcagtgatcacgcatattcattgtatgcttggcatattgtaaaaaatgattttgacccaagaaatgaaaatgcaaaaaaataccaaaaacaaaagacaataagaccgataaaaacagttaattatttcaattaaaatctcaaattttctacggcatcatctgtcggcactgccgtcttcatccttttacgaaaaaaataaaaaattaaaattaaatgaattgacaaaatatttatccttttgttttgttatttggcatcatatcatatgtcttattgcctgatcatttccaatcagttttaattgcatccctctcaaatcccctgccgagccaatggtccgattcgcgggcattgatcatcactgatcagaagtggcgagaaaagctcaatggcaccacaaattggtacaaaacattcattgcattcattcgatttgatctttttaatgccaaaagcagaacaagatggtcggaacaaaatgtttaccgaggcttgaganacccgatactttttcatcttgttccaaactcagtcggcccgtactcaatcgtcccggctcctatttttacgattatttttcnnacacttttttgctgttcacacacttcatttactatcctaattaacataaatattgttaatcgtcaa

SEQ ID NO: 45283 - DNA, 1145 bp, Heterodera glycines
  misc_feature (1075)..(1075): n is a, c, g, or t
acaaatttatttttaattataaaaattaatgaaaattttttattaaatatttttatttttattgttccaaaaaggcgcattaataacaaaagataaatgaaaatattaaaattggaatgttttaaccaatcaaaatttagtaccgcagatgactatggacaggaaaatcagcaggaaaagggagagaaggacacggaggagagcaacgagtaaaaaaataataaatattgaataaaaaataaaagaaaaaagaaaaattcattcaaattttttgtaaaatttttgttcattatttgtaagaaatttgccggcatcggaggacagtggcaacccgctcaaatcttctgaggataaccaaaaacagcagcagatggatgaaggagaagagaaggaagcggaggagagcaaagagtaaaaataaaataaaattaatatttagttaataaataacattcaaattttttgtcaaatcttttttaattatttgtagcaaaatgccggcatcagttgacagtggcaatccgcccaaacccaaattgaaagactatcagaaacagcagctgtaggatgaaggagagaaggaagcggaggagaaaaaagagtaaaattaaaaaaattaaatattgaataaaaaatacatataagaaaaattcattcaaatttttgccaaaattattgtagcaaaatgccggcatcggttgacagtagcagtccgcccaaatccaaatcggaaggcaacctggaacatcagcaaaaggatgaagcgaagaagaatggaggagggtaataagcacaatgaaatataaaattgaatacctaaactgaataatatttttatttttgtaattaaaaattctcagaactttaatcaacatagaaagggtaattttcgatttcaaaattattaaaaataaatatatttaaatgaaattttatatgtatcattttttccaactaattttcagttctaaagatgattatgaacagaaagagcagcagctgaagaagacagaagagaagcaagtggaagaggaaagcgacgggtaaaaataaataataaaaaatgaaaaagtanattatttatttattataatattaccatttttgctaaatgcatttggcatataatttataggaaaatgacg

SEQ ID NO: 45284 - DNA, 796 bp, Heterodera glycines
agtcgcaagggcaaacacttcaaaagatgggtcttgtgcttagagggaagcaatgtttcacgcatggtcaagtttacgtcgccatgtcaagggttacgcaaatggaaggcatccgtgtgttttcaccaaatacctgcaagggcgataactgctatatccacaacgtagtttttcaaaaactacttggcctgccattgaacacgcttgcgcctaccaaacaacttttcaacataaatacaaattattcaggggcgctaaatgagaatttgcatgatgaggatgaagaattagatttaccatgttgaatatatagattttatttctcattttcaataaaatctatatttcattgtgacttattactgcttgatttaacattttcttgaatactttcccttttttaatgcatatatatatttttgttagttactatggaagaggaaattggtgaaaaggatattaataatactgctgtgtttggttgtaatttgccgcctgattctgacacaggtttgagggattaattaatttaacatttctacattaaaagtgcgggattgggaatacgtttttatttgccgacccttaaggcaatgaatggcaagggcgatgtagagcaatttgtaaccaacgaaaagcataccaagttggtggacgtgtcagactcagacgaagaagcgaaaacaatagaaaccagtgcccaaagcccagcttcgggtgtgtgttttttatttattgtttaatttacaatttacgacgagcacactcaacttcgcaatgattttttgctgacacg

SEQ ID NO: 45285 - DNA, 1032 bp, Heterodera glycines
aaaaaacttttgggtaatgattattttttggagtgagtcaaacaccctattagtgcttgctgtgccgagaaccggcaggcaatggatggctttctatctgcaagaaattagattggcaatatgtggtgtaaaaaacttttgggtaatgaattattttttgaagtgagtcaaataccctattagtgctttgctcgtgccgagaaccggcaggcaatggatagctttcaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaccggcaggcaatggatagctttaaatctgcaagaaattatattggcaataagtggttgtaaaaaacttttgggtaatgaattattttttaaagtgagtcaaacaccgtattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtatggaattattttttgaagtgagtcaaacaccctattagtgctttgctgtgccaagaccggcaggcaatggatggctttcaatctgcaagaa

SEQ ID NO: 45286 - DNA, 652 bp, Heterodera glycines
caaagaataagcataattgaatcaaatgggcaatttgacataacccaaataaaatcccaatctcgtggtgaagtatataaaagaatatttttcagataatagaaatcgcttacgataaaataaaataaaaataatgctttgaattcataattttagttcttttgaaaaagttttattaaaataaaagtcgcttttaccgagaagtctgagtaaacagtaactgattcattcttattctcttggtgggctcaaatataattgattgggacaaagacgtctttttgtgtaggttggttcgctagttcagcaaaaatagtaaaagaccaggatatagcaacaaattaaatatactctaaaacagcgaataaaaaaggatattaaaccttttttagaatgtgaccaaagaataagcataattgaatcaaatgggcaatttgacataacccaaataaaatcccaatctgtggtgaagtatataaaagaatatttttcagataatagaaatcgcttatgataaaataaaataaaaataatgctttgaattcataattttagttcttttgaaaaagttttattaaaataaaagtcgcttttaccgagaagtctgagtaaacagtaactgattcattcttattctcttggtggacactac

SEQ ID NO: 45287 - DNA, 1048 bp, Heterodera glycines
aaaaaatgagaaaaaagagatagccatttttgtcaagaattttttttgtttgcgttcaaatatcgtaagatagtttgatagggccagacaagagaaggcactgtttgttacaagttgcgggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgataaggccagacaagagaaggcaactgttggtaccaagtttgcggtaaaaaaatgacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaatagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtc

SEQ ID NO: 45288 - DNA, 1190 bp, Heterodera glycines
  misc_feature (13)..(13): n is a, c, g, or t
  misc_feature (39)..(39): n is a, c, g, or t
  misc_feature (47)..(48): n is a, c, g, or t
actgtgctcatgnacacgtagttgtccaataaggtactngacttccnnacagtaaaatgtgtacaaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaactggccaaaggcgactgtgctaattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaatttatttcaaaagacaaaaaaaaaatgattcaattttgaaacgaaatagtgcacaaaagggagggatggttagacgaaaagaggaatttttagaaaagagcgcaccccatctgatatttccattttccgttccacaacaggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttgtatatttttcacaatttatttcaaaagacaaaaaaaaatgattcaattttgaaacgaaatagtgcacaaaaggcgagggatggttagacgaaaagaggaatttttagaaaagagcgcaccccatctgatatttccattttccgttccacaaca

SEQ ID NO: 45289 - DNA, 877 bp, Heterodera glycines
  misc_feature (868)..(868): n is a, c, g, or t
gaagaagctgcttattaacaagccgatgctggctaaagacaatcattaaattgtgagtaaattagcacatcggaaaaacattttttggtctttggcttttcagcgatcgattacaaaaagaaaagtcacacgaccggctattaattatccctaattggcttctcattttcccatcaattgctgcagtttggcactgtgctcagatgagtggtgttcatccaattgggctttgctgaattgttttgattttttaaatgacggatcaccgattacctgccaaatcgtctgtcgcaaattcggcactttgccaatgtccgttccattttgtggcgtctccgatgggcaacaaaacggccaattgaaacgaatgtttggccgcatttgtcacatccgattaattgttccctttgacaagctgttggggactgatcagagcgatctgcaaatgaatattctattgtccgctaataaattccgcgtttggcattcgcttttcccctaatttcgcctaattgacccctcaggcgtcgtttgtctgccgttttcggttttggtgcgtttccgccaatgttttctctcaaatgctccgacatgtgtgagttgagtcccgcaaaagtgtcaaaagtgcgtgaacattgtgcgcatcccatcgtaatttcggccaacgattggtcccccttttgtgcgttttcgccgccaccgcagccgttgtcaccaaaagtgccaaccgcaaattccgtcaaactgccgaccatcacgtggaaaagcaaatgctttccgtaatcttcggccattacattaagggaaaatgttccaaaaaataagaagttgtagcgaaatagaaagaaaactattttggctatacaanttttgcaag

SEQ ID NO: 45290 - DNA, 854 bp, Heterodera glycines
gtaccgttaacggcatttcgctctcaaaataatcgcgaacaaacctcaatttcgtcgcttctcgtcgccgcttcatccgcgaacggctcccgcttcgtcgtaacgaacccggtcctccctgttgaaaaaaacaacatttaaaatgtttgaagttttctaactatagcttattttttagcttttttaatcacttttatggcaatattaagaagttcaaaaatttgaattttcgacttattgtttgaatttgggttagttcaggaaaaactttttgtatgttgcttttgtccatgaggatagtcactgattggacgcgtaaattgaatagagcctattgactcactcatcgcaacagtctttggtcaagcaaattggacaaccccgaattttcatacaactaatttttgtccaaaaaagggtggaaaaaattcgttaagtcagtcagactagaggaacccaaaaccagtgtgaataaacctcagaattgttgtcattgtcgtcgtctctctgtctctgtcgcatccgcctttcatcttcccgaacaacgtcgagttgtcgcaaaagttcgcggacgaattcaaacagttgttcacggtcggcgatggcttgctcacgttcctctgtgcccatgttcccagtcgccaagttagcatcaaacacattgattcggtgtgttgcatccaaaatttgagcaagtaattgttgacgacgatataaaagaaaattcataaacgctaaaacagatatgtataagcagagttcaagaaatttggtgaaaaattaattttcgacttttgtttaaattcgggtccgaggttcgcaattgaccaaaactgatgttaggttagtgatta

SEQ ID NO: 45291 - DNA, 867 bp, Heterodera glycines
gtaagataacatttgcccgcaggcatttttcggtatttttcaaaaaaagctatgaataggaaaaggagggaagcggcggtttccaaagacattgccggaaaaattgggaattttaataaaaattggtggcccagcggtgccgacggacgctgcaggggaaaaagtcggaatttgattattttgaattttttaaataaatttttaaacaaaaataatttgtaaaatatttcactttttttgctcaattgttttgaagaaaaatgcatttctgcgttgaatttttcgattctgatttcactattcgtcactaaagctaagttatgatttattatttagcaaacaaaatttaaatagtaattaaatttaattattacgaatagggctgctaattttatgttaatttttttcgtacatatttttcatttttttacatattttgaggttttttgagaatttatagaaattttttgcaaaaaattaaaaaaaatttttttgaaaatgtatccctaaaaaatcgattttttcaaaaaatgatatatcaaaaattaatttgtaaaatattcaaatgtgattctaagcctattttggtcatttttatggcattttgtgcctatttcactttttacgaagaatttttttccaaaaaataaccattaagtgatcatcatctgtgttccctctccgtggacctacgaaaattgctaaatttttggtccattcccatcccattcatctcaatttgttgtaaatgcaaaatctgaaaatttggattgattgccatcataaaattcaagcgggggggggggtcgaaaaatttttcggactttttaatgaatttgttaagaaaatttccaaaattttgcgacc

SEQ ID NO: 45292 - DNA, 966 bp, Heterodera glycines
cggctcattagcatttctctgattggccttccttgttttcaaatgcttcaatggcgcttcttttctcatgctcaatcactttttgcagctcttcaaatgccgtcggcaacaacagttcgccccttttagtcctttccaaaatgccgaacaccgcgaagtccacgtcgtccggcatgtgcatggctttgtcgctgtaaatgtcgatgattttcctgttgaatttcataaaattttcttccgcttcttttgtttcttccaattcactttttaactcttcaaaagcgttggtcgcttttttaagcaatccgtccaatttttgtacaattaattgcttcaaaaaatgcgacttttccattgcaatggaaattaatttgccgattttgccctttaattcctcctgaattaattaattaatttttaaatgataattttcatcaattaaatgtacctttttgttcatggaatttggccatttacaaattgcagcattaatttcagctaattcggcacttaaatccgacgaaaatttgaaaaaccctttaatgtcgacaaaaggcttttcaaaattgatcattttggttttcatttcgttcaaccaaatgcccattttcatctcaacaaccaactcatccacaatcctttgagcttgttctttacttgggttggctaattccttccgactaattaggtcattaagcatttccgtggctcgctcaaatggcgacaggtcacaatatgagccactttgttctgcaaatgccacaatttggtttatttttgcaacaatacaaggaaacattttgcttgtccatttgcatttttcaatttttttcatcgaaatctccgcaaaaagagtgccaaaatcagtttgaaggcccataattagggacctgatcttggccattgccatcaaatgctcatctgccgcttcgcctcctccgtctccgatttggtcattggcactaa

SEQ ID NO: 45293 - DNA, 1001 bp, Heterodera glycines
tccatacctcacatatactcaacgggccgaaaaatcatttttagagcataacaactgatgacagccactgtcattgtttccaaagagatttctattaccagatgccaaaaaaagagatagcaattttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatgttttttggaccgtccatacctcacatatactcaaacggcccgaaactcattttta

SEQ ID NO: 45294 - DNA, 1280 bp, Heterodera glycines
  misc_feature (82)..(82): n is a, c, g, or t
tcattgtttcagctgttgtgggagttccaaaggcgcaaattggcagaattggaaacggcacaaatgactctttttctgaacncaagcaatttgtgtgggaagaaaaaggcagaggagggacaattctttggagagtcaaaatggcacgaaacggcagagaaagtgagggaacagatcagccaggcatgtgaagaaggcgaagagagtgccgccgttgaaggcggagaaagtgaggggacgacgaagaagacaagcgaagacattcaggtcagacgagcagagaataccgagagaaaggccccattgaattcagtcggaagtcacaaattacatggaaactgcccgtctcgagttgggccaaccgtccaccagcggcaactgcgtcgacccgtcctctccaccactcgtcacacattttaactcaatggccgaactgctcttttggtggcggattaatgccgaacgcttcccacgccttgtgcagctcgcccgtcagttctgcgcagttccaatggccaacagcagtgaccagaggaaggcactaagcaacgacaatgcggaggaagagaaagtgacgcggagatacgcagccgaacagatggcagaagatggcgacatggcacaattggagagcggacggacagaacagttacagctgctcacacagctgatgaccgtgagaatggcactcagagagggggcgacagaaacgaacgaaaatggcaaaaaacgaaacgaatgcatggcaccaaatgaagaaattacaactattgaaccaattagagaaacatcagaaattaaaatatgaacttttccaaattggattcatcaaaaattgtttatctttcgtttctcgatgaacattttttgaaatgcacccataatcgaatcaaaatgagtcaaagggtcaagcggttgtgataaagtaaattgcgatagatcagagaataatgtgagatccgatagcaggcccataacagaaatttttcaacatttccaaaaggggtcacttatttttcggggattggttagacatagttacgggcctgattcgcagtgattttgagtggtgaacaaaacaacaaacaaaaaatttaacgtgcattccctcaagcatccacctgcgcagtgatttcagcctcgtattccgccctcatcgtcaacgggggcatcttggtactgctgatacttcgagatcaaatcgttccttgttgaattcggtttccgtgaattcaatctcgtccatgcccttccccggggtaccaatgaagaaaagcctt

SEQ ID NO: 45295 - DNA, 1072 bp, Heterodera glycines
  misc_feature (154)..(154): n is a, c, g, or t
  misc_feature (171)..(171): n is a, c, g, or t
aaaaattttaaaaatttttatccatctccctttttgatagaaaaagcatcagagtgccttaaactaacatgtaaataaaatttggtgcgtttcagagcagtttctgtaaaatactttatgaattaattatgcaaaagacaaataaataatgacntctcttccttaataaanaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaacgatataaccaaaatataaggacaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaattgattttttcaagtgtccgtttggggtactcaaacaattatggggagcaaaaatccaacgcagaattaaagtacaggctataggaaagctattcccgaaggattcggtctccccataaatctgggcgcatcggttcggggggactgccccgaaaacaaaaataaatcgattttttcaagtgtccgtttggggtactcaaacaattatggggagcaaaaatccaacg

SEQ ID NO: 45296 - DNA, 684 bp, Heterodera glycines
agggcggcggacgcggggcacgacggcggagggagcgccgcacgcggccgaggcaaaggtcgcaaagtgttcagactgagcggcggaggacgtcgaatgcaatgccgaagtttaacggtgcctaaagaaagcgggggaattggtcgagagaatttggggaaagataggggagatcatttcgggggagggaattttagggggcacggagggaatgcttttaggtgacagtttggctcagaatgcattctgagcagcagagagtgtccgcccgtccggttcaatttaccggcactttcgtggggggtcgagtcgtgggatgagcttgatgagcttaagcttggctgtgtgtgcaactttcgttctgccatgcttatcaatccctccttaagtgatggcaacgaatgctttgctttcaaacagtcgaaactcactaccttacctcgtcaatttgccttgtctgatacggtgggaatacggctcggcacactccgtcgcccaccgttggcatcgattcgtacgtcgacgtggtaatgctgccgccctcctgggccgagctgagcaccgtggaaacagtggcctgaggaggcaacggtttcaaatcgacaaatgcaacgattgcctgcgaagttgtgctggtggggtgcgggtcgcccgaacggctcatcgacggagtggcggacactg

SEQ ID NO: 45297 - DNA, 1090 bp, Heterodera glycines
  misc_feature (3)..(3): n is a, c, g, or t
ttntgtacggaatgccagaacgtttgccaaaaaaaatgacggagtatgccagtgttgcagtgagaaagcatttacacgcagctttatcttaaatttgtattatactaaatcaaatttttttaggtattattgaacgctttttatgatttatcattttttttgggggttttatcgtataaaaagacaaaaaaggaatttcattttctccgaaaaactctcggattaatttgacaataaaaaagtgataagcgtcgtaaaaaaatcgtgaataaaaaatatattgaaactaaaaaattaaaataaaatatactaaaataaataaacttttatttttatccattaaacaaaaaaatttttaatttattttattaatttttaagaaaaaacttttatataaaattgttaaaaattccatttaattgcattacgtaaaaacttcaacagcttaagtttttggtaaatggtgtacaaattttgcaaaaggtgtcccattgccggatcattttgttcaacataatcaattggagatttgccaaaaaataaaaaacgctaaaaaataagtatatataaatttaaaataaattaaaattagaaatctgagtattttaaaagaatttaaatttaatttaattaaaattaaaaaacctgagttaatgagttggcaaatgtattgacaatgacttgatcgagttgacccaactggcataataaactttttgttgctacggcaccggcacttttcacaagtttggcaccatttttatataaatttgcccaaaaacttcccattgttgtacaacaaactgccgaaatagcaaacattgaaacaatgatgcaaaacaacaatattgcacgcctcattattcgcctttttcagactaaatttcttttaaaaatttaaatttattttaattacaattatacattaattttaaaattaaaaaacttaaatatatatttttttgataatgccaacaaaattagattgattttaattttttattattaataattttatcaccggaaatatatgaaatgtctgtaaaaaatatgtgcaattaaaaagcataaaaaaataaaattttaataa

SEQ ID NO: 45298 - DNA, 808 bp, Heterodera glycines
ccaattttatttacaagttaattttagcactctgatactttttctatcaaaaagggagatgaataaattttaaaaaatttttaattcctttttaaacaggccaaaaagtttaggcttaactttttagtgaaaattcaatcactcatttttcgagtactgatcaaaagcggactatattttttaaggacatccttaagacaaggaaaagcacctctgtgatgttttaagaccagtaactatgaatttaaattttctatgaattttggggagaagggagtgggaaacatgatttcaaaattttcaattttttatagtctaatctactcaaaacggttcagaattcaataaaaataacattcacggtgcgaaaaatggggtatgaaaagtttattgggggaaaaaagactacaaaataatacccctgggagaagggagtgggaaacatgatttcaaaattttcaattttttctagtctaatctactcaaaacggttcagaattcaataaaaataacattcacggtgcgaaaaatggggtattccttctacaatcgcctttatacatcccaatatgagcgctaaaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtcttcaaaaagcttctcaaacatttt

SEQ ID NO: 45299 - DNA, 1295 bp, Heterodera glycines
gagatatgctctttgaagatttatctgctgggcaaaaatcagcagtgttttttcaaaaacgattgataatgacgacaatgccaaatttgaaatttgaaaaatctttcttctcccgcgatttgtcggaaacaatatacttatttgttagtacaatacataatatacatcattgggaattttgaattattcttgaacccgagcgtttgtcttagttttcaatgactaattagcctttaaaatttagtggaaattttaaatagtaaaaaattttttgcagttcgatattttatggttttaaatttaaaaaatattttaatcggataatattataactctaaagaaatttttaattatttttgtttttaaatagcaatttttatttattaaaatttcattttttggaaataaattatcctcggccttatatccatctccacaccagggatgggccaaattgaaaaataaaaagcgaaatgcgaaaagcgaaatttgcgaaactgaaaaatgcgaaatgaaaaaaaagcgaaatgcgaaaagccaaaatatgcgaataatgcgaaaggcgaaatgcgaaaagcgaaacctcggcccatccctgctccacacccataaatttttcgcttcgtatagcaccttagttttttaaagggaaatgaatggtcgggttactgtatatcttggtttttgaactccattaccgtaattttaagttcaacgacaaatactatatttttgtaggaagactactgtaattgatttaatcaaaatttaatgcattttaatttattgcataacaaataaaataaaaattacgacacagatggtgagagcacaacagcaccaactccattagcatcagcaacagaagctgaagaggaggaacagccgattttgctcaattatttggacactttggcccagtcaatttgtgtgatggcgatggaacaaagtgccaacaaattgttcgagcgccaaatccaattgttctaccaattcgccgatggtttggcaaatgatgtcatccattcggtgcttcgattggccgacgaagagccatcggattttgacgacgatgaagtggaacaggaggaacaggcttttgaagacgtacattctgctgaagaagaagcggaaatgatgccgaaggacgacaaaaacgcatttttggcagaaaagtaaaagtttagagtcaaaaatattaaattttgaaaattattttatccttttctgacatttgatttctgggtcctgtcctttcaattcacggatcgcttccataaaggcagattgtaatt

SEQ ID NO: 45300 - DNA, 1702 bp, Heterodera glycines
atcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagcttt

SEQ ID NO: 45301 - DNA, 1100 bp, Heterodera glycines
atcatcagtatcatcttaattttcccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacggaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattccagaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatgctttatttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaataaaagaaattcagggattaattcctgaggaatttccaaggaacacgtgcatcattgctacaacggtgccttaatggcattttaatgtcaaaatgcccgacactagcgcatttctttagacaacgaaaaataattcctgaggaatttccccaagccatgcgcagctttgttagaccgatgccgaaatggcatataattggaaaaggacagacaacaatgcttttctttatatcagctgatggtttattacaaaaatcgaaatacttcctgaatactttc

SEQ ID NO: 45302 - DNA, 1481 bp, Heterodera glycines
  misc_feature (21)..(21): n is a, c, g, or t
  misc_feature (1018)..(1018): n is a, c, g, or t
attggcaatgtgcttatttcncattttggcatttcaaatggccaaagtgagtgagggaaaaggggggagggcgagaaatttgacgacattttaaaaggaaaatgaaataattggcagttttagtttcaaaagatggcggattttaagcaagaaatggatgcaggaaatcaaataaattgtgccgcttttggccttttggagtgccatttcctttccagtctaaaatgagccaattaattcgagaaaataaaatattttaaaatttaggaaaaagtgaaaggagaggggaaagggtaatggatgcggagaaacggcgaagtaaggagaaaaagtaaaacaacaattaattaagtaattaatgggatagcgaaaggaaaagcgatgggacatccatcccattaatccattatcccttttggttacacctctgaaagtgatttggtttatctttttccttggtttctcccgcacaattagcacattcttctgcttattcatcgatcatctgcagacaattctcgacggcattggcatcacaccataagttgcacaacttctgctcttttttgacgaaaataaatggcaaaaaaaaagtaatcgcatgataaattcccctgggatcggtcatttttctttttccaattttattttctcgcattttttttattttactaacaaattctgaattgctataatatcgtatataagcgagtaaatgagtttatttccattttttggttcttcgcttttttgcccttttggcgatacttttgagtatcttttgttccgattgtcccactgaatgatggcaatttctttttctgttatacggaggaggaatggagaatgaatggcttttcaattggtcattctctgctgatttggaggtccatcgaacaattggaagggatcgaggagagaacggaagaaatgaatgagtcgagaacaaagcgacggaggacggcacaatcagaaggaaaactcgacggacggaacggcacccgaaagaattgggggnggggggggacaaatgatcgaaacggaagagacgaatttggaagaaaagggacggaaaagtgatgggatggcatcatcagagaagagatgttcggaataatttcaatttcttaaacacaaccaattaatattccgtcccattttgactttgaaattcacacattaaatgctgtgcacaatccaaagaaatttcattttaatttatcatttttaatcatttaaaaattatatgggaataaattcactttaaaaatgttaaaagtctgatggattaaattgggcaattagtcataacggaatgaactgatgagcaaacatttcattatccacccattcattcgttcgcttactcatccctcaattaaggataaaagccaaaatcgtcttcctcggccgtttaactcaaaattcatctgttttcatgttactcgaatactcctttctaattgctttattacttttgc

SEQ ID NO: 45303 - DNA, 1184 bp, Heterodera glycines
cgtcaatttgggggaattaaaaaccaattttattccaagaaatatgggagtccatgaatggttggttggcccatttttgtgcataaatttcggttgaatgattcttgaatcgaaattttcgaataaagaccactaaaaactccgcatttcctccaaatttaaggtgttaaaaatttcgattttgaatattttaaaggtctcagggcattgaaggccaaaactgctgcattgtgtttcatttttgagaagacaaccaaaaatgattgttcatgcaaagatttggagaaggaactgctccaacttgggctgccctcgggtttttttttaccattttttgaaattcgaaaaatcttggacaaatttttcttggcacagaccatgtcagtgtactggttgaactctacgattccaacagggccgcattgtgtgacagtttggcagggcctgcaatcaaaggttttttcatgagaggcggtaattttacaaaaaactgctcctccctctttgacaaaaaaaaaaaagagtaaaaatcagttttgaatatacaaaatccgaattttatttgtttctgtgggtttgcgattgattcgagttaatccaatttatgtccaaattttcaaaaatttccgaggcctaattttagaaaaaattgaaattttagccccttcactaacagtggtgtgcaaagagcaggttccaacggctgccgacccgtcagtgaaaagtgactattttcgcttggacacaacaagttcggacgggtcaacagcaaccctgctcatccaccgagatgagttggtacagttgagaacctgtaagattgctgtcgcagtattttaatgccttaaaacccctttttttgcgggttttattaggcatggaagatgccgtgagagtgctcgagtcgttggtggtcaacaaagaatgatgcccgcttattggagacacgccccatgtccaatttttcaatttgtgacttgccacttaaactaaagcatggcacttacaactagtgccattccaaattctgccattcatttcttccgcgcagcacattttatttaatttaaaatattttattgtcacgattcgcaaaacatagtcggaattcaaaaacaaaaaaaaaacatgacgcatcaatttgagaccgatggagaagaaagagagaaaagtgtgtgttttgc

SEQ ID NO: 45304 - DNA, 1284 bp, Heterodera glycines
agaactcaattttttgaatggaatctgtccatttaaaactttataattcttatgccattttccatgactggcacaggagctgatcattaacattccttcatttgtctttttccttttatgtcattttgctttttattcacaattttctctttgggggtgtcgtcttctgagaaaaaacattgaaaagtaactgtaaattattgcggaccgacaattttttgtgttttagagcatcgaaaagttgccggaccgatgtcttcagttgattttctcctatttgtcccccactcaaatgctttccgtgggtcgagtgtgtcgcagatggaagggcattgcgtacaggtggctgttggaaaggaaattaagtgtgatttggcggtgccttaggcgcaattagtcccagcagttcccgaatttgccattttttcgagactgactcggcttgaattgtccatcttttgtctttttgctgctaatgtgccttttcgccctttagccccgtcctttggagttcggtgtccttccgtgtcaaccatggcggcattcaggtgacctcgaaacactcgcgtttcacttccgtaacgttgcgccgcaggtgaccaaccccgagcttttcgcccaaatgatcggagttcgctttaccgaactgcgcctttgtgagctgtccactgatttgatcactccaattgtatttgccaatgattttgtgccaaattcactcgaagtgccttttgccctctttaggtgctccatgaattggcgagtcgttgtccaaaactccaattcctcactttgggtactaatttattgtatcaagtataattggtccattctttttcagatttttccaccgctatgcaggttaacccatctgtcaattggcatttaaattataatgcccactggattaaaattggcacatttgcccctctcatccaaaaagtggcatctttttcatcccatttaatgacacttttttggcacattacatttaccccccccccccccccccagttgcacgacttcaacgacctccaatcgtttccgagtcgtctccgttctttaacgttgtgtctcagtgaaaacatttttctcgaaggctttcttcgtaaagtgtacactttcatctccaggtcactcttcttctcatcacaatatttttgcttattttcctctatttttagtgttgaaattctgcacattatcggttttcctcctcttccaataaattccattcgcttctcttaaggaacgtatgaaaaaggtggaggacgaggaggagga

SEQ ID NO: 45305 - DNA, 751 bp, Heterodera glycines
ttttgggggaaaccccacatgtacaccgggtgtagaaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgctttttggtgaaaacccacatgtacaacgatgtacagaaaaagagatagccattttctgagaatatctattcttctgagacagcaattttc

SEQ ID NO: 45306 - DNA, 1329 bp, Heterodera glycines
  misc_feature (678)..(678): n is a, c, g, or t
  misc_feature (686)..(686): n is a, c, g, or t
  misc_feature (1298)..(1298): n is a, c, g, or t
tcccaaaaaaaatctgaaaaaccaaggcggacaaattgatatgaaatatatatatgatcgtcaaattttatggattcatcccatttaaaatttgaccactcctttcttttttttggagttttttccgggctttagattaagcatcagggatgggccaaatcgaaaaataaaatgcgaaacgcgaaattccaagaaactcgaaagcgaaattttttctacaacttttttaagtcaaaatcacaaaacaaaaatcaatttaagaagcaataaaattttaattgttcatcaaactgtgtatttcttttacttctgcattttccatgtccttttgaatccctttgatttttttgttttttatttttcatttatgtttatccagcttccttagaggcatccactctccacttgttttatttatttttcaagaagatattcaccaatttaatttatttgcgctggcgtttggcacaaatgtttaaggttggcaaaattatttcataatgttggcggctaacataggccattcccgactgatatgtattggcacaaacaaataattgctttatcaattctgtcattttgatttttaaaataattataaatttatatacgcaaagtttcttttcgcttttttggcagttttattaaacgagccagcaattgctcaaaatttgatgncattagcnaaattgtattatcacaaaaggctcctaactctgctgatttatcagcattttgctgcttttcaaggagttaatgatggtttttttgagatgctgatttgctgatttttgtaaaaaaccctcaaaaatggttatgtaagattgctaccaaaaactcacgagttttcaaatttatggcgacctatttgacttaataaaattcattaaaaattccaaaaattttccggcgttgtttttgcttaaaatctggctaataaattacacttaaaatgtgaaaaatttttccctggcgccaccggacgctaccggccctctgttcccaaagttttttttttcaaaaagcaaaccgcaaaaaacatttttcttgtttttttttgataaaaactttacaaaatggtaattttcatcctccaaatgttgattttaaaaattcaattgggagccctgttatttgtaaattattaattattattattattatcactattgttatttaaatccttaaaaaaaacttatgattatttattttttttttattattaagtcctgaaagaaacattattgattcttttcgctggcaaatataattatgcttaataattatgcttatccganttaataaaataggatattattttatgttgta

SEQ ID NO: 45307 - DNA, 1550 bp, Heterodera glycines
  misc_feature (57)..(57): n is a, c, g, or t
acaaaaaatcatttccggaaaagccctttgttttatgtataacataaaggtcgcatntactccatagggattaatttaaattttaaaatatgataatgtggcgttttgttgcttttgcaaatttataattagcaaattaaatgcagttattaattgggggctaattacatacataatgctcatcattttgcttaacttttgcatttgtttatttacgatatgtgaaaagaaatggtgggccaaaaatgggcaaatacagaaaacgaaaacaaaaagatttgacacatcgcaaaaacaaagcgcacaatggtgttgagtcccatcctttctttttacaaatgatgagggcgggattccccaattttaccctaaaatttttcaattaaattggggctaaaaaacccgtgaaaatttaaattttttgactatgctcctcaaaaaattccaattttaaagcgccgaaacatatcaaaattcttgacaacagtaacaattgtttactgtaattaaaatcaaacgaagttgtacaaaaaattccacaaaataacggacaaaagttttcctctccctaatgaccccagacagttaaatatataaagaggggaatttggtttattgtgtttttggccaacaacaattaacagcagcagaacacacattaaacaacaaacataatacaacaaacacaatgaggtggaagaagaagaagaagaagaagaagaagaagaagaagaagaagaagaaactattcacaaagagaaataatggtgttatgataaaaaataaaaaaatgttgcgcaatgaaaagacgaaaaaataaataaataaacaaaataattaattattggacaaaaaacaaatattttttatttgaattaaattttttgttggcaaagggagggcggaaaggcttaaaaattgcataataaaataattgacgacggcggcggcggcgacggacattttaataataataatgatgaggttggatgaggttggatggcctgatcgaagtcgattaaagaagagggagtgaataaagcatcgctttagggatgaaaggcacgtggatttttacatggaatagcagggcaagagatagagaaagagtgggaatgaatagggcaatggagaggaagagggatatccgtgggataaagcggaaaaaagcaacgaaaatgggggttaataggacggatagaggagataaagcctgggaaaagaagagggaaagtgataaggagggaagataacactggaagagatgagatataagcatgggaagagaggcgataaaattgataaaatatggaaggagggataaagcgttgaaaaggatcaagaagataaaaggaaaagtgaggtaaaagcagggcaaagaagaagctactgctgataaggtggaggggtaaaggatcaaaaaagtggggataaagcataagaaaaagaggctaactaggtggaggggtaaaggatcgaaaaagtaaggataaagcatgggaaagcgaaaaagtattgaacaaaatgtgatccactgatcattgattgat

SEQ ID NO: 45308 - DNA, 954 bp, Heterodera glycines
  misc_feature (130)..(130): n is a, c, g, or t
cccctaaaattgacacgtgaataatgactgtgtattaacacgtaaatcatgcccgtgaagtaaaacgtaaatcatgcccgtgtattaacatgtaaatcatgcccgtgaatttacaagtaaatcatgaccntgaattgacacttgaattatgagcgtgaattgatacgtgatttaacccgtaaattgacactgaataatgactgtaaattaaacgcacatgaccgtgaattaacacgtgaatcatgaccgtgtattaacacgtaaatcatgcccgggaattaacatgtaaatcatgaccgtgaattgacacgtgctttaagccgtaaattgacacgtgaataatgactgtaaattaaacgtacatgcccgggaattaacatgtgaatcattaccgtaaattaacacataaatcatgattttgaattaacacgtaaatcatgactgtgaattgtcacgtgaattaacccctaaattgacacgtgaataatgactgtgtattaacacgtaaatcatgattttgaattaacacgtaaatcatgcccgtgaattaacacgtgaatcatgatcgtgaatttacaagtaaatcatgaccgtaaattgacacgtgaataatgactgtaaattaaacgtacataacccgggaattaacactgaataatgaccgtaaattaacacataaatcatgattttgaattaacatgtaaatcatgaccgtgaattgacacgtgaatcatgccctaaattgacactgaataatgactgtaagttaaacgcacatgaccgtgaattaacacgtgaatcatgaccgtgtattaacacgtaaatcatgcccggaattaacatgtgaatcattaccgtaaattaacacataaatcatgattttgaattaacacgtaaatcatgactgtgaattgtcacgtgaattaacccctaaattgacactgaataatgact

SEQ ID NO: 45309 - DNA, 1567 bp, Heterodera glycines
agcaagtttttattagcactaattcaacttcaactttatattacaaaaaaagaaaatgtttttcctactaattagaccggtgcccccacaaagtgtccaagccacgaaatgtccaaaagagtaaaaacccacgaaatgtccaaaatttttcaaaatttataaaaacaaaatgagtctaatttaggatttttagggttttcggggtcgctgaacatgagtatactatttatattacccgttgcctaaccttaggcccatccgaataataaaaaactcaaattcgagagttggacatttcgtgggtcagcgattagaccatggggaaatccatgaaaaaaaaattaagaatttacatagaatttacatcactaataataagttttatttataaatgttaatattttaattatgtacaaattaatttaaaaaggtcgtataaataattattttatttgaattgagtaaaatatttctttttgatttaaaaattattctattacctaattattttattatttatgattagggttataagttgtatgcactaaaaaatgcaaaatatgcgcataaatatgcactaatcccccaaatatgccctaaaaaccctaaaaatgcccaaatatgcactaaaatatgccttaaaaactgtcaaaaatggcttttaacttttaaaaaaatgccaaaaattgtgtgtataaattaagaattgacttttaaaacaccaaaacaatgggctaaggagcattttttagacaattgtaaaaatatttttattatatgctaaaacaaaattacatttttatatacataaattttttttacaaaagttcttacaaaaatttaaaattttttcgatttttaagggtgtattttaaaaaagttccaaaaagtcgatccttagggtgtatttttcgcttttttcgcatttttcttatgaaaatttgccaaaaattaaaaaccttcaccaaatcaaaaaattttaatgcagaaatgctatttttgagcccctttcttcatagcatatgcgcagaaaaaatatgcaaaagcatacaacttataaccctatttatgataattaaccattaaatcaactttttgtataagatttattttttaaaattttgtataaacaatttttcgctgcattttttctcttttatttgagaatgtttcatgtcccccgcaacactgtttttgttctcaaagggcgagaaatttgataaaagtttttctctttttaattttataatattttttagtaattataatccattttttcgtcatataatcaaatatttttatacgggaatctttttcagtttattttattatttaaggctattaaatttgcttaaattattgtagtgatttgctttagtttttattattattcatataatataataagttttatttttgtaactgatgcgcattgattaagcttaattttttgttgaaatttttttttttgcgtaatgaaaattaatattattatttttttcgtgtgtatttatgcatttttaatatttatttaaactttttatcatttttaaatttaatttttttt

SEQ ID NO: 45310 - DNA, 1712 bp, Heterodera glycines
ataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttttattcatctcccctttttgatagtgaaagcatctgagtgccctaaataacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggtccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggtactgccccgaaaacaaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaagaaaaattttttggataaaaattatttaaatgaactgactagataatatttaaaataggttatttctcttcctttcaatatccctgcaaagtttggtgcgcttctgatcagtttctgaaaaaaaagttaagcctaaactttttggcctgtttaaaaaggaattaaaaattttaaaaaattttattcatctccctttttgatagaaaaagcatcag

SEQ ID NO: 45311 - DNA, 822 bp, Heterodera glycines
  misc_feature (764)..(764): n is a, c, g, or t
  misc_feature (771)..(771): n is a, c, g, or t
  misc_feature (813)..(813): n is a, c, g, or t
tcataagtttgttttgtagcaaataatttttctgaaattttgcatgctaatagaaaacataaagtggtatcgagtgttaatagattttttcaatttgaacaactatggaaggagtatatatactcaaaaagccaggctgtcgaccagttggccatcgctcagttgtcccacaactgaagcccaaaaatgaggccaaatacacaaaatgagggaacaaaaacatccaaacaacaacttgtatagtaataaaattttgataacaataaagaaagcaaaaacaccaatttgtactgctcgagagtctcttctcagtcccggtatttaaaaaagcataaatattttttttaaataaaaaccgtgaaatttcatacatttttgagttgttttttttggttcattttaatctttgttctcgagtctcgcgaaatttcgactcttgagcatttcgcgaatagcaatgagcaatgcttgaaaaatagatcttcaaagttacatcacaacagaaaattggtgcttaagccggcggtcctctatcgccagggggcattacttacaaattgcaagaacttcaaggacagctaataagctaattttcaagtacataggaagagggtaaattaatgtaaaacctgattctttgaagatttaagatttcatactgttaaataaaataaattacatgtctcaggtcttaaactttcgttgggtggtggcacatgaattattttttggtatggattggcccgaaaaaattttcataattntcatccnaacagggtgatcaagatcatatttttttggatatggattggnccgaaaaaa

SEQ ID NO: 45312 - DNA, 773 bp, Heterodera glycines
atcacctctgctggatatttttgtggattctttgatcccttaataaaccaaagtttaacaaagagacaatcaattatccgtattttaaacggagaatgtgagggaaggacaaatgttttttatatatttttttcgtcttaaaacgggaattatctcttgtacagttcaggccccgtaaatttttttcaattagcaatcaaaaaacatttcaatatataggtttcggtagcacgaatccggcattcatttcggccaattccgaagccctggacctaaattcaaacaaagtcgggaattcacttttactaaaattaatttattgcgcaaaataggtagattttatgcagaaattggtcaaaatgaaggtacttatatgcactttactagccataaaaaaaaatttttttgaattcgtgaaaaagttgtttccataggttttcagcaccgctgatcaagaatctgacgtccgtttcgatcaatatcgaaccccgaacccgaattcgaacaccgacttttaataaaacaagtatttcctctattagatttaaaaaatatcaaatatatttataattactaagaatcaaaacttatacgaaaattaaacaattttctacttattgtttctcaatttatatagaaaaattatcacaaaattcaaaattcaaatttcccaatttctcatatcattacactgtgatgggcgcagagaccaaactaaaaatattttgatcatcgaagagcattttaaaattatcgatattttccaattcaaa

SEQ ID NO: 45313 - DNA, 230 bp, Heterodera glycines
ggggaggggggggggggggggggggggggttgtttttttttttttttatttttttcttttttttttttatttttaaaaaaaaaaaagaaaggaagaagggggagggggggggagagggagagggggagagaaaaaagaatgaattcataaaaaaaaaaaaaaaaaaaaaaaatttttttttttttttttttttttttcctcccccccccccccccccccccccccccccc

SEQ ID NO: 45314 - DNA, 1063 bp, Heterodera glycines
gcgggggagagtgactggaagagagtggaagcgagaggaagagcgcgcgaagcgaactagagagaggaagagcgagggaagacaaatagcgagaatgaggagggaactggtcaggaagacagagcgggcgcgacaggggggcgactgagccgaagacagcggaagaccgaggaagagagaggaagagagtggaagagagaggaagagagagggaagcgaaatagcgagagtgagaggggggagagtgagtggaagagagaggaagagagtggacgagagagggaagagaaatagagagagtgaggggggggggagagtgaatggaagagaagagatacaaaggagaggcggcgcttaaatgtaatgtataaaaaagaaaaacgagtcttttcatttctttcatccttttcattatttatttatttactttctttcaacacactcgttcacttcgcttcacttcatttcattcccttgctgttttgtctccgtttgtttgtcgttttttggccaataatacataattcattttaaattttaaattttaaattttaaattttaaatgccctcgcaattaagtgactataatcaatagggcttgtaattatatggatataaaatcgcgaaatatggccataaaatatggacaagaaatcgcgaaatatggacataaagttgcaaaaatatggacataaatttttcccaattgagcgtacaatttctcaaaattttttcaaattcgcttaacgcaaagtaaaactttcaaaaatggctaaatatggtattaaaaatcattttggaagaaaaaaaccgatacaacttaaaatgtactcatcttagcgaaaaatcaatctgagaagcgaacttttcgcttttttgcttatttttgacataaatcaactaatttttatgaaaatttaaatttaatcaatattttcgacaaaattttgataaaaaatgtcttttttggaaaaattttccgattttggggtgtcaaaatccaatttagctgatggggggccgttctaatagagattttttcgaaaaatgccaaaatatggac

SEQ ID NO: 45315 - DNA, 560 bp, Heterodera glycines
  misc_feature (207)..(207): n is a, c, g, or t
ggggggggggggggggagaaaaaaaaaaaaaatttttctcttccccccccgcccgcagggggggggggggcgggggggggggtgtgtgtttttttattaataaaaaaaaaaaaaaaaaaaaaacagaaaaaaaaaacaagcgggggggggggggggggtggccccccccctcccccccccgccccccccccccccaccccacccccnggggggggggggggggaagaaaaaaaaaaaaaaagggagggggggtggtgttttttctttccctccccccccccccccccccccccggggggggggggggtttattttatttttaataaacccccccccccccccccccccccccccaaaaaaaaaaaaaaaaaaaataaaattttttttttttttttttttttttttttgtgtggtggtggggggggggagggggggaggaaaagccccccccccccccccccccccccccccccgcggcgggggggggggggggggggggggggaaggaaaaaaaaaaaaaaaaaaaaaacccccccgcgggcgggggggggggggggggg

SEQ ID NO: 45316 - DNA, 881 bp, Heterodera glycines
tggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtccctaaaagagatagccatttttctgagaattaatttcacatttccgcagctctt

SEQ ID NO: 45317 - DNA, 886 bp, Heterodera glycines
  misc_feature (173)..(173): n is a, c, g, or t
attttgctttgctttaataacttttttgctttaataaaccaaaaaaaaaaaagtcgaggaaaaaaaaagagattgaattgggtcaaatttggaaaaggttgtcagaactgagaaaagtgcatttgcctgaaactcgtggggacacaacaaactcatttgaaaaaatatcaganaatttaaaaaaaaattccgggggaaaatgcgggacaaacgaactgcagggattttaaagggatccaataaaaagttttattacatcctggtcctaaatatggccccctttttaaaataattgtaaattttgtacgcaaaacaacagatgtaatacaattaaaataaaaacaatggaatattattgcataaatctgagaattttcaccgaaaagcaatgcctcggactctgtgccgccaacaatcacttccaagggccagtcaagctcacgccgcatttgctcaggcgatttggtgatcagctccccgtcgatcactgggcaaaagtcgagtccctataaatccaatcaatggaaaaatctttttttaatttttcccgtaaattgcacacttttttgtgccggttgaacgccgatttgccgatgagcggtgccgaaattttgtaggcgggaactgagcgcataaatgtgagcaatgagtccagatcagtgtcggcacctgagtgttcaatcaatcagagtgtggggtaataaaatggcattcatttttggtgtgtatttttgtttaaatcgataattattggtagaaatttttaaaaaatgtcgaaatcttttagtaatgaatgttttctattgtaaaaaattaaaaatcttcaaaaagtaagttttttctaatttttttttacaatttttcactgaaaaactaagaatttaga

SEQ ID NO: 45318 - DNA, 1425 bp, Heterodera glycines
  misc_feature (1324)..(1324): n is a, c, g, or t
  misc_feature (1346)..(1346): n is a, c, g, or t
aaattaatttttgcattttccggaggccttttctacccataagtttccatttatctaattttcttttgatctatcactcttccaatttgttctaatttattcattttatcttcccggataaatattattcatcatttgtcaacacaatacaaatttttctgtgttttagggatttgattttagttagtaaaattttcaggaaatttttctggataagagccatgctaactgatttgaatgaaacttaaaaatcgaaaaaattttgagccttttgtaagctttttgaaaaaatttgtttatgtaaattttatctagggtaatactaaacggtgggggtcgactgggccccggattaactgggccctccatctgggccccaagggccattcacattttccatttcatattgtcaacaactttaaaagacgatgtattaagcaaataaaggttcgccgccagagaaaaattaaacccaaaaattcacggtcacgaaaaccgtgaatttctcgggctttttggttcacggtcacgattaactggacaattcacgatcacgattaaagggtttttaagtaacggcacaccactagtagttagataagtagttatggacagtaactacttaggtacgtacttttaagaagaaaatgcaagcaaaactaaggtaatagtttagattaaagatcggcattttccaaatacacgggctacgggctccgtaaatgtgcccgtgaaacccgtgttcaataataacacgggcccgaccgcggatttttttgaaataattttttaaagtaaaaatcaacttgaaaaatacaaattttgaattttcgattttttgttcgaattcgggtccggatttcgaaattggtcaaaatgaatattggattcgggttcattggattcgggttccccgactaggtcgaatggatattatattcatgatcagcaaccccgaaaaacccataagacatgttttttcacaaagttctaaatttaagaatttttgtcaaaaagctgtggtaccatctaatttttgactttaaaatacaccgtcttttaataatttttgacaataaaaaatttttcggaaatcgggattccgaccccaaaaatgtcggaaatttttgaaaaatataaaatatactaccaattttttaaatattttaatcggctaaatttaaaaattcttaaccaaataaaagttgatttcaaaaataaatcggtttatttctatatctgattgaaaaaaaactcaataatttttttcaattttattcagttcagttttatttattttagatttagtgattagtctgggaanagctgaatttcttctttgagantagtatatactagttttagaggggttttagtgagtttcttgtttaataatttaaatgttgtgatcagatctaggatttt

SEQ ID NO: 45319 - DNA, 1264 bp, Heterodera glycines
  misc_feature (1245)..(1245): n is a, c, g, or t
  misc_feature (1258)..(1259): n is a, c, g, or t
gctggtagatacctgctcaaacggacgtgaactccttgagtttctggtcgattcggaaagaaattgctacaaatttccgcaagcggagcgaaattggacggtggcggcgggcgcaacaattggtcaaattttaattttaaatttcaatttttaaattaaagaagatttattattgacagccccctcccttttccaccatcattttgttaatgatatgcataattagtgtttcataaatttgattccattttaggttatattgtcggtgcccatcatgatgccaaccaagacggaataatccaagcgatgtttgaaaaagctgaaacaagcccagtgatcgggattggcaccgaccagcccggccaaatcagccaaagggggcccctcttcactgaaggcccaaaccatcgctcgacggcactcgcattggctcaatttttgcgccgaatgcattggcaatatgttaacgttgtgctggacagaagcgtacgtttgttgtttttcacttaatgtccgttcgcttacatattttatgcccaattgataaaaatccttaaattcccttcctaattatccgtttcctaattgtccctttgctaattacccccatccctccctcattacttctcattaccatttgctccccttcccttgttgattcttcagagcttctcttcggtcgccctcttcaagcagttcgaccgaattgcctcacttgcgggcatttgctttgccgatttggcaattattggtgaacaaagggggccaaatccgacgatggaacgcgaaagtgaaaacgaagacgggacgggggagggagaagaagcgcatctgaagaggacaaaggcaaagcgcggctcttccgcagcgaaggcatccgccgccacggaggaggagcaaaggcgacgtttcaccggcgttggccctcccagcgcaaatgtgactttggtgttcgcttccgctgagcaggtcaaaaaagggacaaacggaggcgggaagcattgttcacatttgcccattttaggctgctgaatatatgggtgctcgtgtgcaattcggcggcactgtcacgggcattccgactgtccatgtgatgctcggcgatgcgcacaatttccatttgcatgacccaacgaatttggcccaatttgccggcactttgtctttccagggaaaagtgagtgaagaaaatgtcaatttgccaattttggacattataacgtgttgaggattttgccaccgtgngaattccagaccnntgcag

SEQ ID NO: 45320 - DNA, 1269 bp, Heterodera glycines
cagctgttgatgggtgccgacgcctttggagttcgcgtgattttcttcgctttaagcgttttattattttgtttaacatcacttttttattttcattttttgaatgtcttagctagagtttgacctggacctggacagtttggaattgacactcaaagccaaaacatggcgataaacaatggcacaaattggcaggaaagactataaaaatatggaatacttattatacatgtccattattgttatttatttttttatttgtttattaataaaaagcagaaaaattgaacttttaactgctggtctctatttgttttaatgaattttgtttctgaggtttgaggtaattaattggcctttttgctatttttagtggcgggatttcgtctcattaccatttaattaataaattattattttaattaattatttttccaattatttcggttcttttcttttccgtttttctttttttcacctttttttcttctgttgctgacaaaccctccttctccccccatgatttgtgcttccttgaaaaaaaagattctttttgtttgtgattttacattgaaaaaatcgcacgaattttacgatgtttggacagtttaaatgtcgtaagaatctgaacaaacattgactttaattgagcaatttggcatttgattttataaatttgtcaaagggccaatttttgacagaattctaaaaaaaactatttttgctttggtatttaaataaatcttcttatacttaaatatttaaccatttgtacgtaactttcataaaacataaagctcttcaattgagcaaataattcgtcagcgaacaatttgttcggttgggccattctttccgcggtgagtgaatggcggggagggggcaaattgggccaaaatgctttttggcctttaaactcagtcagtctcattcaatctccaaatcccttttttccgcaatgcttttgcctaaaatattttcttaattcgaagccattgtaaatccatcaatttaaaatttatatttaaaattgttgtttttttcactttgaaatgatttgttccattctatcggataaatgcaattaataaaaaaacaatggctaataataattaagaattcaattaataattattagggaagcaacttttagtgaaaaaacttttttttgctcaattgttttgaagaaaggagctcaaaaaacgcatttctgcgttaaaattttttcatttggacgtcacttttcgtcactagaaatcactattttgg

SEQ ID NO: 45321 - DNA, 1241 bp, Heterodera glycines
tgctctgaaacgcaccaaatgttaattaaaagttaaatccgtttctctgatgctttcactatcaaaaagggagatgaataaaaaatctaaaaatttttaattgctttttaaatttgcgaaagattttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaattttttaataattgtttgagtacccctaacggtacacttgataaaaatcgatttttttgttttcgggcagtccccccgaacgatgcgcccagatttatggggagcctgatccttcgggaatagcttccctatagcctgttctataattctgcgttggatttttactccccataatcgtttgagtaccccaatcggtcacctgaaaaaatcgatttttttgttttcggggcagtccccccgaaccgatgcgcctcagatttatggggaggccgaatccttcggcaatagcttccctatagcctgtactctaattttgctttggatttttgctccccataatcgtttgagttccccaagcggactcttgaaaaaatcgatttttttgttttcggggcagtccccaccgaaccgatgcccccagatttatggggagaccgaatccttcgggaatagcttccctatagcctgtactataattctgcgttggatttttgctcc

SEQ ID NO: 45322 - DNA, 1511 bp, Heterodera glycines
acggccgcttcgcacacgttttttaacttgttaggctgcttcgcagcctcagtcgggcgtttgcgcccgtttttcaattttgttggccttgtacgggcgcttagcgcccgttatttaaactttgtttacctcaaacgggcgcttcgcgaccgttttttagcttgttaggctgcttcgcagtcttagtcgggcgcttcgcgcccgtttttcaatttttgttggccttgtacgggcgcttagcgcccgttatttaaactttgtttacctcaaacggccgcttcgcgcccgttttttagcttgttaggctgcttcgcagcctcagtcgggcgcttcgcgcccgtttttcaaaatttgttgaccttatagggattataagaggtacaataaatggtagaagaggtacaacagtgatcagaagatgtacaactgtgattaaaaaaggtacaaaagtgattagaagaggtacatcaatgattagaagaggtagaagggtaattagaagaggtacaaaagtgattagaagaggtacatcagtttaaattttatttttttacaaattcaatgtaaattgaaacatgatattctttaattttttattcaaaatttaaaaattatttttaataaaattttcaccaaaaaataatttaattcaaatgaaaaatttttatttattattaataaaattaaaaatattttaaatgaacaaaaattgaaaaacagaaaataaatggtagaaaattaatgtacaccgtccggatccgaacctgccccctcccccctcaaaatgatgcctcagaatccccaatcacacagggattctgaggtcttaacgatgtcaaaagtaaaatctgatcacgtattcgtgatcagcggcccaaataacccctaaagacatatttttggaggattttgggtgaaaaaaattttccacataaaaaccatgtgcacccccctttggtcccgaatcccaaaatcacttttatttttgtaacatctctcaaaaaagtgataaaaatgtaaaataaaatttatattatatagaaaaaaattgcggattttttgagtatattatttttccagaatatcttttcagaaccgagttatgaatttttttctgaaaaatcgaaaatttccagaaattctggaataactttttttcttttgaggatagaaatcccaaataaaccccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattatgaaacttaaaatagacatcatattcgtattcagcaccccaaaataccccagaaaaatatttttgacccccattttcaacccaaaaaaaattttcgaaaatttctagggggcctagctcgaaaatttttgaaaatttccgaacatgaagtacaccgttcgatagag

SEQ ID NO: 45323 - DNA, 592 bp, Heterodera glycines
  misc_feature (17)..(17): n is a, c, g, or t
atattctcagaataaantttagaaaaaaaacacaaataaaatttttgagagatttaaaagtaataaaaatttaaattaatcatttttataaattaaattttaattgcataacttaaattgcttattgaataagtaattgtttgttttcaacagcatgatggatgccggtgccattctgattgccatctcaacactgccaaatatggcgatgagttatgccggcgatgactccgcttacggtgtcaccaacaacccgcacgacacacgtcgcatcacgggcaaacattttaatccaattagtgttaatgagggctgtgtgtagggggaggcaaatacgctcccacccgaaaattttctaaataaaatttcaaactttgaaatttttcaagaaaaaaacagaaaattttcataaaaaaatttaagaaaaaaattgtcggaaaatttttcgagcgttattttttctctgaattaaattactaatgtgtttttttcaaaaattttaccaaaaaatcgttagaaacattttaaaaatttttctaagattttttcttgaaaagtttcaaagtttgaaattttttgggtggggcgaggg

SEQ ID NO: 45324 - DNA, 293 bp, Heterodera glycines
ctgcaggtctggtacacaattattgagacaataattaatgtcaaaattgcaaacaaaatccatgcaaatccttttagggcatgaaccgctctcgcgctttttccggtatatttttagcccaatttccggtattgccaacaaaactttcacgcgtctcgttcgcttacctttttaataattcaatcacttcgctaacattcggcttttgtaccattcgtaatacagaagacggtaaattgttcattttttatctatattccatcattgcttcttcaattctcattgtttccgat

SEQ ID NO: 45325 - DNA, 1380 bp, Heterodera glycines
acacaaagagcgtcttcggagggcccattcggctgcccttactgtgattctgttgaacacgctgactagcgcgatggcatcacatccggcactggtcgattcggccaaaatgtgcattccgaccgtggcgatcgtcgactcgaacagcggtgagtggcaataggaaatgaaagaatttgtccaataatccgtgcatcagagcccaactacgtgtgctacccaatccctggcaacgacgactcggttgaatccgtcaactttttcatggaaatgtttgcaaaagcaatccaaaagggccgagcggagagcgacacttttctggagggcgcgaaagagaagaagcatcagcagaaaaggacgatgggccagcggaggcactgaacgaacaaacggagggcgacgaatgatcggagggggggggggggcgaagacggactgattcctctgcttattctttgtttctgtccactttctatgtttaggttttctgaatacacttttacccttttaaattattttgagtgttttcccataaaagtccgctgctatttctccttatttcttttttttttttgattcaatttgttttctgttcgatgtcttctccgcttggtgtgaatgtgtttatcaccggcgccaaccgaggcattgggctcggattggtgaaggaaatgttggcggttggtggaatgaaaaatgtgttcgccggttgtagggacgtcgattcggctgcggtcagtggacgaacccttaggggaaattgaaatttttaacctcagaccaaaaagggaaaaagagctttaaggaattgcaacaactgcacgacaaaaatggaccattgcgactgatcagaattgacgtcagcgacgaccgaagcattcggacggcatttggccaagtccaaaagcaattggtggacaaaggcggactgaacttgctgatcaacaacgcgggcattcttctcaaagtgtgtgtgttgtggcacaaaagcattgtttttggctaaccgttccttttttcttgctaatctttgactctttctctgatcactctttgggctgatcggtctctctgctaatctttgactctttctctgatcactctctttgggctgatcggtctttctcttgctaatctttgactctttctctgatcactctctttgggcttatcggtctttctcttgctaatctttgactctttctctgatcactctctttgggctgatcggtctctctgctaatctttgactctttctctgatcactctctttgggctgatcggtctctctgctaatctttgactctttctctgatcactctctttgggctgatcggtctttctcttgctaatctttgactctttctctgatcactctct

SEQ ID NO: 45326 - DNA, 1222 bp, Heterodera glycines
caaggcagcaccagtatgagagtcagaatgtgaaccgcctttcaattaacgcccactttccgcaaagtcgagcaccagttacatgctttaattgtggaaaagccggccaaaaccatcataaaaaccgattcgggacaggaatgggtcgttttcattggaaaccgtggcaatctgctcccagctacggccttgccaacgacctgcgaaattcgcaccgctctggaatgccatattgtgaattgtaaagttgctaatcaggcacttagcaattacaataattggatgttggaaccgccggtgatgccattcgaaggggcagagagtgaaaaatggctgaaaatattcgggcaggcgccctggattctcgaaaccatccgggccaagttcgtgcaccgtttgccaatgttggagacgccgcgggtaataatcggtgactttacggcccaacaaatcaattcggaaatgacggacacagcgctggtgacttccgtggaggatggcttggcaggaattgtacgtcaatttgcaagcgtcattttgtcctcaaaagtgcgcgccgttctcattgtgtttggctgtgacgcactgctctcaggggagacgatggacacatcaccgaatatatcaaacgcatcaaaggactgtgccttcgttaccaggacgttcaaattgtatgggccatcccgccatatgtccacacccaaaaagtgacatatgatcagtttttggaggcacttttgacactgactgaaaattgtcccactcaaatggcctttatgacacgacaaggacgttcgttggccgaaatttttcgttacggcggtacccacaatggacagtacgtaaatcaaaccgggattttgactgacgcggggatcaaggccgttcttatctggttgtattatgtggcaaatttcccgggagagcgagagatgggacgaaggcgttcagtgattgggaatgtgccctcggggtctcaaaaccgtctaggcgacggtagtgggcgagaaaatgccgaaaacgaggtgcctgtgcgttctgagtcgcgccctgggagttcaaccggtcgccgttctttcatggccaatcatcaccgccgtaatgatgttgggtgtaaccgccacgaccggatttccgatccgcgatcgagtttcggcgcctaaggcgaacgtcgggaatttcggaaattcgcgctcgaatatccccgttagcactccccgcc

SEQ ID NO: 45327 - DNA, 782 bp, Heterodera glycines
atagaataaaattattatctaaaattactattataatattaatttataaaataattttatataaatcatcttgcaactgtcttcttaataagcgtgtgatcgaaataaaagtgtccattgcgactaccaccaaaagaacaacaatgggttttgaagaaaaaaacttttttttttaaatttatgttcgttttcttccttcaatggccgttttaaatgccaatggattttaggatgacgtggtcccattttggttgctcaagaccatttgaaagcagaaaatgtaaaatatttgttacattatcccccacgacgccttttgtaaaataattttctggccaatttgcaggttaatagcgtttataacattgagcatattgttattagctttaaaaaatcaaatgaaaaagaaaattcaattttgtaattttaaaatgtcaattctaaaattttctaattacaatagaattatgaacttttatgtgacagaaaaataacaaagttatacttaatttagattgacccaatgttattggttgaaaataaacagtaataaataatacatttaataataaaaataaattattatataagaatagattgtatgcgacggaaaatgtaaaagtgttttgcctcacgctaagagtaattaaggattcaaaaaagattaaagaaaaatatgaagcaaaatgttagataataagaaaactcaaatataaatagaataaaattattatctaaaaatactattataatattaatttataaaataattttatataaat

SEQ ID NO: 45328 - DNA, 1012 bp, Heterodera glycines
attttgattcactgcgggattggaactaaacatgccttctggacggatccctcggtatattatatcccgcaaaatcccataatcccgcaatttccaaaatgcgggattgcggattgagatccagcaaaatcccgcgcgggactccggcaactccctcactctagcggaaaacttattatactgatatttggtattagagcccggaaatttcaaatttgcgggtcctgttgcgtgattgaattcaaaatttttacacaacgggatccgcagatatatatcccgcaaaatcccataatcccgcaacttgcgaaatgcgagattgcggattgggatctcgcaaaatcaagctcgggattggaattctaaattttgcgggctctacgaatttggtatgatcatgtgagtgtttttcatgtttaagtgctgtgattatgatactacgcagagctatctattgtataatcgtgttttcactgtgctggcaaagtgttaggatttccgctgagatggtaattagttgacgctaatgaatattcctatttataaatatattcgaaaatatgcactagaatatgtaaataaaatgcatattttttggaaaaaaattcttcgcgattggacaagaaaaatgtgttggcaaacacttccgctccatctgtccaaatatttaatacattgattaaatctcgcgcaattattattattatttattattatgaattgtaatacgcacataaaattgtgtatatattcgtgaaatcgtatatgaaattatattcattaatttcatttattatacatattgtttataaaataaattttaaataaacaattcatctggtaaaactcattcccgaaaaactcattgccatctccgagaaatccatccaccatttgcttacaaaactcttttagtgaatttagggcatattcctaatggccaggatcttgagccttgtaaatttgttccgatttatatttttgctaatcggattttctcagcaaaatccat

SEQ ID NO: 45329 - DNA, 758 bp, Heterodera glycines
aatcggaaaaatacacccctaagaaatggcccgaaaaaaataaggatcaaaatttttgaattgattttcgaatttttttttgttacaaacttaagtttttagttaaatttttgaaattttaaagctaaaaggacgcattgagcctcactcaaacatgattgtaccttaaagatttatagataattaaaaaaataattttacctgcaaaaaatttaaaaaaggccagaagtgatcttttctatatgtctcgccccaggagattttgtccaggtttttaatatgcatatttgccctaggggatgagcaatcatctttataagcctcccattctgccctctgccgccttccccattaacgtgctgacgcgtttcgtaaaaaatgccacccatgcgcgtttcgtaaatccgccaatggaacaaaaatatgtaacacataaaaattcataacttagctcaaattctaccaaattaatatttcatggtatcattcaatagccttaattgttctctatcagaatataattttacaaaactttttacttaaatataaaaaagttataaagcattgaacacgctatgtttctttgcaataatcatgcaaacaaattataaacatttaaaattttctagtcataaaatgcaatttagccaaacttaattaatatcattcgatagccctaaaatttctctatttatctttaaaatttcatttagggggtatattctacaaaaatttttagccgtttttttgccaaaaaa

SEQ ID NO: 45330 - DNA, 602 bp, Heterodera glycines
caccagcattccatcactgggactcaacccccagcattccaatcactgggactcaacccaacagcatgccaacccctagggactcaacccaacagcatttcaatcactgggactcaacccaacagcattccaatcactggcactcaattctcctgcatttcaatcactgggactcaacccaacaaaattcaatcactgggactcaacccaccaacattccaatcactgggactcaacccaccagcatttcaatcactgggactcaacccaccagcatttcaatcactgggactcaagccaccaacatttcaatcactgggactcaacccaacagcatttcaatcactgggactcaacccaccaacatttcaatcactgggactcaacccaccaacatttcaatcactgggactcaacccaccagcatttcaatcactgggactcaacccaacagcatttcaatcactgggactcaagccaccagcattccaatcactgggactcaacccaacagcatttcaatcactgggactcaacccaacagcatttcaatcactggaactcaacccacagcattccaatcactggcactcaattctcct

SEQ ID NO: 45331 - DNA, 1724 bp, Heterodera glycines
  misc_feature (1665)..(1665): n is a, c, g, or t
aattgttcacattgtataaaacttaggaccatttttcccaccaattaaagatgtatttgccgacaaaatcagactaaacttttttacttcatttaaatattatttacattttttttttcaaatattttattaaaattcataatttgtgaaaaaatatgccgtctttttttgggtagcttcgaaaatatcttatgattttgagtattcatgcacaataagtgagggatttattttgaggcatgaaatttctgtctcaatttgtgtcacctttcaattcttcataaagaacaattttcatcaattattttttttttgtttaaataaattaccaaaatctaaaagtttcaccaattgatttctcaaataaaccataaaattcttatcattttaattctttattgagtttaaccaaaaattagctagaacccaattaaaaacccaattaaaattgtttcgaatttggctttcccacgcaaaaataatttgaattttatttttggcataaatacttcaccaatttggttgatgtggttcttttttaattggaatcaccaatttagttggtatggatctttttattgaattatcatcaatttttcggtaccgtcacaattaggtacgtcatgtcaactctttactttacctacattcccacacccgattaccgtatataaataagagcagagccttccgggcattcatttaaaaatttgcattacgccaacaaagcgctgttttccaaatttaattggccaaattgtgcaattgccatttcgtctattacatgtatttgtttgtcatttgttccgcaaatcagggggtttttgctgcgttttttttcctgacggttgatttagccaattttgagccactcacattaattctttttggtcacgaaagaggggacggcatttctgcttcttcttcttcatgaatgcttaaatgcaaattgcgtcttttgcctggatgtcacacagaaaagtcgtggcacaccaaaacccgcaaaatatgataatttgtcttgtctttccatgacaaccatattaacatttccataatatttatgtacataaatatgaattagtacaaatgacattttcattaatggccctcccaccatattattaggcgcgcaaaagtgcaacaaaacttttcacaaccataaacgaaaaaacatccaataacatggcatcaatttgcaatttcttactgtctgagaaaaatatcagtgaattcttttaaaaatatataatatttattgccatcccactgaggacaatctcgaattttctgataatttttgacaattttaattggaaaacatttcacgaaaaagaaaataattattttgtctattggagcaaaaaaaaaggttaaaatgtttgccacactgaagacaacaagttcaagcagacatttgctgccaattctgttcatcttctgctgttgctaccgcgccttttcaaatgtatgtcaattttggcttttttaaattaatttcaatttttttttgccattttagtttggtgatgcggccattgtgccattgtcagccctgggccgctacaaggtgtcacttggcgagctgaacgaattgctgacagaacaacaacgctcggctgacgcagtgccaagcactggcgacaaattgccaaattatgccanagttggacaaaaaaaataatttcaaaattgcattttcccatttttcgatccatacggag

SEQ ID NO: 45332 - DNA, 492 bp, Heterodera glycines
agtcattgccaattcaaatgccttacgcaaatttgcggacggaatcgaaaatttggtcttgcagtatctgttccatttttcagaaaattataacttttaaggaaatattagtttattttttccgaaattgtccgcaaatgtccaactgctattcaaataaatatttttaattattcatttcagaccaatattattattcaaagtcattttattggactaaaaattcaaaaataattaattgcaaaaactcagccggtgaacttaaccgtttaagcgtgcaaaaaaaaatagtaatttaaatttaggaattgatagactcaagcaatgggttttatgacaaaagcaaagacaaagtgacattggcaattgatctcataactgttgctgaaccaaaagtggacaaattaattttgtaccaaagcaagtcgaaagggacactttttatggacattgaaaaagtgtcgaaatttgcgcgggaaatcattttgagtg

SEQ ID NO: 45333 - DNA, 1078 bp, Heterodera glycines
  misc_feature (179)..(179): n is a, c, g, or t
aaggtgaaagtgcgttcttcaaaaaaacgggtcatttcgacctctgcaaactttttttgaaaaagcgaaggcacgttcgagcgaattctgaacataagaattttaagacattttcttatgaatttatcaaattcacgcaaagtcaaattaaaattttcggtacttttactgttgaggcncagaaaaatactcagattttattaaaaaccaaaggtgaccattttgtcttctaattttgttgtcataaaaaacaatgaaaacttgtttacagagggtttttgaagtcgccaattgtgatatcaatttaaataaattccgaaatccctcagcgactccgaatttttaaagcttttaaaaatatgggtaataaaaaccttaaggctatcgtccatttcacgtccgactatgcgtaaatcgcgaagaccgtggtgagcccttgtagcttgaattttgattttgaccaaccttcctaaaacgaaaggattcattgtttacaagtgaataaggtgaaaagtgtaccgtttccagaaaccgtttcaacagccagaccgtttacctcgattgttgacataggaaaattatattatcttaaaaaataagccatgacagcgatcaacactgagatcaattatagacacatccaataagttacgccagaaaatgcatcaaacacaaaatttttgtcggtgaaaaaattgaaaatcaaggtaaattcagaaaaactttaggaaattgaaaaaaatttccgtgaaaaacaactaggcttatctgaaagagcacaaaattattctctacaaaatgattatgaaaccgcagcaaatcctttacatgcagataggaaacgatatatatctctatttttgttgaattttatgcgttttaaggctttggacggttcagtcccacagccatttggccacttcagtcccgggcccataactcggcccgaagtgcgttccgcaaaaaaaattctttcagattcgtgttttacagaccgagaggacacgaatgatatatcattcgtccatttcggtgaggtacacaaattcttcaatttttccaaacattatttttaaaa

SEQ ID NO: 45334 - DNA, 1044 bp, Heterodera glycines
agtgagagatagaaaaaataagagagagtgcgagggatgagaggaggagacaaagggaagaacgagaaaagaagggagagtggggggggggggtggatgagagagagagaatgggaaagagaacggagaagggagaaagagcgagagagagagagagggaagagagaagggagagagtgaagggagcgagagagagagagaaagaggagaaagaagcgagagagagagagaagaagagaggggaaagaggtgcagagagagaaagagaagattgataagagaaaggggcggggagattagagagagtgtggagagagaggagagaatgtgtgaaagaagagtgaagtaagagcgagaggggagacagagcgagagagagagagaaagaatgagagagaaggagacagagagagagagagcgagagagagagagagagagagggaagagagaagggagagagtgaagggagcgagagagagagagagagaaagaggagaaagaagcgagagagagagagaagaagagaggggaaagaggtgcagagagagaaagagaagattgataagagaaaggggcggggagattagagagagtggggagagagaggagagagagagacaattaagagaaagaaggaagagagagagagtgggaagagggaagagagcgaatcgatagagaagggggggagagggggagagagagagtgaggggagagagacaacggagagagagaagagagagaagggagagagtgtgaagagggggagagagagagaagttaagagagagaatggggagagcgagagagagaggggaggagggaagagagaagggagagagagaaaagggagacggagagagaatggagagagagagagagggggaagagagaagggagagagtgaagggagcgagagagagagaaagaggagaaagaagcgagagagagaagaagagaggggaaagaggtgtagagagaaagagaagattgatcctttaaagggggggggggttagagagactggggagagagaggagag
